United States Patent 8,067,671 (METHODS FOR GENETIC CONTROL OF PLANT PEST INFESTATION AND COMPOSITIONS THEREOF) - sequence listing, part 24

SEQ ID NO: 31309 - DNA, 1588 bp, Heterodera glycines
  misc_feature (3)..(3): n is a, c, g, or t
ttntgctgagcatataaataaaatagtgaaaaatgctcatttaaaggcatatcatattttgagaataatgaagacaagagagctaaaaactattataagaatgtataagacttacgtcagacctcaattagagtatgctgttgaaatttggaaccctaacttaaaaaaaagatatagaacgaatagaaaaagtccagaaatttttcacgagaaaagcctttaaaaagtgcggacttttacatagatcatattcagaaagacttgaaatctgtcagcttatagaattagccaaacgaagaaatattgctgacttaactatcgcttttaaaattatgaagggttttacgagtcttgatgctagtaaactttttactttttctgatcgatcctctcgtaggccattacttttgagaatgcggcgcacaaccgcaaaaagcaagaataatttttttaacctataggtaagaattggaataatttaccaattgttccaattcagacagttgtgactctcgcctctcgccaaaactctcgctctcgtcttttctgagacaagtcacatccctgttacagggcactgaaaaaatgcacacatttaatgaaaattaataaataattttttgacaactattctcctgctgattgcatcaaaatttctgacttatgtacataaataagtaagtgttttggtgaatgtcatttccaaatatatttctcatcaatttcactcaaattcgaaataaattatttaaaaatataaaaaaaaacaattttattattttataactctgctcaccttatgatgaaattaaactcggcgtttgaccttccaaataatgatgcgttgtgtttattggaattttttatttacccaattggcagcggcagaagggaagtgtttacctcgttatttttgtttttatttgccacatttgtcttcattcgcttttttctctttaattttctaacaattgaattgctttttttccataatgaatttaaatttgattaattacactaattactgccattagttaatctatgccttttattattggcaatttcagtcacaaagcaattatttgattttccaaaaatggggaagggccgaactaccggtaatagcggaggaggcaaaggcggaagcggtggaggcggagacgaaaaaagcggcggaagcggagcggggaaaggaacggtggctgccggaagcggaggtgtacgcggaaagggtgccggacagagcggaccagcagcagcagcagcaggtgggacgaaatgaatggcacggttggagggaagggaattggcataattggcacagtgtaatggactttttcattggcattttcaatgctagcaaaagcattagttttctgtggtgagctggctggaaagaatggtacacttttccctactctcagtcgataaaattgtaaattgctgttttatcccatagttgagttttttcgtaaaaatgccgattttttacagattttccgagaaaaggtctaataaatttgcccaaaggtagtgaaagaatatggggggtatatcatagctctctgattgctagcataaatatcaa

SEQ ID NO: 31310 - DNA, 1342 bp, Heterodera glycines
cgggtaattcgccttccgcaccgatcagttcctcctttttcaggcggaccatctccgacttttcgaccatttgttccgcttgcaccaaaaagtcggactgatcttcttgctcttctgaacatggcaaaaaaactagataaagagcaggtctttgaatttaattcaagcagtctgtcagattcgtgctgagacaaaatgtgaaaaagtgcaagcgatcaaattaaatcaaaataattaattttataaataaaaacaaaataattgttttatttactttaaaaaaatattatttaaatattcgtaacttaattaaactttataataatcaataattattttgcttttaatttttgaaataattatttttgcttttaatttgatcactttcactttttcgttcttcgtcatagcaactgtctgattaaagcctcttaaattggaattgcctctttcgtcgctttgctgttttccatgctcaagttcggtgtgtgtttctgtccgcttttcctccatttgttttttggccctttcctccgccttttcttccatttccgtctcctcagtttcccgtttcagtgccgttagcttttggtgcagtttggtaagctcttccgcctccgattccgacatggtttcccttccgcttccccctttcttcgcctcctcctccccttgtcgcaatttactttcaatgacctgaaaggatttgctcaaataaaccttggcattttgaaaagcaacaacagctcagcagatgcttcatctcccctaatgcttggtaatttctgtttcgacccgcctgaatgattgtggtgacggtgctgctcagtttgaagatgatcctccgtctccgagttgggctcgtcgacgcggcaccgtccacgctcatctccacgaactttcgggtggccctgcactgcttcttcagcatttccatttgcagctcaatcctccgcagcatcgcctccgtttgcggcacgcgcccttccgcggcggctgagcgcacttcggcgtccaatttggccaaatgttccgccgtttgtgcgtaatttgtgcgcagtgcaatttcggcctcaatttcgtcggccaattcccgatggaaacgcttcagtccgtttttctctctcttcaaattggatgaaagtttttggagatgttttttgtgttcatcaacggaggcaatggccgcgacagttttcaagtccatcttcaactcggtcaatcgttttgccaataactgcaaaaatgctggactaatcaaatcagcatgaacatcgttttaattagcctttcttaattcctaccctggccaagttccaatcccgatctctatcttttcatc

SEQ ID NO: 31311 - DNA, 1448 bp, Heterodera glycines
attacgtccttgcgttgattttcggccattaaacaatatcacgattcccgacccatatccaataccgagaatggataagacaattttacgggtcgctggtcaaacattttattcaaccttggatttggcctccggattttggcagattccattggattccgaaagttcttataaatgtggcattgttaccccttggggactttatcaaatggtaaaattgccattcggactgagaaatgcgccaagcatttttcagaggaccatggacaaagctttggagggtattcggaatgtaaccgtatacattgatgacattttggtccatacaaatacggaagaggagcatttggagactttggaaaaagtattttgccgattgaatgaattcggattaaaattaaaaagagagaaatgcgaatttttgaaaaatgaatgcacatatttgggccatattttaaatgggaaaggctatcggccctcattgaataatcaggaagtgattgaaggattcccagagccggaaaatgccagggaagtaaaaagatttttgggtatgatgtcttttttccgtaaatttatccaaaattttgcggaaattgcaaatccgttacaacagttaacgaggggaaaaatccctgaatttgtatgggaaatcgcgaaaaagaggcatttgggaaattaaaaaataatttactgaatgccaatgcctaagggctccgaattacgaattgcctttttatcttttcaccaatgcgtctgctattgcctatgcgggagcgcttatgcagagccaaaatggcaatgatttatactctgtcggttattggtcccgaactttgtctacgacagaatcaaaacttcagcccacacacggggaattagcggcaatagtacatgccgtagaaaatttcagaccaattatttagtggcagatgcattatcgagagttgcaattaaatgggaacaaatagaaggaaacagcagagaggtcattccttttttattgacagttgatgatgaaataggtttacatcgaaaactatagaaaaagggacatttgaagatagtatactgtcccgagatgattcatcgggcacattttggcattgtgagatgcaaagcccgagccagagacttagtgtggtggcataattggtctgaggaagttgaaaattatgtgaatgagtgtcacatttgtcaacaaaatgcgtcaaatgaaccgcgtgtggaccccgaatataaatggcctgaggccaaatatccattcgaacgggtccacgcagacctcgcgggtccaatttgggggacgaatttttttatagttgttgacgcatattctaagtatccatttgtgtgtcaacgaagatgatgatgatgacgacatttattcaattttgattgagtacccacaatttcctgaggcccaacattaaggacgggacggttat

SEQ ID NO: 31312 - DNA, 1155 bp, Heterodera glycines
acgcttatatatatatatatatatattttttttttttatttaccgaaattaaaattgaaaaattatgtaaaaccatacacaaaaaatgtaaaaattctaaaaaaaatttaaattaaaaaataaataaatttaaaaagcaacaaaaaaaaattaatgaaccaaaattctgttgattttcccccgctgctgtttctttttcctcattttttctcccctttttttccctaccaaataattttggccaatttcgtacacttttgactttttgtttgatttctatggtccaagaagtgttgtcatttttccaaataaattgtattttattacttttaaaactttgtgaattttcgggtgcctttgtgcgcattaataaaacgaaatttaattaaccaaaatgtccttggccccaatttgggcacggaaagtcggccgatttaatgggggcgaacaatcggaaaattgaaaggaacgaagttacttaaaaggcattcattcccatttaaatttaaatcatcaaaaatttgaattgtttcaaaattaaaaaaataatatttttttaagaaaaaaggaataataattttaattacgcaaaatgtattttaataattgtaataataataacaataatcacaataacaatgagaagaacaagagcagtagcagcaataataacggtcaaattaatgcgaataaaacggcaacgacgccgcttcgatcggcactgaaaatgaacggacacagcgcaaacggcaaaaaacaggtgccacaaaacaatgaacaaatggcacatcaatcggcggatttaaccattgaaatttaaattaattgaaataattattaaaatattttttagttttaaatacctttctcagaatgcttttcaaccccaattataattcctaatttttaaacaatccaattgtaaaaaacgacaaacttttcaggcccattttccgctgcttggctccgatctgttgcccccgtccccgccgatcagttcccccgcctctccgcatcagtccgtgccaattccgtccacttcgtcggcgtcggctgtcactttcgcggccggcacttttactgatcatcggccgcaaatgccaagcgcagtagcagaagttgcagcagtgcctgatcatcgcgaccaatgcctat

SEQ ID NO: 31313 - DNA, 1509 bp, Heterodera glycines
  misc_feature (30)..(30): n is a, c, g, or t
tcaggatccaaaaaacgaatttgaaatttnaactaaatataatctactgaaagaggaattgcgaaaagaaaatgtttataaaaatatgacttgggttaaatttgaatgtgaaattgcaaaaaaattgggcacaaagcgaaaaaatatttatgaaatgaaaagaaaattaggacaaatacgaaagagaaaaacagtggttgttgaagatagggacacaaaaatggaactgatcaaaaaatttgatcaattgagaaatcaaaaaatttccggatttaattatgacgcgaaaaaacgggaaaaaattgcaaaagaaattgcgaataatttgggataaatgttgagataattcgcgaatggaaaaaggaattaggtaagatataaaccgtgacaaaatcaattattattactaattattatttatttttaggcataataaagaatttttcaaaaaagcaaaaaattaagaaaattaaacaatttgaaagattaaaagaagagtttattaaaaagtttaatttgaaaatgagtcgaaaaattagcaaaaaaattgctgaaaaaattggtacaaatatgcactcaatatgggattggaagaaaaaattccaattaaacaatcgtaatattttaataattaaatttatttttatatgaaattgcttttttaaggaaagaccaaaacttacacggatgctgagaaattggaatatgtgaaaaaatgtgaggaaatgatgaaaagaaacccaatgatgagtgagacgaaaattgctgaagaattggaaatccctaggcaaaacttaagacgatggaaaaagaaatttggaaccaatgaaataaattgaattatttttgtggatctaacaaaattggatattgagaattgggcactacagaatatattaaaaaaaaaagaattttcaaaaatattttcgtaggaatttcatcaaaaattagataactatcatcatttcgcattgataaagacgtatgtatcaacacattcattaatattttttagttcaattataacggcctttttttggaaaacttagcaaattaatttccgtaaaaaaatgttttaagcatttttttcgaattttaattccacttagctctcgtaaaatcagaaaaatggaaccaaaatgacaaaaataagcaaaaaatggaccttttcatgttacgtcattctaaaaaaaataaatttttaatttgctatgcagaaagaggctcaaaaatagcatttaaacgttaaaaatttttgatttggtaaaggtttttattgcatataaatccatattttgccatttttgcgtttttagtccatattttggccattttttggaaattttcacaagaaaaaaatgcaaaaaaagcgaaaaatacacccctaaagatcgactttttagaattttttaaaaaataaacgcaccaaaaaaagagaattttttcaaaattttggcaaattgtttgggtattttattcgcttccgaaatttttgctgacaacagaatg

SEQ ID NO: 31314 - DNA, 1491 bp, Heterodera glycines
ttcaagcagaagacacacattctttgtgcccgctttttgggtggtgcttggaagaccgtctcattggaggacatgaagattcacagaattaagtaaaaacgacatctgtatagatttaccaagctcttcagaggcggaatgagcaacatgcttttcctttgccgtctgactgaaaatcacccaccactaaaaggggagccggacaaagtccttctgcgcgtgtattttaacccagaaacggaaagtcatttggtggcagagtctgttattttcacccttctctctgaacgacacctggggccgaaactctatggaatattcagcgggggccgtcttgaagaatacattccggtgagcaaagggaattgcgatataatgtcgatggtaacaaggggagagatcattggcactagtacctggattgtttttcaatcttcgaagaataatagttataataaaatcgtggcaaaacccattaaaactattaagtcacggccacttacttgccatgaaattgcattgcccaccatggccaacaaaatagccaagaggttggctcgagtccatcaacttgaagtgccaatttggaaagaagttttgaatctttttattatttaattctttttcgtctttagccggaatatatttgtgacgcgcttgaaaggtgcttttcagtttttgttttgcttttcaaatgatctaaggtggcttattcaattgaaacaaatgcccagtggttctcgtgatttcgatttgccggctgaaagtcacgaatgggctcctccgagcataaattgcgaagatttacagaaagaaattgagcacctgaggtgtatttcattgagctattccataattccctttttaaggagattgattgtaaagagtcggagtctggttactttctgtcataatgatcttcaagaagggaacattctcttgcccaaagcacattctggcaatatccgaatcggctccgaatcggacgaaattttatctggcattgacgggaatatgacgaacaattcactgaccgccttcaacccgatggatccccgtctcgtgctcattgacttcgaatacgcgagttacaattacaggtgagtgcttttgtcattcacccacgatcgtgtaaacaaaaacggaaaagaaaaatcagcttaaaaaggaagaatttgccttcttaagtaacagtattgtttattgtaggggattcgattttgccaaccattttgtggaatacagcatcaattatgacaacgatgagccacctttttacgaaatgctcccagagaagtttccttcggaaggacaaatgcttgagttcatgtacaattacgagaaggaacttcgccctaatgccagtgaggaacatttgtgggaaattgcacggtcgatggtcgaagtgagttttggcctttctttgaccaatgccagcacattttttcaggaaactgttccttttgtgcccgtctcacatttgctttgggg

SEQ ID NO: 31315 - DNA, 945 bp, Heterodera glycines
  misc_feature (886)..(886): n is a, c, g, or t
aaaggcatttaaggcacgaaaatcacgaaaaaggcacaataaggcataataaaagtcaacgtagaagcctcaaaccaagtggaaaatgcgttttttatgcttaatatatcgaaactagtgcgcagaaaaaaaaggcatatgcctcaaaatccgagctctactgatcacagaaaatatagtcatagaggcaaaaattatttcatgaaaattgaatattttttaaaaattattgaaaattttagaaaatattttttaatcgaaaaataatattaaatattttaaactttaaactttctcaaaattttttaaagtattctctaactttttttttaaatatttttcaaaattttagtaacaggtaccccgttttctctttttttttatttaattttaaattgtttttcaaatcctttgaccctcgctcgtccgtcgtttttgccatcaatgacccttcaatagcccatcatccattttcaccgattggtgtccaaattgggaaatactaaaggtgaagaacgctcttcactcactgcaatttcttttctgctgaactggcgcctctgctcatttcttttttgaatttgttttgggtatattttgctgtccaaattgactttagacaaatgccattttcagcgcctttgagtgctgaagagccaatgtcattagccagcttaattaccgggtcgaactgtttaaagacgtgcggaatggaggacgtccaattcgcggcgagggttagtgccgacgaaggcaaacaaattataaattaatcactgattctgagggatatttgtcactttctctcttgtcgtggccttcccgagcttctttcctccgcctcttttccttcagagggcctccgaccttttcatcacaattcgcngttgtgccgttgtgctcacttcacttttggcacttttctttattttaatgattgcttta

SEQ ID NO: 31316 - DNA, 1587 bp, Heterodera glycines
  misc_feature (1558)..(1558): n is a, c, g, or t
ctgtgggcacaacttcttagagggattttcggtgttcagccgcacgaaattgagcaatagcaggtctgtggatgcccttagatgtccggggctgcacgcgcgttacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcactctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtatcaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggctggttcgctgcgcccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgngttggccgcttgttcaagtttcccttgac

SEQ ID NO: 31317 - DNA, 2506 bp, Heterodera glycines
  misc_feature (2191)..(2191): n is a, c, g, or t
cgtttcagaaccctttctgaaaaaatatttaagaattaattattgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcnctcgtggtgggcccttcgcccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaccccctttt

SEQ ID NO: 31318 - DNA, 738 bp, Heterodera glycines
aaccacttgcattccagcaatctcggtcatccaaataataataacaattttgtctgcttttaggttggaaccagcacgacatgtacagagagcagcgagaacaaggaccgaagtcgtccaggggaaatgtcagtcaaaagcactcgaaaaaaggaaattttggtgtttcagtatatgcgttatggccaagacagtcgcccgaacggagaagaggcggagggacagagaggggacagaggccgacggattggacagcagcggggctttggcggaggacgaaatgccactcataaccagccgatgacgagggacaatcagccgatgacgagggacaaccagccgatgaggggggaccaacgaatgggccgtctgatggaagaaaaaggcggttggttaaatttgggtccatgagtctttcgtattattgatttaagctgctgtgccagaagatgaagtggtgccggatggtggtgatgccgacaatgatgacatgggcggatttggtcgtgcgcatcgcacacgggctccttctaaatttgtttagacctccgtttttgggttttttgtttaattattattttgataatttgtcaccccctaattatggcaattgattattccaaataaattttgaaaacgcaaccaaataacagacaatcaatgaaacgtggttctctgttcggtgaatactgtcaaaaaataaatggaacaataatgggttgtgccggattgacagcc

SEQ ID NO: 31319 - DNA, 605 bp, Heterodera glycines
taatacataccgtatttgctctaattatcccccaatctcaaattgttccccagtctaggaggggtttgaagtttttcaaaagttatgacaattttttcatctttttggctagaacttttaaaaaacgataaaaatttttgaaatttggcaagctaataacgcagggttggcatatccaaagtcggcttccaaggaagggtatgccgatttgcaaggacataatggggaaaatattatgcaatttggttgcgtctaagaaaagttatgagttgatttagtcaaaaatttagcatattttgcactttttgtccttcgacatagcaccaggggaaatcagcagttgttgataaaatgggttgtatcatggcagcaaactcacaagggcgattcggacggaccaaaaatgatcacttgccatttgaagatctgaaaaagggggagagattgaatgaaggcaaaaatttgattaaaaaagaaagtgcctacattatcgtcaacgaggccacggacagcgaatccatcggtggggttcgtctgaagttcgaccaattgacgggctaacgaagcggacatcagtagaaaatacggcacgacacagcacaaaa

SEQ ID NO: 31320 - DNA, 812 bp, Heterodera glycines
attttttaagaaaatagatacaaattgagcctagtaatattaaaagccaaccttttttgttgaaaatctgttaacaaattacactcaaattttcaaaatttcccccggcggcgcctatcggcaccgccggacccccttcttccccaaaattttttcggaaaaagcgcgctgaaaaaagtgattgagaagaaatctgaatttctaatattcatttagcccaaaatgattaattgtttgaaatgattgaagaaaatttgtttaaaaattttcattaatttaatttagctttaacttttggattttattaaataaaaaaccaaaataaaaatttaattatttaatattttcacgtgaaataaattaaaatttgaaccatcctctgtccccactttcctcactccccctcccctcccccttcagatacctttgcattcgttaccccttaaactctcgccaaatctgttcaattcgtaatgtgcgcattgccactgtctgcatcacttgcatttccatcatttgtggccttcccaaatgtgttgactaccatttcgccgtttacgaaggccttttgtacgttgactcgggcgaatgggtccctctgaggtcagtcggtcccccccccccccccttaaaaggctccgtccccttttaagaagctgtctgtccggcttcactttcttcgtccaattggtcggccaaaatgcctttttcaatgcttacttttggactcgcgttgtcgccttcattctcctcccgtcccttctactcatttgccttaacgccctcctcatccaattggtcaattaaattac

SEQ ID NO: 31321 - DNA, 1618 bp, Heterodera glycines
  misc_feature (1553)..(1553): n is a, c, g, or t
gggactcgcaaagcagcgaacactccgtccaacaacaaccggtggttatctgaggggaagggcgtaaagagcagtgaatggcgccttcgcttttactcggatttcgaatgcaccgatgtccaacttggtcaacacttcgtccattattttcaaacattcggcctcttgcaccatcacttcgccatttccagcaatgtcaaagtcctaattttaaatttgggtgacatttccaatcctttgtgataaattcaacactcacacattggtagaattcccggtaacgaccttttgtcatcactggttgatctcttctgtacactttggcaatttgatatcttttgatcttttctactttatttgcagccaaataacgagcaaaaggaaccttaaattggacgaattaaaaaaattgtcacaactttatttaaaacaatgaacgaactcccgctaattgtccatatattcgaatgcgtttatttgtatgaagcaaagcatttcttcatttttagaattgtggaaagataaaattgccaaaaaattaacttaccgtgaggtcgtaccgcaaagagcaaagctcgcctccctggtcggcaaggtcgtagaccaacttcgtgccctcctcgccgtatttgcccatcaaaacttcgcgcagttcgaacaccggcgtctccattgtcaccgctccgtgtcgtttaaaagtttcagtgacaattgccaggactttttcacgagtagccatttgttcgggtccaaaatcgcgagtacctagtaaaaaaaaaatttgacatttcatttttttattaaaatccaacatgctaatacaatccattcgagatgacagaaaaaggaaaaatttcgatagacagataactttttagacataatttatgatttatggcgcaagaaaattttgggccggatatttttctatacaaatcggtgaattatattatattaaaattaaaaatggcaacctttcggagtcttcaactcgtatttggacttgaaatcgtcgcccaattccatctttttcttcataaccgcctccttttttgcttttacctgcaaaggataaaatgaaaataaattctggagtgaatattttgatttcggccaagtcgtatcccggattcaacactgttggttttttccataatttgccctaataactaataatgccattacttttaccacctgtcttcccgatcggtgtgtgtacactattcgtttaacgaaagattgcgaacaaaagtaattttgaaaaagacagatgggaatattactaaagtaaaaatttaaaacaaaaaataagtaaaagacaaacaacaaacttcgcaatttttttccgcgatgatatcattaacatttgtagcatcagaagctgcatctaaagccattcctaaaagatttttaaattctaaggcaagaacaaagcaaaaagattgaaaaataaaaaatatatttttttgaaaaaataaaataattggcattcaatttttttgctctattttgatttaaaaatgaaatcgttaactctcacggttatcgttgcnaattacaataagtgaaagtgaaatacaaaaaaataatttaatggcaaaaagttacctaagctatc

SEQ ID NO: 31322 - DNA, 1127 bp, Heterodera glycines
atttggcacgagtcgaacgctcgggacaagcccaggcggtctgaccagcggcttcacctctttgggcaggtattggcccatacgaaacgaaaacatcgacagcgtcgggttcaggttctgccgaggccaaaaggcgaataaatttcccattgaattgaaaaggcccttccgctcgacgttcgcctccaatccgttgacaccgccgcgggacacttcgacccctctggcgacaacgacggaagcacagaggcaagaaacggaaaaggcggaggagcaaagcgaagagccaccgagcaccaccccccaattaagcagggcacacggcttcgaccagggcagcagcagcgcgtacccgccattccccggcagagagcaatcgccggcggaggaggaaaaaatggcacgactaaaatacagcccaagcggactgtgaagagagaatgggagagagagagagaatgggaggagaggagagacagaaacaatcaaagaaacagacgaaaagcaaatttcaattaaccatttttgaactaatcaatcaatcgcatcattatcatatgcttaaaaaccaattaaaaacgaaggcggaaaaactaagactcaaaaaaacagaaagccaaatgtttgggcattattatccgtgttgaattttatgtacaacgaaagtcaatcaatcatttatacgcaaaagcgtgacgccgaaataaagaaaaaatgaaataatatcaaaacaatcattggtcacttttgaagttggggtggcaaagaaatcaacaaattcagatcagatctttcaagaagtttggcaaactctttaaaatcatataggaaaatgcataaaatttttacgcgtccaattgttttttatttttgtttgatattaagccgaccgaccttagcggacctggactcagtggtccgctaacgtcccggattttttacaatttcctagtttataaatttggtttttaaagattatggtattttggttctagtgcagaatacacgtcccatgggtttttacgcgtcccattgaatttcatcaattagctttttctttctttaaaattaaccaaattttttattatgtttccagaatagaccatgcttggcaaagcatgtccagg

SEQ ID NO: 31323 - DNA, 1018 bp, Heterodera glycines
  misc_feature (1006)..(1006): n is a, c, g, or t
caaaagaaaaagcgaattacggaaaaacttttcaaactcttgccataaaattcctttttcttttttaatttggatataaaattcaaaaatgtttgtaagaaaaaaaattaaatgattaaatccttttaaaaagttaatcaaaattgaaagaatcgcttttacggttaaaagaaattaattacccccccccccaatcgttaattagcaattatttgtcccattttcggtgtgcccactcatcgcatcgaagtcaaaaattggccatgagagaagggggggggggaataatgaaggaaaagagaaaacaaaaagggaaataaaaaacatagtgacaaaggaggctaattaatgttacacataataattaagaagccatttgctgagcatcgtttgtcaaaatgccaaatggcaaatgaatgccaatgggtcgaccctcgggggattatttgaggcgaaggcattgaaagtgcgcattcaatctttgctcagccaaaaaaaaggctttttgagtcgaattttagaccaatgaatttttgaaataaataaatatatttttggtggtaatttgcttttctccaataaattgggtgaatttacaattcactcactttagttttaatggtttaatttccccattttttaaatttgattataattaattgccaaatcttttcaaagttcattttgatttcccctttcttcctaattaacctcttattaattgatttccatttagcagcagaaggccccctccctttcgtcttccatttctcttttgtcctctttcgtccctttgtccgctttttcttcggcttcgtcttccgttgctgcgcccaatgaatttgttggctcagatcagcaaaaggaaggtgagggattacagttttaagctgatttgggtttaatagttattcctttgaatcagagagaaaaaagaaaataaaacggagaaattaaattaaaaagaattccaaggataaaaacggagaagactcgcgaatgctcnatgttctactct

SEQ ID NO: 31324 - DNA, 1407 bp, Heterodera glycines
  misc_feature (29)..(29): n is a, c, g, or t
  misc_feature (120)..(120): n is a, c, g, or t
ctcgaagactgtggtcgttgtcggcacgncagcccatcggtagaagaggcatgaagccgagggcagcccacacgaattctgccaaaaactggtgctgcgcatacagagtaaatgcccagnccgatgattgagggcaataagttcaggaatcgtctcccggttgcgaatggcactgcacgtgtttccgcgacacgatcctgccgatgggcatcgcttcacggctgtcgttgagatggagtaggaacgcagccaactttccgtttttggcacacaaatcatcgtgattgaggcgaggcaaagtcggacggctccgagcagctcgtcctgttgggttcgaatgacgaatgagttcgtctgatccgatggcagtagtgttagcacggtcgccgctgttcctgcgcatttcagtccttccgccgatctcgagcagtcctccgatcgaaccattacggagatgggcttggtagccattgtggtgccgaagacgagcagaagagggagaagtgaagccgccactactcccgtcctggccccatggccccgttcgggatgctgccatgcctgggccattgctcgagctctcctgccgagttgtagtcgccgctgtaactcccggatttctgcccgcgcaacttttgctccctttcgcattttgccctcgattcgttccgctgttggttgtgggagccgtcgtccagttgcccaattgatgaatttgacggggtagctgactcccaaggcaattgctcgggagaaaagcgttgctcccgaccagaatcgggagaccaatgagcaacagcagccgaaaacggctagcacaagtgccgctccaaaaccgaagagggtggatgcccaccgcgggtggcacgttgggttggcgagctgctcccaacagaagaagcagttgatgagttcacattcctctctcgctgggcaccgctgagtgacattgtaagggggggcccgactcccaccaacactgaccgctgcatgagtagccatgaatcagtacctcagccggtagttcgtagctgatcactgtcgctgttggcacagttgcccagcatccgtccgggcagcaaatttcgactttctctagccgctgaccgctgctggtcttcacgccgcgtttcgtgcattccatgtggcacggcagcatcgtcgtgtgcatgtccgggtccgattgttccgacggtggtagcgatggggtgggttgacaccccatgccaaagttgggcagataagtgccatcattaccgccaaggcgaccagggggaatttgctcccccttttatcgaccttccgatgctcaggtgaccaaattctccgtggcttgcgattccgctgtgattttcgtcgttcatctccctgcactgctcgaccctccgacaattgttcgttccgctg

SEQ ID NO: 31325 - DNA, 1020 bp, Heterodera glycines
aaaaaagagaaccatttttttgagaaattaattccccaatttccccagcttttccggtaatggaaaaaattttgaagaggctctccgggaacggattagcatcggggttacgagatagaaatttgtcctaaaaagagatagccatttttctgagaattaattcacattttccgcagctcttacggtaatggaaaaaattttgaagaggctctccggaacggattagcatcggggttacaagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacaagatagaaaattgtcctaaaaagagatagccatttttctgagaattaattcacaatttccgcagctcttacggtaatggaaaaaattttgaagaggctctcggaaacggattaacatcggggttacaaaataagaaattgccctaaaa

SEQ ID NO: 31326 - DNA, 1588 bp, Heterodera glycines
ccaaaaaaaactttttttaaaaatattttaggcatgaaaagtatagggcaatttttccccattaaacataaatattgtattagctgtgaaagaacttatcaaattgaggaaaaacacagcctggaatgcgaggaaaggtgtaaaaaatgctgtagaataggtaaaaataaaataagtaattttttactggaaaatctaaggcttcgatttcccgtgccccccgggaagaaaaacattaaaatgcgataattgtaatagatctttttttaatgagaaatgttatgagtaccacaaaaagaaaatatgtaatttatacaaaaaatgcacgaaatgtcaaatggagtacactactgatactaaaaataaacgcgaatgcggtaaattttaagcataaatagtgagattgagaataaaaatatttagaagaacaacattgtagaaaatgtcatttattccatgatccaaagaaattatgctttatgcaaaaattgaaaatcaaaaaaatggccccatataggattgttgcttacgatttggagtgcacggtatttatttttaagttcaaaaataatattttaatttagactaatacaattttggacgaaaattcgctgagaaaagagactgtacataaaccgaattttattagtgcccgatttacctgttcattatgtgagggagaaataaaggattgtgaaatttgtgggaaggaaccgcgacatttaaaatggtgtagtaaggatgggattgacccgttactctttcgttaaatggattataaatttggaaaaatatgaaacgtatgcattcgcacactttagcggtgagaataaaaaaaataaaaaatgatgaaattcttttttagggcgttatgattcacactttgttttgagggacttgcgaatttgggatataagcagccggaattaacgatagcggatttaaaaatttatgagattaagtttagaagaggcgaaaaattcccgaaaattcattttcgggacagttggcttttaatgcaaaataaattggctcacctaccaaaaacatttggtttggattgtgaatcaaaaatgtactttcccaatcaatttaacaaagaggaaaattatggtaagaaagaatttccattaaaaaaatatacccaattttaggcataattttgacaaccctcccgccttttgaggattattttcctgatgaattaagtgaagaagaatatgacaaatttaaaaaatggtattatgcaaattataacagtggatttaatgtggttaagttaaaaaattttttatattgaactatttaataagacgtgctgagattgtcaacaacaatagcgtcttcatgtatgaagtagggaccaaaataaaatgaaaataaataaataattttttagcatttttcgtgccaaatttttaaaaaatagcgaaacaatcccgattattcctgagtgggtttgaaccaaaagatagtcaaagtaatatagcgatcaaatattttgaatggattatgcacagagacagagttagagcaagacatgccggaaatgggggagaaattatgctttttggcgataaaaaattaa

SEQ ID NO: 31327 - DNA, 1347 bp, Heterodera glycines
aaaatatgagcacctttaccgctcgttggtttggcgtattccccggctgcccgaacgtgaaagtgccatttacaagtcgtacatgctaaagtaacacagaatattgactccaatttgacttttccattgtttctcctaaggtgtcgctttgaattgtcctcctttgatctgatgcccgatcactttgagccctgcggcgtcgtcgaatttacaatgcctttggcggtgatcagcaacactgtggtccgatcagtgggcgtggagcagcacgaagacagcgaaagtgtggagaaatttgtgcgctatgtggccaagtgcaagtacaggtagagagagaaagaaattagagagaaaatgagtgagaaaaggagagaaaaatgacagagaaatagagagagggaaggagagagagtgggaaaagagaaaaagaaaggggagcgcgaagagatgttctaataatgtgagctattcgagaaacctttcgagaagatttgattccaagacccgagattaatatagagtcgaaaccgagactcttgattactctctcgacaattacctaattaatccaaaatcccaattgtcggaataagttcaaaaaatgaatatgaaaaaacagaagttctttaattacagtttggaaatcgattaccagcaatgttctgacttggacaatgagttggccaccagcgcagcagagaccgaagagccagcggaaccctcgcgccatttggccgcgtttgacccgaaagatgtgcagcaaagacacgaggggtaataaatgtttcagccaattgtttaagcatttgtcacgcttttattcctttatcagataccgtatcgaattgcccgacgaccgtacgaatttaacaaaaacgggagacgaaaatggagacgataaacgaaaacgaaggtcgagcagtagcagcagcagcaatgacgaggacggggggagaagggcatttccggtggtccaaattgacatgaaagggtacggctattgagaagagaagaagcgacggaatgaatgaaagggcaaacaaaaaatgcattaaccgaacaaatgcaataaatcaaattaattaattaaatatttaaaaagataataataaaataacaattaactgattgtttggttgttttttgtcagtttctccaaaaggccaaagctgagaaagggccgttccatcaaaacagtgaaaccttttcaattgtatccatttgaaagttcttcgaaaaccccaccaaattcaaaacatcacatcgccatgccggcacggaaaaaggtatttgaagaagtgtaagaaacaattatctgcctgccacttcgctgctgaaataattgaa

SEQ ID NO: 31328 - DNA, 1055 bp, Heterodera glycines
caagtattatcaattgatgggactcatacttagtaaaataccattggacccataaaagttgatgaactcataaagtgcattagaaacctcatttaatttttgtccttgacttttttaaaactcaataagattttctgaaattgaacagattaatagagaaatctttgggctatttttcatatcaagtgcggtttcaattaaaatggcagagcatttcgtaatgcaaattttcatttttacctttaactcggaggactttgacaaaagttatgacggttttttgtcgaaaacaatacgaaaaaagatctttataaattaatgcgtacatgcgcgatttcttttgcgccgcaacttttatctttttagttaacaaagaaaaggtccataaaaaggggaaataccaaaaatgggatttgaaatctataaaaagtctataatttaatttaaaaaatattcaaaatattttaatccaacaaacagtagcgcagctttctttatccctggaacataaaaacatccatactaacattttccgtcccataaaacatgaaaattttgttacacctaacacacaccaaaaacaatgtgtcatcgagagtgctcttatttatgctccgtcactcttctccatgaacagcgtgtaggggcacaacggcttctccttggtcccgtacaacaccatggccaagatgtgcatgccaaaattggtttcagtctcacatagcattcctcctgcagcgcgcgcacctgcggattgtacagaccgtattgcccatcaccaaaccgccacaacgagtgccctctgggagatgaggcaaaattttaccatatgccttgagaaaaaagatagtgaaaatacggtagaaaatatttgtggtaatgacacagtacagtatagagtactgctaaaggctttaagggttcaaacaccaagaaaaaaacaaatacgaaaatattcccccccccaaacgaaaatctaaaaattttatagactattttcgtaacaaatagcactcaaattttcaaaaatttttccggcggcgcctatcggcacc

SEQ ID NO: 31329 - DNA, 1694 bp, Heterodera glycines
tttcagaaccgagttatgaatttttttctgaaaaatcgaatatttccagaaattctggaataactttttttcttttgaacattataaaaccaaataaacctcataaaattctcccgattttttgctatttttaaagctttaattcacttaaattgagcagtccttcattgagttatgaattttcaaattttaacccaaatttccaaggaccaaaaaaattaaaaatattttcgaatttttaaaaaattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaaatttccggccatatggcacaccattcgatagagcttaaaaaagtctacaattttgccctaaggagttttttcgataaaaccaacccctaacgagttatggacccgggactcaaatgtcccgcacaggccaaaaattttttctatttccgggaaaaaatcgaaatttttccgaaaaaaataccagtcgatagagctcgaaaaactatgttttggaagtggtctcagtttctctgggaaaaatcgttaaaaaatcctaaaattcaaaaacccgaaaaccgttttttaggcttagctcgaaaaattttcaaaattttcgaaattttaaaacttggttggatagcctttcaaatactacacatttttgctcagaaacaatttttcggtcaaagcaacccctggcgagttattcgcctggtactgaagtgtacattttgagcacacttcaattagccaagcgtgcaggccagggggtggctctaataaaaaaataaaaaataccagcatgtagaggacagttgtggggagtgccctcacagcgggcactttttgattcgggttttagaaaaaaagttacaggccctaaactgcaagaaaaagtgagaaatcggtccccgggactcagtcgtccgcgctgaatttttctctatagttttcccggatgctcctcaaaaagttgtaagacccttccactactttcagggcgctcccggccttcggccgggagattttgttttttgaaacgaaactcaaaacctatataacatatatataactagcgggtgcgtgaaccgtcggctatttagctgggataaagcgcttcgcgctttgggagcttcgctacctagattagctatcgggttgtgaaaagatttggaatttttaaaaaattatcagcgatttttaggccgcttcgcggcctcagacgggcgctacgcacccgtttttacgttcggtgatttttaggctgcttcgcggcctcagacggaattctgcgttggatttttgctccccataattgtttgagtaccccaaacggacacttgaaaaaatcgatttatttttggtttcggggcagtccccccgaaccgatgcgcccagatttatggggagaccgattccttcgggaatagcttccctatagcctgtgctttaattctgcgttggatttttgctccccataattgtttgagtaccccaaacggacacttgaaaaaatcgatttttttgttttcggggcagtccccccgaaccgatgcgcccagatttatggggagaccgaatccttccggaatagctgacctat

SEQ ID NO: 31330 - DNA, 969 bp, Heterodera glycines
gataaaaaaatcatttggtaatggattcaacagaaacggaaaaattagcactttgtggaaaatattttacttacagatttgaaggtttcagacgcggtgtagaatcttaaaaaattaatactatttaaatcttttataagatttacgcgatacaaattaaggaaatagtgaagttcatgtgatcttaatagaaaatggataaagaaaaggtggtttattgaaaaaaatggtgttaattcgcgtgcagaatctataaataaattaatattattttaatcatttaaaatattttagttatataaatgataaatcgaaatgtattaatgctcagataaaaaaatcatttggtaatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataaagaaaatgtggtttattgaaaaaaatggtgttaattcgcgttcagaatctataaataaattaatattattttaatcatttaaaatattttagttatataaatgataaatcgaaatgtattaatgctcagataaaaaaatcatttggtaatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataaagaaaatgtggtttattgaaaaaaatggtgttaattcgcgttcagaatctataaataaattaatattattttaatcatttaaaatattttagttatataaatgataa

SEQ ID NO: 31331 - DNA, 2101 bp, Heterodera glycines
aacaatttgtagacttagccaaaaccgtattcagtccaaaaccagagaaaataaatctagtttttggttgctcggggtcagttcggagccgaccgtttcagcgccaccaaatttgaatgttataacttttttcattgtcagttaaagttaaaaagtctggcatcattgaaagttctatatgttctctatatttaggtgtcaaaatagaaaagaatgattcaaaattaaaaaagctatggcaagcggtgccgaaaaaaccaagaaaaagtcaaatttttgagtaatttttttatgaaccggcgaaattttttgcaattttgaaggctaatagagaaccttaagagctatcgaatgataccaagattatttgatttatttgacaaaaaagataaaaacgaaaattgaaaaaaactaaaatgtaaattgaacgaagtcagaaaagtggatcgaattcccgggttatctagacagatatggacgatacctgcttcacacttcaaccaaggagagacgagcatgcaatatggcctaccacgatgtctcgcgcgttttttccaatatgcctgataccgcgtataatttgggaacgtttaattgcaaacacttggcacaacattttttttccgctggtacgtttttgccatagaaagggggggggagttaaaaatcagcaattataattccgtataatctttttttcttcacaaatttgtttttttatttatagggcatccttggatttactcttttattcttaccaaaatttccttttttccttttattttgtttttgctagatttaaatcgacatcctaagttttcctgtaattttctaaatcgttttgcttttttaccgttctccccctctctctatctctctctcttcctgtatcctttatttatagaaatgcccgattccgactccgactcgcagccaaacactgatttgcaatcttattttaagaagcgacagaatgcgattgcggtaatgaacacatggtcgcaatagaactgttgtggcgacaccacaaaatgtttgacggatgggttggttatattgcaacccatgacgcaattcgcctgcgtttgtggtgccggaattgcaatataagactttgcgagacttacgaattttcccgcagtgggaagaaaaaaaggtgggcttttatcaaaaaccgaatgaaaactccatctgcaattttcattattcttttgaaatgaacaatttgtagacttagcccaaaaccgtattcagtccaaaaccagagaaaataaaatgatacccaggattatttgatttatttggccaaagaaaaaaagttaaaaacgaaaatgtaaaatgaaaaaaccgaaactttttatattctcttcaccctccccccctcccttctcttctcttcccctcccttcccggagggtgttagtctttgttctgtttagtggctgtcatcgacagaaagccgaatggaacggacggataaggaaggggaaaggagaagaagcgaatcggacaaggaggagggcgcacaacacacagagttaatgcccacccgcccacccattcgggaaacgaatgggacggagggcgaagacgacagccaccattactcactcactctctctctctttctttcgctctcctataactacttttattcacccttcccccactccactctctatctttcattttccatagtgacttcccttcttctaacaacttttattttcttttctttcctttctttctttctctttcttttatctctctctctctctgtctctttctttctcgtttttttctttctttccttcctttctttctctctttcatcttttttcctttctcatcttctccttcctctttttcttatcttccataattccttatgccttcttcactttctttcttttcttttcatgttaagtcagagaaggaagagaacagacatcacagaattgtcccaaaactcgctttatcggcaaaacggagaagaccgaaacgaagtcggcctgccattctcttctattctcatgttctttccttatctctgttactctcctactgcctccctagtcactctccctcccctcccttttcc

SEQ ID NO: 31332 - DNA, 1805 bp, Heterodera glycines
  misc_feature (886)..(886): n is a, c, g, or t
  misc_feature (912)..(912): n is a, c, g, or t
aaaagattttaattatattttaaattttaaaaatgtgccatacgaggtcaaaaatgatgttgacaagcgctggtaaaaagtcaagggttagtgcgaagcataatgtgacaacgacatagcaatttttcttaatatttcaaattaattgtaggtaattactaattagcataaaagagggtaatccgtacaaaaatgataattgatcaattattaataaattataaaatacctttttgatcattgcgcagctaattgtatgaaaactgtacaacaaataactgcaaccaaaaatgttcatgatgctgatggtacacttgaaaaccaattgaggaatgttgtgccattttaatgggagtcatttattttatgatatcatccgatagctttacaagtgtttggtatagcttccaaattttgaaaatttttgttaatttcaaaaaggttattaccaaaatatttcttccaaaatttttggccatcttttttttcaacttattaaaagtgatttttttcgggaactatgtataatgaaaaatataatttcttccattaccgtaatctcgaccatattgttacagaaacccctgctgtttaggtaacttaccaattttttaatgtatttttcgaacccatttttatggaaatgcatgctcattttaagtcattagtagttatcccacggggagcgtcccaaccgtcccaggtgtgaaaacaggtgttttcaaggtgtgaaaacatgtgttttcacacctttgggagggggtgtgaaaacaaggatcgcccccggtgttcgtcccaaacccggtgtttgtccggggctggtgcgggaaattttccagccatttttttctggcgtttttttgaaaaaatttttttctaaccaaanaggtatggccattactcccccatatnttctcagtaccttttattgaataaattattttcccgcattttttctggcgttttttaaaattttctagtcaaaacgtatgggtaattttcagtaccgattattggcatactgcaattaaaattttaattttttaattttaaattgtgtttgtttgtttcttttttagattttctttaatcgtcattacaaatatttattaacagttttattccaaaaaaattgattttcatcccatttccctcattaattcccttaatcaaaatttaatcgtccctttctgcgctcctccgctgcctttcttctcttttggtactgaaatgctgcaaacttatttgcagcatcgaaggccgattgtgagctgatggacgccgtcgtggacggcccaggattttgcttctcttcggcttccttcgccagtgctcgtttcgcccattcccggaatttctttccaccgcactttttgttttttcggcgctttgtttttgccaagtcaatgccgtgtgcctattttatgcaaagtaaaaaaaaatttatccccgaaatttgcacctcttcccccagttgaatttggtccccaacctccatacaaaagctttcctcgtcttcctcctcgcccgattctgcttcttcttcctcctcctcttccaaaccccttttcggttgtgcttcttccgcctctccttcttttcggtttgcttcctcttccaaaattttttggatcatcagctccgggctctcggtgaatgccaccaattggcggttgcttgcccggagccgttccttgacaacttccgccttccgcttttcatactcaactacatcgacgcaaccatcctttaaatttttattttttaattatttaaattctttttttttcaccatttcggttgac

SEQ ID NO: 31333 - DNA, 1490 bp, Heterodera glycines
aaaaacgggaatatataaaaagcgggacagaaaatgggatttccgcttttctgtcggctcgaattctttcacaacagtaaagactaagtaagcattcgacttgcaatacacacatatatcccgtttaaaagcggctccataattaaactttttttattattttttaattgtcagaatttacaaaatttcaaaaaaaaaaaatgttcacacgcagatgacaaatggttgttgagaatgatcacaaagaaaagaaaataaatgatatttttcgatttcaagtgcctttttgctttggttggccatcgccgccggcttcgattcttcgcgctttatcttttttttttgatcagtcacaacactccgccaaacagcaaccgcagcagcatgccaacaatgcccacagacaacagttgttgctcccttgctgttgcggacggtcgcgctcgacatagctgcaaaagagtggccaaatttaccacaaatttaccattttatagaaggctaacaactcaaaatttagaataacaatttattgcaaaatctaagaaaaattcagtccgaaatttttttaaaataaaaatttagtcattatcaattttttaaattaggtaaaattgattttaaaatttttttgctatagagaaaattaaggtgattgtagtaaaaaaactttctgaacagtttttattggttagtatccaaatttgctaattaagtgttggataatccgtgtccagacatttgcgcctatgtccaaaataaggttcaaatttaagttttttttaatcctagaggttttaaacagcattataattatgaaaattttgttttattttttctagaatttgttgacgataaaattgtcacatacaatcactttcaatcgcttatttaaggcagtttagttcatttgggttgaaaaccgcaagttaaaaccctatttttggcataggcgccaatgtccgaggcgcaaatgtggcgtaaatttataatcagtgaaaattattttaaaaaaattctcgccccatagaggacaaaaaaaatggaaggaaaaaacgcacacgacttgtggctgcggttgttgttgctgaggatagccaccaccaccatatgagttcggctgttgtgggtacggttgcgatgggtaaccgtatccaccgccgccaccaccgtagcccggctgaccgtagttgggctgtggctgctgcgggtactgttgcatgttcgggttgtacggcggcggagcggacatttattagttaaactttttgtttgtgcaaagcgcacaatgacaggacgacgcggaaatgaggtgaataaaaaagttttgtgcactcaaacgaaacttagaaaatggttagaggtcatgtaaaaatggaaacaaaatttatattgagcaaaaacattttccgtgtaccaagggtgggactcgaccgcgattcgcggcgttttttttcccgcgattcatgaccgcggcaatttgatccgcg

SEQ ID NO: 31334 - DNA, 1242 bp, Heterodera glycines
tcaatgctattaattttaaatgttgtcaaatttacactttaataaaaaataataattttctattaacaaaaaaacatcgaaaattgaaattaacacgcaaattctgctacattttatgtaatatttaaaaataatttagtgatatgtccatatccaaaaggaagatatactaattgcccttttaaataagacaaacaaaattattattttttatattgaatatttaaagaggctgcataaaaaatgctaatttaaagtaatgtacctttaaaaacaaacttctgtagtcactgacatgaggcttcaaccaactctgtcaagagaaaatatttgtaattatttagatattcaagtaattaaacaaaatgttacttatttaaatttttagttaataaattacaaacagccgttattctatcatttaaataatactaatatttatctataattcaccaaaatttgcaacgataaccatttctatcagcgttataatatatcagaatcaatcacaattaattggtaatcatgaaaacaaaaattaataaatagtagaaaactttggtttcctattcaataaatatttttctcgaatatcttattgcaagtaaaagcaaataagcaaaaatatcggtaaaataaaaaactaaacaaaaatatacgaatcaaagattttaaatgttgttatacgaacctacactaaattataaattaaacttattaacttttacatttctcaaaactgttaaaacccaaattttaacatgctctctgagtcgttgttaattaataaaaatgtagcaatcttgaactcatttttgtcataaaatactaaatttacttcgcaataaagaatcaaaaaaggggcggaggagtatccataattttagaaaaaaactatccaagattaaataaattattatagaaaattaaaagcagttagcataaatttcataattattgtttaaaaaataaaatgaaattatacaaaataattgctcgaaataaccttctttaccgggattctgtctgaatatcggctacccgacttttggggatttgcaacttggggacccgacatttggggacccgacttttggggatcccgacatttggggacccgacttttggggatcccgacatttggggacccgacttttggggatccgacacttagggatcccgacatttggggatcctgacatttggggacccagacttttggggatccagacatttggggat

SEQ ID NO: 31335 - DNA, 1417 bp, Heterodera glycines
ttttcaaaaaaataccaatcgatagagctcgaaaaactatgttttggaagtggtcttcgtttctctgggaaaaatcgttaaaaaatcataaaattcaaaaacccgaaaaccgttttttaggcctagctcgaaaaattttcaaaattttcgaaattttaaaatttggaaaaatgcagctttaaaaactctacaataagttcgctggcaccccctcgctcagaccaaaccctgacgtggtattcacctggtactgaagtgggaaaaaaaaattaactgagtctccgtgtctgtacaggtccgggatttggtcagatcaaaaaataaaaaataccagcatatagaggacacttctgcggagtgccctcacagcgggaattttttgatccgagtttcagaaaaaaagttatgggccgtcaaacgcacgaaaaaatgagaaatccgtacctgggactcagtcgtccgcgcagaatttttctctatagttttcccggatgcgcctcaaaaagttgtaagacccttccactactttcagggcgctcccggccttcggagaattgacggtgaaatgagacgacgcaaatagtccaacgaccaccatcgacaaagcccaagtggcgaatgtttgacacaaaaattggctatatttcacgagcaaaaatgtcccaaatcggctggcgaatccacaaatgtaattcagtgcctcttttgtcgaaaatttggtgatttgaacgaagaaagccatgacagagtgatcaatgtacctaaaatggatggaatgcttttattcccatataaaagtttctttggctcttgtggagtttaggcccaatactgtaaatttagttgaaaacgaaatttgatttttaccaaatttgagtttggggttcgaaatgagtcgaaacggaaattcagagcgaattttgctggacaacggacggtcgggcaatggaaatggcacagaattgacagcgccgataatcacaaataattccgataatcacaaataattgtggtgccgttgttctgacactgaccttgcgacgaatttcgattgctctccaaattgtcaattcgctctcgtcatcaacatgtttgtccaccaaaagctcgaaatgtggcgaaagaagtgccaatttgaggccgagttgatgacggtcaaaaagggaaagtgtccatccaaacatcgctgcaaaccaactgaaattatgaaaattaataatttagcggaaaagggagcaataagtttttgacaaaaagtttttgaccaaaatctctcagagaatgctacacaaaaccaaaagttttctattaaaaataaaaactttcaaaatttacaaaaattgttgttttttccttgaaaaaattcaatttttgaattttttttatatttttgcggcgagattttgtcccggcgaga

SEQ ID NO: 31336 - DNA, 729 bp, Heterodera glycines
aatgcctatcattaaaaaaaaatgagtattgaaacgaaggcgccaaattcaaaaatcttttattcccaactgatcaaatctaatcaaacataatttttagttgataattcgtgtttgaaagctttatttgattaaaaatattaaaagtaacaatattttaacaaaatggggaagaaaaccaatgttttttggcttttgatgtatcaaaggaatccatatgtctatcaaaaatggaattgagcaatgtctgatgttctccgatcttcagcagcagttcgtcgcccttgtaccggaagaagcgctcagactaaaacaaaaaaatagttttttgaactatgaaatcgaaagttgttcaacctgcttgttcaaaacgtggtgtaaatgttcgatgccctgttcactgatccatgcgaaccatccccagcgcttggcaaagtctggaccatgggcgagcgaccaatgcaatttggggatgaatcctgcggcattgtttgtgtcaaatgcagttggataggtctcccaaagtttcttaaaaggggaatgtgagaaaaatgcaaaaaaaatttttgccttgaaatagccatgaatgccgagacatttgtttgagaaatctgtgatttgttctgttgtcaataggtccgcacgtccaaaaacgtggagctcccgaatttcgccaaggagggcggcaatatccatcgaaaacggtgttccaatcgatcggatttcggt

SEQ ID NO: 31337 - DNA, 1748 bp, Heterodera glycines
tgaatagatttttgacagaaaattattcataatttcgtctattatagatcaaattttataatatagatatttttcgatagccctaagtgttttctattatcctgcaaaattagaaaaaaattctttaagtttaaaaaagttatgacctgagaagctcaaaaacccaagtttttttgaacatttttagtcataactttcttgatacttaacgaaactttttggaattttgtaggctaatagaaagcacttagtgctatttaatgatatcaagaattaaaaatttagatgcttttgaacaaagttatatcaaaaaatattttcatttgatggttttttgactaacgcccattatgatggtttttgactaacgtcatagcaccgattgaacttacggaacggaactgacccccccccccccatcgcagcatatggtcccgctttatctctattgagggcaattagcaatgttttggcacccactcataaacagcagaacaatttgctggcgcttacattagcagcaccgccttatgtaggaccgaacctcaccaccgtatcacaaatttgacgaaaatgccattcacaccacagtaatttgacgaaaatgccatcctccccccccccagcagtaggaggcggcacggacgatggcatccgttcgcggtgagttcatttgtgcgcgcaacaacaaaaaaaaattggcaaaacgtacacacacacacacacacactaattactaattaattgtgcgcagcacagaaactaaaaacggcacagcgcactcatacgcattaattcacacatcgcaaaacaaatattattatgttatcattagcgcgtgtaaatttgtttgaggacatccgccgccggcggcaccgttcggcgcgtctgatgagggcacaattgtcatctccgcgtggagaaaaaataagtaccgtaaccatatgacaccacagcgacaaaaagcaccgtaacaacaattattgcctgctgttcccgcagggtgggcgggggaacaccgtaattagcaaataagataaaatttcgcgcacaatttgctaatgaattgagcactggcacggaggcggggggcgggagacatccgtcggcgcggcaaaataaatgagtcaaacaaaagtgcgtatgccggcgcccctccccgcccattcattagtgacgctgctttggcatttctggcattttgactgttcgccattaaaaacaaaattgctttttgtcaattttcccccattttaaagtgcaaaaaaagggcaaaatttattattttggcgaataaaaatgaaataataaatataagattatattgaaataagaattattttgtttgtgatgtgctgtttattgcatgaccatttgctgtggcattcattttgtgtatggatcaatccgcttcacctacggcaaaaataaatttggccacaaattatttatttacaaccacaataccaataaccatttttggtccatttatttaaagcgtgtaaaatcatatgtaggtttaatcacaaattagccgaaatgtattaatcccgttgggttggataaaacgaaaaaaagaaatgaaattaaatgaaattccggaaaaaagaaattagttttttagtaaattttattttgtcgaaaattattatgcgatatcgagggtatgggtacgactgagcgatgccgtattttccgaatttgcctgaccatttttgggcctcggtagttttcgaattttcgaaggg

SEQ ID NO: 31338 - DNA, 1833 bp, Heterodera glycines
attaaccattttcacccatataaatccattgactctgtttccaatcttttccccttttttatccgcgccactcaataaaaaagccccgagggtatccacctgctttgcttctcccccaattatttaatgatttttgtctgtctgacggcgatttgattttgctgttgtttgttgttgttttggcgttgtgtttgttgttgctgttttgcaaaatctgatcgggcggaagaggaagcacacaaattggtggttgtcaatcatccgcggcgattggtggcgatttgtggggcgttttgcccctatcgccgcccccgcccacggcgatcggtcgtcgctgacggcggcgtcggtggtcacgcgggcggggggcatttgtcggattttgcccccagcggaaatagcctctgcttggcgaggattatccctcccccggccggcgccggagggagcaccaccgctgactaactgacaacgtgaatgtgcgcagcgggcgcgcacggcctgcgcccgcccgtaatcaatcaaaaccgccgccaaccaaaccaaacgctgcagcacagtggcagcggcggcgggtgatgtccgctctgccgccctttgtgaggcacgcagcgcggtgcatgcacacaaatgatgtgtgtttgtttgtgtatgtgtttcagtgcggcgcatgcatccggcgtgcatgtacatgtgaaaccggaagcgcacactgagaaaggaagccagtgcacgcaagttgattatatttagagaaaaagaagaagtaacggaaagtgtagaaaaaactaattggggttattaattgttggtccggaaaggacacgccataaaatgcatccggaaaaggaaagcagtgtttatagagtgcatgtccggaagaaaaaacggaacggacatgggacacacggatttgttgaagtgagtaatttaaaagtgaaaaaagaaaaaaaagtaaaaaagtaataataataaaaaatgaaaaatgaaatgccaaaagaaaaatgaaagtatttttttattattaattagggatgcgatttttaggcacaaaaataggcaaataaaattttttattaacgctttttaggtaacaaaccacgttaaaactttaaatatttcaattgtaaatgaaattattaaatgttttaaagttttttttcgaatatgaacaaaattttaaaccaaaaatttttattaagaaaaaaatatattaaatttagggataatttttttaaaaaattttacaattcttaggggtgtattttctgaaaatttttttgggtcatttcttaggggtgtattttttgtttttattgcatttttgttaaggattttttcaaaaaccctaaaataggcactttatgcacaataaacccgatataggcaaaaataggcattataaaagtcatcgtagacaccccaaaccaagcggaaaacgcgtttttcttgcttatctacacgtattaaatgtgcaaaaattttaggcatttgcctaaaaatcgcatccctattaattaaggagaaaaataaatatttttgtgatgaaaatcaaatgaagaatgtgcgttttcgattgcgcccgttcattcaattaatttgacaatttcttttgcggttgaaagcaaaaacaaaacaaatttattttggtaaaaaagaaaatttagaaatttatttatttttttatgttattaattgagaaaataaatgacaagaaaaggattaaatcaaaatgaattctcagcaaatataaagaaaaagaaaattttgaaaaaataattaatttaaaattaataaacaaaaaaatttaaaatatttttgattataatttat

SEQ ID NO: 31339 - DNA, 1046 bp, Heterodera glycines
aaaaatctacaagtacatatatactgtaccttaatgttttgtatggtaaaaaaatcaaaaatttccgcttgcacgagacctaataaaagtggagagcataagcaagcatctcatcatcgctaaagaaggtggttcccctccccccccccgttttgcccccgctcgtccgacccattaattcatttttattccatcccctaaacattcattcattcacactccgtccgtccccaaggccagcagcagccaccaccccaccccacctgtctatgtctgtccctcgcgaagcccatccatttaatttgggcattcaaaaaaaataaatttagaggcaaatttgtgggggcgacgacaggaaggcgtcctcctcctcgtcgcgtcaccctccgctttttgaaagaaaatttttgaaaatattcccacaaatattaattcatatacacacacacacatatttttgaaacgcggaaaatgtttgggggtttcaatttggtgccagccgatcgtgacaccccccccccgatctgctgctgctgatcactccaaatcaacatagtgatcgttcttggctgaattgacagctccgtctttgtctctctcactcgcatactctctctctttctctgtgtctctctctgtttctctctctctatctctcagcagaacccaatgaaaagtttgtaactgatcgttgttccgctctgtccattcgacctttttaatttgtgacggtcggtcaaaacagagggaggaaggctaaagtgtggtcagagatcagcaaacactttactgatctgatcgggaaggagttttacattttaaagcgaaaaacccgagaaaaaaacaaatgtttatttgtgtaattaatggtgtgctatttttgcaataaaaaggcttggacaagcggtgggggtcggtttagtctggccggtttagtctggccgttttagtctggccagtttagtcagagggtcggtttagtctggccgttttagtcagagggtcgtattagtctggcaagctgtttttgccctacattattcaat

SEQ ID NO: 31340 - DNA, 820 bp, Heterodera glycines
aatagagcccggaattttgaaagtaccgggaccgggcccgggcttcgaaaattgaccggggcgggccgcccgttcaaaaaaagcgcgttttaccgggcgtcccgggcccggttcaaaattttgaccgggcgcccgtacgggaccgggcttttttcaaaatttttggaattttgattaaaaattcgaaaaaattttatagtcctttattttagcttagaaatgtcaagccattgtaaatcgaccttttttactcttcaaaagaattttaaggtgtattttttcaaaaagattttgacgacattgggggggggtccggcagtgccgacagggccgccgggtaaatttttgaaaatttgagtttggtttgttaacagatttacacgaaaaaatgacaaaactttgctattttgagctacattttagaaaaaaatttagctttttgtactaggcgacgctgaagaaaaactttgacttttaatgaaatttattaagaaaatttttggtttttcatgaaatttgaaatttttttttttgtaaaaagaaagttatgaaaatgttgttcaatttcatatggattttggggtctttttaacagttgaaattgcccaaaaatttcaaaaatccaaagttctattgaaatttttgaattaaagacatttcgccaaaataattatttaaattttcaaattttgggcagtttcgctagcggaatttaagcccgttttagcccggtcaaattgaccgggcccgggaccgggaccgggcttcgaaaattgaccggggcgggccgcccgttcaaaaaaagcccgttttaccgggc

SEQ ID NO: 31341 - DNA, 1512 bp, Heterodera glycines
  misc_feature (33)..(33): n is a, c, g, or t
aagtgcgaaattcgaaattttggggttgagttnaacgttcgaattcggacccagtgttctaatgtaatatgtattagctaggtatataggtaagaacctttattgtttacctattggcatttgcaattatataaaaagtgcccgttaaactgcagtttcccggactttcgctttgcttttcaagattgaagctttcttctaaatatgtatgcgtttccatgctatgggaattagtttcataatgaagaaagttaaacccagttggtgaagctttaaaaatgtttttaaaaagaacaagatatttacattaaagttttctttaatgaatttcaactttcgagctttttgaagcaattaaattacaaagaatacatattcattttttgctaaaacgacttataatttctcagaaaaatttaataatattacctattctttttctcttttaaggtaaaagaagacaaaaagaaaattttggtcgacatgaatatcaatcctttgtgtagaaaaaatttacaaaaggtgaacaaaataaaaattaagggagagggatttcttggaaaatttataatattgtagcaagggagtctagcaaaataaacaaaaacaaatgaatggtattcttgctagactcttatgttatatggtaacggattatagattaaaaaaagaattaaatttcggtaaaaaaggaaatttggttttttcattttttcgggttaaccatttttgaaattttacttagacgagcatcggcctcggcaaactcagatttgaagtgcctgcggagggcttccatgtgtttgaagcggagcgtaatggactgaggctgaacctgaccaatggaactatgtccgtgccgggcactgacaaatcactgtctttggaggagaccgtcaacttgggcgtctttgacgcacggtcgctgattgtgcgcgacccacgcaacgggcgaaggctgccgctgaacgaagcgattcagcaaaaggtgctcgcctgtttcaaggggcagcccattaaccagggaaaattcgaaaaatttattttcgaaactggtttttttctgtgagaaaagtctccaagtctatcttagataagaaaaaaattattcctaaaaactttaaaccaaggttttcagattagatattttctaaaatcgcatagtttttctttaatatgtagagaggggaaagtccgcccaatcttcgcacgctcctttcataactctggcggtcgaaactccgccaagaaaaaattttcaaaaaagtcgctcgtaaattttttataagtattttttcggtaatattatcgatggtaggaccccttttttgaaaaaaatattttatctcgccatgccacagatgttggacgggcttggccaaatggtgcaccgaggtcgtcgtctgacgttgcgcgatgttgcgtttcgcgcggtaacggaatcgcccgctgctactgacggcagcaaaaaaatcatacaatttccgtccgccgctgctgaaacgggtggtc

SEQ ID NO: 31342 - DNA, 2115 bp, Heterodera glycines
  misc_feature (25)..(25): n is a, c, g, or t
ttatacatcccattatgaactctanaattatcagagtgccgaaaatcgcatgtgatctaagcctagcaaaaaatggtgtaagtaaaaatcgtaattacgctcaaaaagcttctcaaacaattttagctcatccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttcacaaccaattttagcgcatccaattccttctacaatcgcctttatacatcccattatgaacgctaaaattatcagagtgccgaaaatcgcatgtgatctacgcctagcaaaaaatggtgtaagtaaaaatcgtaactacgctcaaaaagcttctcaaccaattttagcgcatccaattccttctacaatcgcctttatacatcccattatgaactctaaaattatcagagtgccgaaaatcgcatgtgatctaagcctagcaaaaaatggtgtaagtaaaaatcgtaactacgctcaaaaagcttctcaaccaattttagcgcatccaattccttctacaatcgcctttatacatcccattatgaacggggggattttacaccggattaatgggtcatatactacttacgttagtaaaaatttgttctcctgccttaaatgatcaacaaccggtaaaatctctcatatttaattaatataaaattacattgatttaattttagcgtattacttacatttttgttaatatcatttttgctagaagatattattgaacaaaaattttctcaataactagtttatagagttttataatttttttattaataaactaaaatataaaatatttgtcaaaaattgaatattataattaccttttttaaacatttattccaataaacatattttttattgacttttatccatttaaattgtattcttgtctagcattttgcacaacataattttttgtatttcatttaatttaagtataattaaaaatagccttaaaaagaatccttttttaaatttagccattttaatattatcattaatctatattttaatacaaagcaacaaattctctcactattttggaaatcaggacgggatactgcctctttttcaaaattcttataaaacggtcaaaaatagaaaaatttaggcgcaggcaatttttaagaaaattaatctcataaaaattttcttctcggtaccaacaaacctatttctttactcctattagctgttaaatatttagaaattaaaaaaccctttttatatgtaagtaattaattgttttattcttttagcttttttcgcattttcttttcaataattcttttgtatttacttaataagaatgcatttaaaacttttttaaagtagcacccaaaacatttgttgtttgacatttaaagagaggttttttaaataaactttttttttcttttttcctttataaattttcaacaattttaattaattcaaatatttactttagaactggaaaggataaaaattaaatttgaaattttttttattgcaattccatttaaatgctcatttttattaattaaaattcaataatatgattgtgcatttttttccattagagttctttttagcgcgtctcaagttattatgtttatttttgatgaaaaattcaggcaatctgattttaataataaaagtgaattatttcaagtccatttgaccgttgaaactgttttgttccctactgcctattgagttaaattctatttatttaatattattttagtaattatgatacttttttgagttttgatttaatcatttatatattatcttttggcttcaaaatttttcttttttactatgctttatattttcattatatttatttaatattactttagtaattatagtacttttttgagttatgatttaatatatattttaatatcttattatgtcatatttatttaatactactaactaatatataaaaggtaattagattttgattgtttttcatttattttaactaaattgttttagaacggagagtgcttttaataaactcgtat

SEQ ID NO: 31343 - DNA, 1515 bp, Heterodera glycines
aaagggggggggggggggagtcccttttacaaaattataaattcaattttcttggttccgtcccgtttttccaccgtgaccaccttggatttcgcaagtacgggtcgctgatgtcccttttgtcaaagaatgagccgtccttgttttccaggttcatcgcctctatgattttcatgcgcacaatgccatccggctccgggaagtacagcttggccacgtcgacatttggcgccaacggaacgacgattttgttgggcaaaaccaacagattggccacctgacaagaagcagaaaatgcgggagggaaagtgcaaacagaagcgaagagtggtggtgtttagtgttcacctgagtgttgaccaccgaccgaatggcgtcgatcagtccgggcagctgtacgaactcgcccatgccggtcaaattgaagtcgaacttcggcaactccatgaacgaactcgacacaccgccgaccctaaaatgggagggaatgcaaaacacggaacaaatgacgagaatggccaacaattctcgaaataaaagaccggcaaattttagacatgggaaaagcattggctgacagacggactcttttcattttaatacaaaaacaaggaaagtttttccggtaatcgcttattcgttaccgtacccattcctacagactgaaaatgaccgaccgatgaaaaaacaaaacaaaatgccaacaacaattgtacacaaaccaaacacacacattggcggttgggagagcagcggctggagggtgcagcggagtttgccggagaacaccatttggttgagtccgccacggaagccgcacgcttgcacagcgaactcggcgtcccccgcgtacaccacgtccatgtccatgatcacgcggtcacggcccacattttgggtgtacactttgagaccgccctgggaaagggtgaaatttggacgaatggcgagcaacgatcggaatggaatgtccgctttctgctgactgactgaccactctgaacggaatgtcgcccatgtcgacagcgacaaatttgaaggatttgaacggcgccggaagttgggcacggatttggggttcgatgaactctttcaggaacactttggtgtactcgccgatatggggccaaatttgttgaattatctgtcaagcgagaatggaaatagacaaatcagtgaaaaatgaaaaaaaaataaggaaaaacaatttaggggcctaataaatttttcattatttcaatcaaaaataaatcgccaaatataccctcccccccttttgcccagaatatcccttttgttgggatttgagccctaaatgcaaagttgatcggatcgtaatggtactggcgcactttgttgacccattcgatgcgttcgatgtccgggaattggacccacgcggggaggtcgtcgacgcggctgtactgcgccatgaccatctcgcgttcgcgcataatcatgctgcgcatgctcatccgatgctgctcccggcgaatccatgagtgcgttttgagc

SEQ ID NO: 31344 - DNA, 1322 bp, Heterodera glycines
cccccccttctccatttatcccccccgtgtctaattatcccccctttctgaggaggttgaaaaataatccccccggggggataaaaagagaaaatacggtaatctatatttttcatcttaaaatgctttttgtcattaagtattccgtcaaaaaatgttttttttaaatgtgcccatattttgtaattttatgtctatatttcggcggtttaaggcatatttttgttttttaaatcaaattaattagcagccttaagcatgattttcaatttgttaggttttttttattactgcttgatgtagaagcttgatattcatcagcagcctttttacttggttcagcaaaaactgctttattcacttggcccattagtgtcggacaaaacttccaaaaagtcgtttcccttgaaccacaccagtttcgagcactacaaaataaaaattgcaattcttttcactagtcctatttttgaaaaaagcctggatttcctggtcaaaacctaggtccagaaaaaacccaggcttgtcatggccttgttctcaggccaggacctggataaaactgtttgaaaaaatcattaattgttaggaacacctgttttatctacttgaataataatgtgtttttaatctatttaatctttttcagataactgaaataaaacattggtcaatctgaaacaataaattctaaaatgttgctcaataagtccttgtttttcgtgcaaaacctgaaacggattatttttatatttgatctggattttctgctggacaaaatccacgaaaaatctagattgtcaaaaaaaggcctaggcatgagtccaggtccagacgatttctacgtctcacttaatagaaaattaaatttacccttttcaattgctcctgcttcggcttggacagatgaaataggtgttaaagcttctaatttttttaaaatattttattgaaaattattctttttacattttaattttatttgaaaatatttaatatattaccctcaatttgaagtatctcttttttatgtgaatcgtcatcatccgctaatgacggttcactcgaatctgaatgtttaaaagtaaattaaaaatgtcaacattttgcaaacaatgctactgttttcgtttgctgattcgtagtcactgtcggactcctaaaatttttttcaaaattttatttttctaaaattaaaaaaattcctgagttttttcttttattgcttccactgtattcagcagcgtttctaatccttctccaccaaagtgagatgtttccgccatttctaaatgaaacattttctttaattttgaattaga

SEQ ID NO: 31345 - DNA, 1405 bp, Heterodera glycines
  misc_feature (1314)..(1314): n is a, c, g, or t
  misc_feature (1358)..(1358): n is a, c, g, or t
gggggaaaaaggggggtgaaaaaattttttgggaaaaaaaagtttttaaaaaaaaaaccccccgggggaaggggggggggaaaacaattttaaaattttatatttttttttattttattttttccaaacgggttaaaattaaaaaaaaaaccccctcccggggggaaaaaagggggtttgaaaattttttttggggaaaaaaaacttttaaaaaaatatccccccggggggaaggggagggggaaacatgatttaaaaaattttcaatttttttttattctaatctactcaaaacggttccagaattcaaaaaaaataacattcacggtgaaaaaaatggggtatgaaaagtttatggggaaaaaaaagctttacaaaataatacccctgggagaagggagtgggaaacatgatttcaaaattttcaattttttttagtctaatctactcaaaacggatcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgtaaaatggggtttgaaaagtttattgnggaaaaaaagactacaaaataatacccctgtgagaagggagtgngaacatgatatcaaattttcaattttttctagtctaatctactcaaa

SEQ ID NO: 31346 - DNA, 1154 bp, Heterodera glycines
gactttttcagtaccaactttgtccagttcagtcccggttgaataactcattagggtttgatctgagcgagggggctctagcggacttattgtagagttttggaagctcgatttttccaaattttaaaatttcgaaaattttcaaaaattttcgagttaggcctaaaaaacgtttttttggtttttgaattttaggattttttaacgatttttcccggaaaaacggagaccacttccaaaacatagtttttcgagctctatcgactggtatttttttcggaaaaatttcgattttttcccggaaatagaaaaaaaatttggcctgagcgggacatttgagtcccgggtccataactcgtcaggggttgattttaacaaaaaattgtcttagaacatttttgtagagctttttaagctctatcgaacggtgtactacatgatgtaaaattttcaaaaattttcgagctaggccccctagaaattttcggaaattttttttcggacgaaaatgggggtgaaaaatatttttctggggtaaaataaggtgctgagtacgaatatgatgtccattttaagtttcataatttttggaattttttaaaaattctttattttttggcaattttttggccctcgggattttggcctaatatttgaaaattcataacaaatcgaagggttgatcaattttacaggaataaagccttaaaaatagagaaaaatcaggagaattttatggactttatttggaatttctatctaaaaaaggaaaaaagttattccagaatttctggaaaaattcgaattttcagaaaaaaattcataactcggttctgaaaagatattctggaaaaataaaatactacaaaaatccgcagttttttgctctattatataaattttatttggcatttttatcacttttttaagaatttttataaaaataaaagtgattttgagattcgggaccaaaggggggtgcacatggtttttgagtgaaaaaattttttcgacaaaaatcttccaaaaacatgtctttaggggttatttgggccgctgatcacgaatacgtgatcagattttacgtttgacatcgttaagccctcagaatccctgtgtgattggggattctgggacatgttctgagggggggg

SEQ ID NO: 31347 - DNA, 1279 bp, Heterodera glycines
gcacgtggaggctgagtttccatttatcacctttcgaagggtcatttcaaaagtgtagagaaccagcgaagcttgtgtgttcagatttgatggtgcgcattgaggaaatgacatgtgacacagtcaacagagtgatggccgacccggaaatacgcgaacttatccagcagcagtggcaaaaggttagtgaccacagccaagggcagagatagataaagcgatccctttgggacaggattcccaatatgagttcgtcgctcccaaacggccttttcttcggatgacttatgcggaggcaattgaatggcttcaaaagaatgaagtgatgaacgaagaggggaaacccttccaattcggcgaggatattcccgaaggccctgagcgatttatgaccgacacaattggacaggtctttgaatccctcgtttttctttcacaatcgcccgttcccttcagccaattcttctcaatcgctttccgcatggaattaaggctttttatatgtcacgttgtgcagatcaaccggaattgaccgaatctgtggatttgctaatgccgggcgttggcgagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggtacatcgggcggtgtgcgccgtagcttttttccgtctttgaaaaggaccaaaaacgaacccatacgaatatgggtattgttcatttttggcgttaaaacaaatgtatcttctaaattgtgcattttttttgttgttattgcataaagggataaaacacatgaatgttcacaataaatatgttatggtacaaatatgaaaagaatttgggacttagaaatttcataagttttctgaaggcgttaaaacaattgaaatatgcaaggaaagagcaatgcctaagtacactattaacatggcgaggaaaatcagttgctttactgtcatttgacttgtacccaacccttataaaaaggattgaatcagaagaatttcccataaggggatgaattcgcgtttggtgggggatgtcgttgaaaaattggagccttctgagcttgggccaatggaggcataatactgccaccgatcgcttgcacaacggttggagcacagcggaag

SEQ ID NO: 31348 - DNA, 922 bp, Heterodera glycines
agaagggagtgggaaacatgattttcaaaatttttcaccttttttctagtctaattctactcaaaaactgttcaggatttcaataaaaaataacatccacggtgcgaaaaaaagggtttgaaaaagtttattttgaaaaaaagactttacaaaataataccctggggagaagggagtgggaaacatgatttcaaaattttcatttttctctagtctaatctactcaaaacggttcagaattcaataaaaataacattcacggtgcgaaaaatggggtttgaaaagtttattttgaaaaaaagactttacaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttaaaaagtttattttgaaaaaaagactttacaaaataactaggcgtcccggtagatggctgggcaattgatggggtcggctggtaggccacacgaggggtagaagtgtgaggtgtgcaccgttgcggttgttagtgcagtagcagctcaggcgcagatgcgtgtctggatgttcatgcagcagcagctaccggtaacagccgagcctagccgttcaccccccaccctacgcggcatccaaaagaattgatcaggttcgtattgactcggtacactcgctcgtcgctccgcttcgctccgctcctcgctcgcgcacctcgaggggca

SEQ ID NO: 31349 - DNA, 1370 bp, Heterodera glycines
  misc_feature (24)..(24): n is a, c, g, or t
actcatcgccactctctccatttntggtccatatctctttcagaaataattaatcaattaatttttctaagtggaaattaaaattaatttaattatttaaattataacatatttaaataaatataaaaatttgatttatagcacaaatggcaaaaggcaaaagacgttattgagggaaacaatggattttttaattttttgtgtttttaaatagcatttttgagagaaagcggagaaggacaaccatgagaaaattgagccgtgagaaaaacaaaaaagccaaatgcttttaaatgcgttcaaaaagaaaaaaataaaattaaaattaactaaaaaatgaaaattggacttagaatttactttagcttaatttgtattaatcaataaagaaaaccatttgctaattgatatattattatttaacacttttgaagtttaaattttttctaattagtttgaattagtaagcaaaagtaaaattagtatctttccaaatggtaagattttttttttttgctaaatgaaattaattgaaaaaattgcttttttatatatgcttttaaatttacaaaatctgtaattggctatattttcgtaaataaatatgttatctgcgctgacccaatttaaaaacaaaaacaaattttacgggagagagggggtggggggtacgtacggcccatgcaaaaagccgtggtttattgccacaaggccagaggcccattttacagcattacttcaatgtaaatcaacacatgtgtatcaaattacccagcatttgctactaatggcacagacaatttaaaattttttgtttgaatccattaaattggatagaggaaatttttcgtttttaggaaatccacaattggcattttttaaaattccccattgattttatttcattgtttcctggtaagggattaaatgtgcaacacttatagttaaattaataatttacattgccacaaatgctaaatgtcaatcatgggacaaggtcatgtaatatgaacttaaatgccaaaatgtgatcttctcaagcataagcagacacacatggattatttgcggtgacaaatggccaccattttccgctctccgtggccaagtatcccagcagcaaaccaccaaaacagcagcagcaggtggttgacgtagcggtggcggtggcatttgaaattgaaccgcccgccctttggccttctgttggaccacgcacagatttttgggcggctttttagctgcaacaacagcagcagagcaaatgtgtggtgggtgcgatgtgttaaagaaaaaatggataaacaaataaataaatgattgacgaaaagcagcaaccggcgggggataaggggcgggggtggctgacc

SEQ ID NO: 31350 - DNA, 1290 bp, Heterodera glycines
tttgctgtcgatttgctcttttatttgcctttccgttgccctaatcaatccgcgactctccgccacttccaacgctctccgcgcctcttttttggacccctcacgccctttctcgtccaatttagtaatcgcaaccaaaacatggaaaacttggctctaaaacaaacaaatgctcattaattagttcgatgaaatgcccgaaagaaatgagcaagtgttttcagtgccaacccaaaggttacaccatttcccaccgcaaagagttggctggccacccgctcgccaccgaattcggccaaattggcaattccaatcagacaacgccgttggacctcggggttttcggacattgccaattctgtgaaaagctcttcccaactgttcaattcttgcagaattcgttcacagaacgttggattctcactgtgtgagaatgacaaagttcaaacagaagatgtcctcgcaaacctgagaagagcaaagccggcactgcttgccaatctcaggcggtcgtccccctcggcacagtaaaggagccaaaccttcgcacgatccgtccccgcctaaaattttgtttataatgaaaatcatgtcaattttgaattgattacggggaaacaccttaataacagtgttaaaatactcttcgcaatacaacaaattcagcaataattcggcggccgctgctcgcaaatgttcgttgttcacttcgaaccaaaattcctccactttgggtagacatttctccttgagaattcgctttcggaccgaatcgccgaccgatgccaaatttgtcagggtgagaagggcgtcgtaatttgcttttccgtcaactgaaacagtttcgaacgcataattttacaacattttggccaaccttcgggatgaaggagttcaatgcatggcttaaccacctaaaaatagagcgtaaatataaagaaatcccgttcctgaccagcgaattataataatagttaattagtatgacagttacttcgtacatccgttgcccagaaaaggcaatgtttgggtccgatcgaatcccaattttggccagtccatgcgctgccctcagtttcccttctgcactgcatttcttgaagagatgcaataaaagtttcacccctccttcactgacaatttgaccttaaaataattaatcaattaaaatccaaaaatatgcaaaatcaaaaaccaattaaatcgtcgactttgcagaaggcattcaaacaccgcgccaaattatccaatacattacgactttcagttttgaaacggcaacacatgcag

SEQ ID NO: 31351 - DNA, 1011 bp, Heterodera glycines
  misc_feature (1006)..(1006): n is a, c, g, or t
ttcaaaatgaggcttcgaggctttttgtggttttttgagaaattttgaggctttttgtggttttttgagaaattttgaggttttgggggaaaattcgtcagattttttaaattttgataagttggcataatgtttgacaattatttaatttgaattttgttttttaataaattaccaaacggaaatcttacccatatttagccagaaaattacaattttttacgaaaatccacaaaattatgaatttttttgaagaaaatctgctaaaaatatggtcaaaattctcaatttttccccctgccggcggcgcctatcggcaccgccggccccctttgttccccaaaagttctttggaaaagcgccgcaaaaaaatcaacttcgatttttcatgctcagaatttcacaaaatacttattacaaacaaaaaattgctcaaattgatcatggacggtcaaaaatacaacatttgaacattttaaatgtgttttgaataaatttgtaaaaatgaggctttttttcttgccaaatgaggcttttgaaaattttcatataccagccctgcttatcgctctctctgtctcacaaactctctcgctccttcttagccaatcgacaaaaaaaggcgctttcccatcgcactatgggtacgcgccagtgtcagacaaaattgctcataacgccaaatagcgcatttggcgtaaatttttgcgcgctatttcaaaattgacactggaaaatgccttttttgtattttttattttgatctgccataactcgtttcattcccaattaaactgaacaaatttggtatctaaaaaaagtttttgaaaaggagaatctttttctaagcgaatgctaagcaatttgacatctcagaaaaaagttgtgggaatttcaaacttttatcatgttataacgcaagtcctaggcagctctttctaaccaaaatgctaaatttattcttttttttattgattctaaatgttcaaagtgattttgtaccctntataa

SEQ ID NO: 31352 - DNA, 1033 bp, Heterodera glycines
  misc_feature (981)..(981): n is a, c, g, or t
tttaatgagttttttgatgagtattgagggaagaatgtatggcagacgaattgtcaccaccattgtcgccaattccttcaattaattgctttaaggacaaagcttcaccaattaacaagcagaagattatgcaaaagaatggaaaccaattttgttttaaatgcattttattttctataataaaaatagtttattaaattgaggataccaagaatttattgatatcggaaaattgatgcttaaatgaaaaattaaaatttatttttctattgttatttcgtttgtctatcatttaatttgaacttgggtaattgttgagattatactagggttacacgggcccgggtatcagggcatcttccggtttttgtcggatccagaaaataaactccgtccgggtccggacccaagttttaaacaatgtctgggccgggtccaatttttaaatcaagtccgggtccgggtcctgtaaaaataattcgtaatttttttgaaataaataaatatttcatgaatgaatacgtttgtaaatttgtacaattattaaaataaattattttcgatagattcaatatcaaatcgaataaattttgaaaaaaacttaaagacaaaaaaattttattcttaaattttttaaacattcagcataaataaaaagctaagaaataccattagttcggattctccctaatctcaacgttccgccattttccgttatggtctttacttaattattcaatttatgttgtctttcctatccctccttccaaatttgggactaattatgctcctggctgaaatttatttatttattaattaaaaaatactattaatgataatatttaatgctgggataattaatgaaagacaaatgcgtttaatgcgcttaaatacaacaaattgtaacaatgtgcattatgaaaatttgagaattttttcacaaattggtaaatagtaaattaattggtgcatggctgatcncgtatttgcattaatcatttgtgtaaacattttgcgccaaatgcttcttctc

SEQ ID NO: 31353 - DNA, 915 bp, Heterodera glycines
cggaaaaagaaagggagcgttattgagggggtgtccaatttgggccaagattcagaacgggcagttcaaatgagttgttgccgaggattctttcatcgaagcgcttttggcggcctccgtttccattcttttcacctgctttttctgtcgctctttcgtttgttttttccgcttttcccttcactttttctggcacaatgccaaacccttctctttttcgttcactctcttccgcattatttttcgatttgtccaatgaattgccgaatatttctgtgaggaatcgcttctgtcgtttgctttttcccaaagtgccaattccgtcgttgttttttgcgtgccgtccttttccctttttttggcttttcgtcgacgttccttttttaattgttggcatcgaattgtctttgtttttgatctgttgccccggtgcctcttttgctccatggccttttccctgttgagacagtccatgtgatttgtcacgctgtgaaggcgatcccgaagagtgatttggagacgaacgttggccaaggataagcgccgcaaaagcgaccagtaaaattgggccaagaaaatgggcacttcccattttttggttttctaaaataaaattttggtttttaaaataataaaatgatattttcctgtgggtgctttttcctttcatcgccttccttttataggcattttttgattcttttgactgtctaaacaaacacaatcatttcaaaagctttctctaatcaaaaagctttttgaaatgtttgtttgcataaatttgaaaatttaataacttttttttaaataaaataacactgaaaaaattcagtctcagacaatcgaaagttcttttttaaattttaataaaaataaaggtatttgaataaaattgtaattaaataaacattaatt

SEQ ID NO: 31354 - DNA, 1013 bp, Heterodera glycines
ttttggcaaaaaagcttcgtttaatttcagcagaaggcattccaagaagagcttgagaaaaaggtcacggaacgacttgtgacagttcagacggaagttgacaaaatggaaattgcacatcaacagcaaaagggtaagggaaatgagcaacgattactgtacctatcgtaatattacagagactaacaaataaggtcatttattgttttatttcaaattttgtttaatagaatctattccatttaagtgattattgatgaattggatggacaacaaaaacatcaaaagcagcaatgggaaaaggagacaaacggtgagttgttacttaaataatcgattaaaatattatttaaataaatttatccatttttgaataaatatgcatttattgtttatttatatataacgattttttcatgttttagcattggttagccaaatcagacaatttaaagacgaacagaagaaatatttggaaaaggtcaacgaattggaaaagcaacagaaacagcggcagaaggagagggacggtaagaaaccaaagcatttaaatttattctctcaattttaggacggattgacaaaatggagataaagcagcagcaaatgagtgattctcacaagacacttttggaaaaaattgaagcaaagcataaggaaaagcagaagatgtttaaaatggtgaataaatatttagggaaattgggaaatttatatgatatgcatttaatacggtcaccaaatgaacaaatttcaatacccaagcattattaatcgcgtacagtaggtcccggaattttcaaaaagtcgggatttgatgcctttggatagacagaccatggtcgagaaattagggggctcatataatgaagaaaaagtttggtgtatataaattagcagcttttatactctgaattatttttcagtgcattttttggattgaaaaatctggctaggaatcacttttttaaatcggcactggcatcacagcttaatccagaaccccaatgttt

SEQ ID NO: 31355 - DNA, 762 bp, Heterodera glycines
ccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgagtctcctattattttatttttttttcaaaattttgaagggggggggggggggg

SEQ ID NO: 31356 - DNA, 838 bp, Heterodera glycines
  misc_feature (739)..(739): n is a, c, g, or t
  misc_feature (769)..(769): n is a, c, g, or t
  misc_feature (819)..(819): n is a, c, g, or t
  misc_feature (827)..(827): n is a, c, g, or t
agtccattggacgcataaactgtacttgagcctaaaatgaccttatttgttaggctttcttataattggccaaattattattaaaaaatttttgacgcgcacattcaaaatatggattacggtagctcattagtaggtttaattgcagttaattagggaacatatccatttgtaacggtaaaaagtgcgcatttcaaatctttgttgacaattattatgtcaatttgactcatatcggagtcggttcagaaacaaaataaaaaaagtaaaattaatgcattttaattccaattcatcaattaaacacttaataaacaaaatattaaaaatatttattaatcgattaataaatatttaattttgatttaaatcccatgcttaatcattcattattaaaattatttcaaaattaaaatattatatgtatttgtaataatcctttaattccgttcaaaaatttattcaatttttgcatttttattttcaaagcagcaagaataagcacaaaacaaggaggtcgtgccaaaataaggacaaatcttggagcccaggggttcttttgtccgtccgtctgcatcagggcgcggtggtggcgccagcgctggcggcgccaccatcaccggcgccggctggcgctgaagcagcggcggcggtccggcacgggctcttccaaaaatcggccttaattaaaacagaaaatgtaaaactcatcaattttttaggaaaaaaatcaaagaanatttaaaaaaaacatttttaattgttttcngaagtaacaaactaatcgtaagccctttttctgatttaataaatctttanatattaanttaaaaaaaaa

SEQ ID NO: 31357 - DNA, 1570 bp, Heterodera glycines
ctgaaaatctgtttcgatttgccgtccggcgcctacgcctctgtggtgcgtttttgggggtcacgaatttttttggacaaaaacactaaagtttgtgattttgcatgttggaatacctccccccgccccttgaagatccctaactaaaatttaaaggataaattgattttttttttataacaaaaaaggaccttttcattgctttctgctgctcgaatgcccacttttatgagtccaatctccaaatcatatgtttgtattaattaacacatggaaaaagttgggaagttccggttccaaccaaatcttttcataatttaacagtaattttattttcccatttgcctaggctctgcgcgagttgatgcgcaccgactttggcaaaaaggcgcaaaagcaattggaggaagaaatgatgaggaagagaaggcggaggacggaggaagcagaaggcgaagagggaagaagcgaaaacgagcaaaagaaagacgacaaaacggaaatgtgccaaattaaaacttaaaacatttttttgttgttttgattgtttcctttttcaccacttttacttgttaattttatgttggtattcccgatatgtgtgattgaaagaataagaaaaaaaaaagttatggcctaagaaaaactcatcagagtaaaaccaacaaaataaaaatattttttttaaaaattcaaatcactgttttaacattaaaaaagctaagagtacaaaatgcttgaaagtaattaggtgacgacaatgtgggctttaaataaattccttcggtcgcataaaaagggatggaataagaaacaaaaaaaaagagttaaatatttaaatgaacggaatgaattggacaaataatggaaaaagaaattcgaaaacaacgagaaaactgacagaaaatgttgtgaaacgaattcggttttttcagcagaactaccaatgtaatgtgtaaataaatgtatacaacaacaaacagacaaacccatcaagtagagagaccggattttggggaaaacaaaatttgggaccggaattttgatggaatttctgagaattttcgtggtgccgtttaaacaaaaaaaaatgttgggcatcggaatttgaatggaatttctggtaaatctgtggcgcgccgtttaaatttaaaaaaaaacaactaaaaaaacgggagttctccttgagttagaggggaatccctctcgacgatggtccaatcctagcgcatttttgtcgccgggatttgatggttaccgaaggaaaaaaaggagaaaaatttctgggggaaatcgcggcgccgccggcccctcaagactctgcgccagggcggcgccgttcccgacagacatcgatcgcctaactaagaagcggcggacggatcagcaacaatcgctgcgcaatgttgcgccagcgcagtgtcatagagataattgtcgtcgctgccgctttcggcactttcgctgtcgtcgaagacgacgacggcatcgcctcttcctccttcatttggtggtgcatctttgacacgtaagacgtcataggagtgcaaaacttcgcggatggatgccc

SEQ ID NO: 31358 - DNA, 1013 bp, Heterodera glycines
  misc_feature (918)..(918): n is a, c, g, or t
  misc_feature (998)..(998): n is a, c, g, or t
agatagaaaaataaaaagggaggaggcctaacgtttgtcatttctaatgatataccgcttgcaatgataaaaactccaaaaatacaaaattctgatatactttgtatcgatagttttttcgcccattaccaaatcaaaaatccgtcttattttggattatacacctgcaactactgaaacactcaaaaattttatgcaacttagtagaattaatttttggaaattatattggtatttataataaatattcaattttctccctgttttctcctttttcctccgggtttcactcatttttcccgtttggcactaattttcagcccatagcgccttctaaaatcaatacatataatctcaccaaattttacaggcgtactcctctgtaaagacctaacttaccctgaaaaaatctggtctataattggttttcaaaatttttagaaattctgagttattcattaattatttattttttagcaaaattatattcataagtaagggacatgttttaaggcctgtaaaaaatgaaattttcaaaaaaaaaaatccccagtctccaaaaaaacaactataccctgctttaatatttaacaataaattttgcaaaaaataaataaataatgaaccctccctccttaataattttcctgcttctaaggtaatcactcggccgcttcgcgactctgggggggggggggggaaaataagcagatttaaattttgatcgggtattgcgtgtcaaagatataatttgtaaattgtgtcaaatcaattctgatgatatattaatacaaaattttcctgcttcaaaaatgactctgcaaaatgacggttgcagttgtggtttttttgtttgcttatatgctgaggcatggctgattaataatcaatcgcttattttaccaaaccttgatatanaattggaaaaagaagaattctttggcatataaaacgtctttataatcgtgataatgtagtatatcacccgtgctcattgntttgtggcagcgaaa

SEQ ID NO: 31359 - DNA, 1386 bp, Heterodera glycines
attcttgagtaatttttaaattttttttaaagtcagactataaagcacaattaatacaaaattaagcatttgttgtttttattagttgctcttcatgggatgaaaatgtcaactcaccctggtaatcacttcaagtgaatgataaacgtaaaaaagtggacaattttatatttcatgttataaaattaataatatttctggtcatgaaaataattttttatcaaaaaatgggggacaattttaattaataaattatttgttactcctaaaaatgaaataaatattttatattcaaaccgctttctaatttgtatttactgtgtatttgtgggttatacatatttcttatatatcgggcttttttaataaattttttccggtcccgtttttcccaaaattcacggtccccgtggaacaaaaaaagccggataagtgagactttgaaaaagtcggatgggataaatcaaagtgtaacagttttatatccaaattttaaaaatgccaattttactcagaccgattctgaaaaacgggtttcaggaatttacgaatatttgccactgtacaccaattttgagccgaacagaacatacgaactgattggaacttatgagcccatcagccaaaccgatccaccacagtttgaaatgaactttgtgattctgcacaaatctgagcaaacgcggcaaatgatgaaatggtaatttttattgtattttacaactttttattaattttgtaattgaacattcagattggtaataaaaaataataatttttgtattgactgttctctttcattcccggctttttctggtctcggttccggcgccgttttctgaaatggaaatctctagcccatattgatagtttcagtctcttttccggtcaaaaaattgatcattttttcagaaatcctgattcttcaatttgccgcataattaataatttcacttttttggaaaatgccaccaataaaaatgaaaataaccgtcatcccccccccgttagtatgttgtttatatttttctatttttgggaaatttgggcgagctttttaaattggttcagtacaaaaattttttgtttaacttaaaaaatcgagaaatatatgtgattctaattaaaaataaattgacaaattaaatttattttcacccctaataaatataataatttaaatttgcatggctttgctttgtgccgccgagcccgactgtattgtgccggttggacagtcgaacgaatgcatttacatgccaattggtccgaatttgacttgccaccggcaggatcaaagtcttatgggaattctccgatacaacatggaatatcgacaacaaattgagggttttgtttaaatcggagtaccgatcccgacttttt

SEQ ID NO: 31360 - DNA, 1394 bp, Heterodera glycines
cgttggatttttgctccccataaatgtttgagtactccaaacggacacttgaaaaaatcgatttttttgttttcggggcagtccccccgaaccgatgcgcccagatttatggggagaccgaatccttcgggaatagcttccttatagcctgtactttaattctgcgttggatttttgctccccataattgtttgagtaccccaaacggacactagaaaaaatcgatttttttgttttcggggcagtccctccgagccgatgcgcccagatttatggggagtccgaatctttccggaatacattccctataacctgtactttaatcatgcgaagcatttttgctcatacataatagtttgagtactgcattacgatacacaagaaataatagcttaaaacatgctggcgccgaaacgccagcgccgaaacgccggcgccgaaacacagaggacccctttccattgccggcaaaaaaataatgcactacattatctgcaacaacatttcatttaattcaattaccatcctacttttcatgctgttatgcaacaggaagttaaatgtgaaaaacattataggtttgtttccaaatccattgatataaaaaaataacatttcctaattaaggaaagaagttttgccaaaaatttacgaacgagttcaggccaaaattaggagtgatttggaacattgcaaggtgttgtcgttcacaagtgactgttgggccggcacttccgataattttattagcattttggttttattatttcaattttaactatttttatttagcctgacagtgcatggcattgacaaaaattggatatacaaagagtgaattttggcagttacaaatttccctggggagcacaccggtttagcaattgcgatgaaactttgtagcgttttggaacaatggagcattgacggagcaaatgtgcattgttttgtcactgattcggcaaaaaatatgtgtcgggtataaattatcctacaaaaaattataatatttaaataaaaatttaagaaggattgtgtgccgacaatgatattgagaagctgtttgtaaaatgccgtaaaatagtgggccatttcaaaaagagcaacaaagcattgggaaagctgaacgaaattcaagaacttcttgctattcctgagcattccttgttgcaagtatatatattaataattcttaatgattgtacttttaaggaagtttcgacacgttggaattcagctttgatgatgatcgaacgactctacgagcagaaaaaggcaatcaacgaatacgcctaccaaaattgtgactttggtctcactttaacaagcgaagaatggtcaattttagatgaacttattgcgggtattgttttaaagaaaaattggtagaaaaa

SEQ ID NO: 31361 - DNA, 1218 bp, Heterodera glycines
  misc_feature (59)..(59): n is a, c, g, or t
  misc_feature (1147)..(1147): n is a, c, g, or t
  misc_feature (1171)..(1171): n is a, c, g, or t
  misc_feature (1201)..(1201): n is a, c, g, or t
tgcaatgttttcgggattaccctatagaattaaaagaataaaactgacaactttattantggaaaattataggtgaatcacaagaaaatcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactggaaattataggtggatcacaagaaaattcaacactcgggcttaaaaatccggagaaaagtcaattggtgccatggttnttcgggattacttatagaatttanagaataaaactgacaacttattaactgaanaatataggtgaatcaca

SEQ ID NO: 31362 - DNA, 1297 bp, Heterodera glycines
  misc_feature (67)..(67): n is a, c, g, or t
tttttcattgaccatcatcataaaatttgcgtctaaatttccagattttgttccgcaacgaccccgncccacatacagggaggaagtgcgacggcgcgtggagagggcatcagcatctgacaccgcgagcgaaagtcgtcatcaacaaccccccccgcccggtagcgcaacgccggggagaacagcagcaggggacgccgccacaaccgccggacggacaggggatgcaaccgccgggagaacagcagcaggggacgccgcaaccgccagcgacaccgccgcaagggcaagaagcgccgcagcagcaacaacaacaaacgggcgaatggtacctttgatgtgacgtgatgccctctgcgtgatgatattattatatacttatgtatgtgtatatgtattgtattgtatgcatgtgtctgtcgtccgaccatttcattaattaatggtctctctctctctgtgttcgtttgccctgcttttgttcgccgttgtacatattatgtgtattgtcattatccaccaattattgtatatatatgtgtgtacatatgatggtgtatcgagcaataaactttgaaattgccttgatcctttccaattatgtatggattttgggctaatactggagaattagtgtcccggcgaaatataaattaaaaatttaggtcatattcgtcgtcagcgaccctgaaaaccccaaaatacatcttttcaagttatccttacatgaaaatatatatttaaaaaaatctagttgcttgatgaaaaatcataggcaaaatcaatgatttttcgaattctggactcagatccgtaatcagtgtatttttttattgaaaattttttgcatgtattttaaaaatgctttttcaaggttagagacattaaaatagcacgccaaaaagatagaaaaagaaatacattttcatgtttattttataataactagggatgggaattttatgtagagtgacgcgggaccgggaattttgggcaaaaccgggaccgggacttgccgggacctgagaagccgggacctgagaagccgggacctcgatttttcttcgggaccgggaccaaccaggaaattttaaaaattcataaaaattttaaaaaatttaatttaattttatttcaattgaaaataatacaaaattaatttttaattttgtttttttaataaaatccaaaagttaaagctaaattaaattaataaaaattttcaaatcgaatttacttcaattatttcaaacaatttatcattttttgactcaaataatccaatattattagaaat

SEQ ID NO: 31363 - DNA, 963 bp, Heterodera glycines
  misc_feature (906)..(906): n is a, c, g, or t
gatgacaaagaaaaaagttatagtccaaaaacctgctggggcccaactgacgtagaccggtcccataccctaccaatggtaggacaccagaaatatttacatcagtgcctccgcgtgtttggggttgcgcgccagcgccttcaggtagaagccctctgcttgcaccacgtcactgcgtgccatctccacgtaaatgccgtactcggtcagaatgtccgggttgtagggcgccaacgagtaagcgtgctgaaaacgggggaggatgcagaatcatcctgacaaaattttaagtgatttttttaacaaaatgtatcaaaatttccaataatttcccggtgacacctaacggggcgcccggattaaaatttatcatagtttaatagaaaaaaaaatggtcccaaaatgccaaaaaattagtcatacacttttaatgaaaaacggatatgaattcacaaaaatttaaaatttaccccacttctccctcctccggagccatcagatttaatgaatcattcgagtcataattttttttgagacacagacaaattgtttggaattttgtaagttattggattggtagtgcctatcaaaaaatgccaaaattggttcgattttggacgccatggaaggaaaattgtacccaaaaaaaaattccctgttgtgccactttttgcccatcaaaccctaaaagcatgccaaatttgtccaccacattctccaactacctcaatgatgctgcgcgccttgcgcaagttgccctcccaacgtgaacgtttggcggccgaaagtgcggcaaccgcttcccgttcgcgccactggcgcacctccgccgtgcaactttccacgtccgcactgtccgacggtgggcgaacgatgacggcatctcaaacagaaaatgcaaattanaaaaataaattttacataaaattggagactcaaaaatgttttcaggtataaattttt

SEQ ID NO: 31364 - DNA, 778 bp, Heterodera glycines
  misc_feature (58)..(59): n is a, c, g, or t
tcccgaccagctctaatttaaaggattcattctccttcatttcaaggcggatctcggnncccgaagcaggtggtcctttgtccgaatgcgcggctttgaaacgatggcctgcggctttctgttgctggacggatgggacacaattcggctatggtcaaaaatgtaaattcaaaattatccaattttaggtttttgtttttaatttaggtatttctggcttcatctgacaatgttgggcacaatgttggcattgaaaatatacaaaatgttgaaatgaaaataaaattttgtttattgtatgttaaaatgatattttattttttgaattttttgtttatggatgaatgttgtaaatttcacgtgcagaacacttcaaaattgcgcttctatgataaattgaattggaaaaaattaggtgatttccattttttatttattgattctcaaattttgaaaaaatgaattttttaaattttacgtaaattagtcaaaattttcttcgatgggatcttgaactgacaaatgagagcaaattcaatggcagcgctcctttttggtaatgaattcattttgtataatttaatagtttttttatacattttgtttcttttctttaaatttagcgccaagatttgcacaaaaaaaattttttggaatatttttttttggaaaattagtaattcagcataaaattttaaaaaagtcggctataaaatttttttatatatctttaattttctaatcaaaaaaaaattttttttgaaaaaaaaaattctgg

SEQ ID NO: 31365 - DNA, 1181 bp, Heterodera glycines
  misc_feature (48)..(48): n is a, c, g, or t
  misc_feature (58)..(59): n is a, c, g, or t
aaaaaattttttgaaaattctagggggcctagctcgaaaatttttganaattccttcnnatatagtacaccattcgatagcattaaaatgctctacaaaaatgttctaaggcattttttggctaaaaccgaccccctgacgagttatgggcccgggactcaaatgtcccgcttaggccaaaaattttttctatttccggaaaaaaatcgaaatttttccgaaaaaaataccattcgatagagctcgaaaaactatgttttggaagtggtctccgtttctctgggaaaaatcgttaaaaaatcctaaaattcaaaaactcgaaaaccgttttttaggcctaactcgaaaaattttgaaaattttcgaaattttaaaatttcaaaaaatcgagctttcaaagctctacaataagttcgctggccaccccccgctcagatcaaaccctggcgcggtattcacctggtactgaagtgtactttttgagcacgcttcagttgccattttttgcaggccaggggtttgctcaaaaaaaattttaaaaaataccagcatttagaggacactttggcggagtgccctcacagcgggcactttttgattcgagttttacaaaaaaagttagggcccttcaaatgcaaacaaaagtgagaattcagtccctggtactcagttggccctcggatcaaaaaacctatagttttcccagatgcgcctcaaaaagttttaagacccttccactactttcagggcgctcccggccttcggccgggagattttgtttttggaaacgaaactccttgtcaatataacgtatatagtaaaaaaggaataataaattgggttggcgaaaagaaaatcaacaaaaaaacccatctcggtcagacactccttcatgctgatttagattctcaaaatgttttaaaaattgctgaaactttcgataaaggttcttaggtggttgctatggaaattttgagtagactcattgaagatcggtataatttttaaagctttattcaatatttctttaaaaaactttttttggtaataaagataaggttattaacccaaaaatgaatttattaatttgaattttatgaatttaaatgtatgcaattatgatcattcgttgttatgaataggaaaaattgatcaatagcatgtttatcatccacgcaaat

SEQ ID NO: 31366 - DNA, 1615 bp, Heterodera glycines
tagaccttaaacccattttgtattatctttcttcacatttcagttcagtgatgaatctgagtttgtctattttatatggacatgaaaatagaattaattttcatgtacgaaatcaagaaaaaaattttttcaattattttttaaattgtttcacttaattcaatcatttacaaaataaattcaatttagaaattgaagaaatgtaaattaaataaaatattaaatgcaaccaaacaaaactaatataataaataatataataatattattttttgtacaaaacacataataagttcgagcgataataactttttaaattctttcaatgtgaattaaaaataaattgataaaaaatataaacaaaaatatttgtcaaaatttaagacaaaaatgtatcttcatgttatattaccaacaaatatacataaacaaatcataaattccgagcagagatggatcataattataaggaagtggacaagttatgtgaaatgaataattaaagaataaagcaattatttagttggaaaacaaatatttatcaataaaatacaaaatattctattcaaataaaatgataacaatgaaacaaataatttatttatttttagcaaatgattgttaattatcgttgattaaaagcaataaataatattttgattatttattttatttctgtatttacttaaacaaaaaaaaaatttactaattattcgaataaaaattcgtttgtattaagaacaaacatttaaaataaaagaaaataagttcactttattataccaacaattaataattgaaacttttagtaaaatatctttttttgtttgtttatcaatatgagatccatttaaattttttcacaaatcaaaattttctaaattattaattttaaatgacttccgctgaaaacccaaaaagttctggacacagacaagagttaataaataattaaaaaacataaatttttgtcaagagaaaataataaatgatttaaagtagagaccggaattttgaaattgccgggaccgggacttggaaaatgaaccgggacgggacccgggacttggactcccgttttaaacgggattcccggtaccagtaacagtttttggccgggatcccgccgggaccgggattttttcaaatttttgaaattttgattaaaaattcgaaaaaattttataatttatattttagcttgggaataggccaagcaatgcaacgaccttttttgtcaatttttaaagcacttttttcgggagcgcttttttcaaataattttgggcaacaaagggtaagggtccggcagtgccgataggcgccgccggggaaaatttgtaatttttaatgagttttattaatagattttatccaaaaaacagattttgggattctgcgtcaaattttttttaagaaaataaagatttcggggtcggtggagaagttttgcagattttacatacattttaagagattttcaacaaaaattgcaattttgaatatggattttgggatctttttaacaatttaaattgtacaaatttctaaaaatcgcttaaatcttcgaactttgaaataaaaacatttcgccaaaaataattattaaattttt

SEQ ID NO: 31367 - DNA, 1262 bp, Heterodera glycines
caaatgctttcgctgctgcgctctgattgcgatacgttcgccaattatctgccaaaagcagcgaatgaaaggaatttggaataaatttgagagtgccgacttttgcggtgaatgccttcaatttgtgcacgcattttctgatggcgaacccacggccgagcagaaaccaagcgaagggacagaagtaaaacagcggagtcatcagaaagtcgtgcaagtgcctgttgaagtcggccaccgctttgacatattcgcagtgactgtccttttgaagacggacgccccattatggcctctgatgaaagacaaatttacaagaataaaaaaacattttaaatggatttgatagccaattacgtatttggatatcaaatgaatggtcgaacattctttcacctgttgcaatggccaacgaaatgtgctgaatcattttggtaatgtcttcagcgttcgaggagttgtcgtcggcacttgccaagttggtcaaactgaaccaaaatttaaacatgcaaatccagtgaacgatttacattttgcagccatttttggccaatgatttcaaaaagcgcttttttgttgacctttgcacaaattcgcgtgctttgctgttgaaaatgtccgtgtactgctccaacttagcaaagtgaaaagttggcgtcagaatgcgtcgctgtcttttccattttgcatcggtgctcagcagcaaaccctcgcccagccactgcttgaacaagttgtaatcattgccctttgtcagttccatcgaattttccaatatttcctaaatcaaatcatattcccgctttgatttcattttaattactttggcactctctgaatccaatgccaaaatgttgagctcagaggcaaaccaccagcacatcgcattgtgcccatcgcgaagtgcccgatttgcatggctaattagaaactccggcacatctgcccattttgaagattaattaaaatgaaatgattgtcatgtaaatatgataccatatctggattttggaaacaggtggagatgaccgatcagcggaatcctgccaagttgccaaaaattgtcgggcactttcaaaagtcgccgataatttgagagggcagtaaaaagccaaaaaatgaaagcagagaaaagcaaagtaaaaatggcaattagaagaaacattgtgaataggtatttgaataaatattagcaattaaataatttattttctaaattttagaaatattttattgagtgattattttataataaaacggaa

SEQ ID NO: 31368 - DNA, 800 bp, Heterodera glycines
attcccgaagggattcggtctccccataaatctggggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttc

SEQ ID NO: 31369 - DNA, 1502 bp, Heterodera glycines
atgtgtctctttcagcgctccgcgactgatcacaaacgaacgcgacgctttgctaatgagccaagcggtgctaaagtgtcgggcacacccggtctgattgaacgcggacgcgcatatcaccacttccctttggtggtggatgttgacgttggtactgcccgacgcgcactcaaatcgccgtttgatgatcagcggattcaaaccaatgcgagccgaagtgtccgcacaatatccgtcgactgattggcacgggatttataaccaattcgaatggcgcgacgttcggcggttgagcttctaccaccgtcaaatggaaatggcatttctaaaggcacgcgggccttgacttatgaggtggatacagtagggccttaccatatctcatctttaatgattactaaaaacactagattaaatctttatctcgcgagaaatgtccgtgcgattatgttgtaaagtccaaaggcaaaaaaaaaaggattttaatattccggcggaaaattttccgtttatccgttacgacaaattgctcatttccattttattttttatcaataaaatgtttaaatattttaataatttagaatgattttaattggcttaattattattgcctttgtgactttttgtcttctgttgagtttcattgggtttaggggtattttttggttatgctgtcacaaatgataatgattccttttttaagctcgttcgcactctgcctctgtgtatgagcgcttccgtcgtgtttctcaaactggcactcgcgcacatgttattgactttgatgaaccaaatacaagtgccggagcaaaccctgttcgtggtggcggtggcgggcgttttccaattgacgatgcaacgtggttgtccatgtttcgccgcttggtgggtttaatttaatttaattcttacttaaagtttatgtcttattttgacaaaaaaattttgaaaacgaatttttaaaaaaataaattctattttaagctttttttttaaattaacttaactatttttccaaattaatcaatgctaagaaaatttggccacgattttgagacattaaatttaattgaataaaaaaaattatatattttttcttatattgttaattattcgccctcttcatttttcagaataatctgacgcgaactgttgaagccatcaaaatttgccttcagtccgttctcacgaatcaacaactgaacaactgggacttgaacaactgcaacgagggcatttacctttacgattatttattattggccgagcatttgtcgaaaaacaactgtaataattgaataaataaatatttatttatttattatattgatttaaagatttcgtatcggtgcgctctgttatagctgcgaactgttgctttggattgttttactttgaattaaccgttcttcagatgaaatcgtgaattaaaaaaaaatgtttaaaattaagttgattatataagggaagttggagttgacttgccccagcgcacatga

SEQ ID NO: 31370 - DNA, 1537 bp, Heterodera glycines
ctctcccctctctctttctcctttctctctccgctctctcttttctctcccctttaattgtccttcttatgactttctctctctcctctctgcactctttctcgtgattcttatttctttctctatggactttcttttctttctttctctctgttaatagtgcggccggggccacccacagcagaggggggggggggggacaaatgggaagagactaatggatgaattccgccgggggaggggggctcatgaaaaaatctcccggggggtggtgactgaccgacgatgcccccggggggacggacccctgttcgaatcggaatgaaataggaaaggagaagcaagtggtgaaaagattttttgatttttattttcctttgcaattttttctcaaaatttttctaagaaaaatcagaaaataataattactgaattattttaaccgatcagacctctccttttaagataaaatatgtttttaataaaatgcgcaaaattctacttttatagctataataataataacaataatataaaatgtaaatgttaaatataataaaatgttgatgatgatgatgaataataataataataatattataattaaattcataaatcattcatatggtcgtgtttgagtatatggtcagtttaaatagtggcgcaatttgaaaaggattttcagggggaggggagggatgagtcacaaaagtacagtacagtagagaagatgacaaaagttacagtagacacaaaaataaaaatggaaaaaacattgactacaaaagataacagaagaaaacagggaaaaggaggaggaggagcaagcagttcacgaaaattgattagttgatctgggggatgtccattttgtgccgtgacagtccgatcaatttgtgtctgatcagaaatcatgggttgatcggtcccaaataatgacctgatcaggaaaaggtgggtgggggagggactgatcagtcctgcataatgatttttacgatcagttaaaaaaacatactgatcagtgcgggtttcgcgaccggttctaaccggtaagagctgatcagtaaaaagataagtcctatacaatgatcgaccaaccgatcggaaaaccatggactaatcatagcaggattatagacccgatattaaacgtagagaggataagatgatcagaataacatgcacttgaactggtgcgcaatcccttcactgatgtatgacgaattatagatagtgggaaaggagaagggataaaggatttgagggacagacaaacattagcagacggagggacggattatcggtggagaagccgagccgagaaacggcaaaaagcgaaggataataattgaacggttactcaaattcgcttctttcagtgccgatctccggcgggggactattacgcctattagtctgcgcaaatgaagagaactttaaaattgagaaagaatcatgaaattaatattaatgaaaatattttaaaacataattattagagatttttttcaaaaattaatagacaaatgtaaaa

SEQ ID NO: 31371 - DNA, 1617 bp, Heterodera glycines
  misc_feature (338)..(338): n is a, c, g, or t
  misc_feature (1590)..(1591): n is a, c, g, or t
  misc_feature (1602)..(1602): n is a, c, g, or t
tatttttagcgcctaaaaaatttttgaaagagtctatttatgcctattttggcgttaggcccaaaatttgttaataatagtgcaataaaaacgaaaaatacaccccctaagaaatgaaaatttttcaaaaattcatctcaaaaatttgtttatttattttcttgacaggaatgtgatttaaaaattatttatctcaatactgatttggcctaattttttttacttttttccctaaaaatgaggttttttagtacctattttccatttttagatcctattttggggtttttagagcctagagcctacctattttggcagtttttagagccaaaaaatcnccacccctagtcataatcctttaatttttgaaacattttcaaatcactaaaaaactactcttaaaattctcagaaaagtaaatatatttttttaatttcaaagtatataatgccaaaattttatgaacatttcatttccgtcggctcacaagcccgattaactcttttaaaaaattgactaaaatttggcatttgttggaagaaaaatttcactgggaaatcggggccaaattttttaattaaccagcggcgcctatcggcaccaccggccccacccttactccctgaatttatgaaagaggcaaattggtttggttttttgtttttttgaagatttttattaaagttagaatttttcgaacatgcaaaaattccgcaatcacccgggatcccataaaatttaactggggttttagcaggattatccctcgggattccatctcacaaaaaaagattttgaaacatcattctttttattcttttctattcttttttatccattggcggatgcagttgtccaaatgtggttatttataattcccttttttgcaattatttttaaagcgaaaaatgtaaaattcttttttaaatggcataatcaagggcatccatcataagcgcataaattcatcatgaaattgtttgattttcccaatattcattcattcatctcttcccttcttcatcaagcaacattttcggccaattcatcgcttttgtgtcccattttttctcggttgaaatcgtttcgtccccattggcactcgtgcgttcttcatacggttgttgctctgaataagtttggcgctcagccggcacatagcggtgtttaaacgcagaatcggacaagcggatcaaagccatctgtcgctaaattaaaatgattatttatatatttaggttaactaagtacatgatgggaaagtttagtgtgattcaagtacgcaaattcacaattgctaagttttatgggtaaactccagttttatattaaaaaaacccatttttattttagtcatttctgtagcaattttttttatattaaattttgcttaccctcgggtccattttgagaagtcgaagcagttggattggctgattgaaattatatgtgaccaggggcagtgattttgcagtggaaataaataccattgtggtgaaaagcagcagaattgaacagttggaaatggcggaagacattttcttaataattatattttaagagtttaatttaaaaatattataaattggnnagatgaaaaangaggacattttcaaa

SEQ ID NO: 31372 - DNA, 1698 bp, Heterodera glycines
cggatcggagtcaataacgacttcgcaaaacagtgtgtcgtcagctggcacacaaaacacatcggccactcaaaatgttgagtcgtctccaagcagtaaaaaagtgaaggtcgaagatgttgaccgaccaatgtctgctattgaagcaatagcttcaacgccagtttcaactcaaagaaaccgtggcagacctataaaaaaaactcgaggaccaggcgggggaaaaacaaatgattcgttgagcgaaggctcatcaatggatcagagctccgaagccactttaaatgtagtggttttgcccaatgtgcctgaaaaaataaatttcaacacagtgccaattaatttcgccacatcgcgaaatatggcctgcaaaattcggagatgggccgatgttggcctttacgagcgtgatggcgaaacaggactaggcccacgctctggcccaagattcattgaaacgtgctggaatgatctaacacagtttctaaatgatgcctttgttgccgaatatttggcatacttggcaagtatatcacaacgaaaagtagtcgttgttgatcccatggtgtggcaagagggcatgcaccgtgtcacgtcatacaaaaatatgacattcggatacgacccaaatgttcaggcagaagtcatacttttgcccgtacattttcccgcacattggactcttattgtccatgatgttcagtgtggtactcattttgctgattcattgcctgttcccaatggcagactggattggcaacggacggacaaaattaaaaatatcatttctgatattttgccgtcatcagtgttcactggtatttttaatgccgaagtaacgtgccaaaatgatggaaatagctgcgggtactttgtgtgcctgtatgctgaatcctggcttataaacaaccgcacgtttgttctgcctgatttgtccatcaattatgaaaagcggcgcatattatggcacattaacgagctgtatggctctgataatgtgccatatcatccgagggaaggggtgccaactccttgcccaattctctaccgacatgcggatgaagcgcagtcgacatccaaggccgttgggccgatggaagttgatgacagcgatgagataacaatcatcgaacctctgacgaatggaatgaatgccattctcagccaagtccaagtggaaggtgaaaaccaagctgacatgtttggtttggtgtcggattcttgtgtcccacaagagcctattgcgcaggttgacgatgcaatcttcgtcaggccgaaaacgcctcctaggcgatcattgcgcattggcagaaggcaatctgcttcgattagccgttctccctcgcctgcaccaaagcggcgcacatcggcaaatgctgttgatcaaattagggcatttacgcggcgttgctaccttgtccacaagggttggtgctgtgctgccgcagcagcaaagcattatccggaatattcggattctggtaagcttggcgacaaaaagtgctctcattgtggagcactactcttcccgcacgaggacagcagccattgctgtcgacagggaaggggttgttttgcccaagatcaacccgcacccaaaagagcttgaagagctcattgtggacaaaaaacaatcccgcaagggaaaagagtttttgtgcgaatatgtcgcgctacaataatttgctccagtttgcg

SEQ ID NO: 31373 - DNA, 1528 bp, Heterodera glycines
  misc_feature (1395)..(1395): n is a, c, g, or t
tatgacaattgtaaatatgtcttcaaaccttaccattttttgattttacatatttaataatgttctcttaaattttcaggttatttttctgcagcattttttctcatattcgcaagttccataatcttatagggagtccatgtaagggccaatctaaacattgaaagccctttttggacaaacaaagccaatgcaacagagccaatgattagctatgaagaattatttctaacacgataattggtgtggtggggactaagcagatcctgaagaaactccaccaatgaaaacaacgaaataaagctgaccttttcgtggaatcagacgtaaaaggaactataaatctctagaaattacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataatcttatagggagtccatgtaagggccaatctaaacattgaaaggcctttttgtgacaaacaaagccaatgcaacagagccaatgattagctatgaagaattatttctaacacgataattggtgtggtggggactaagcagatcctgaagaaactccaccaatgaaaacaacgaaataaagctgaccttttcgtggaatcagacgtaaaaggaactataaatctctagaaattacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataatcttatagggagtccatgtaagggccaatctaaacattgaaaggcctttttgtgacaaacaaagccaatgcaacagagccaatgattagctatgaagaattatttctaacacgataattggtgtggtggggactaagcagatcctgaagaagctccaccaatgaaaacaacgaaataaagctgaccttttcgtggaatcagacgtaaaaggaactataaatctctagaaatgacctaaaatggtctacaaaaaagccaatatcaaaattgtaaatatgtcttcaaaacctatcattttttgattttacatatttaataatgttctcctaaattttcaggttatttttctgcagcatttttttctcatattaccaagttccataatcttatagggagtccatgtaagggcaatctaaacattgaaaggcctttttgtgacaaacaaaccaatgaaaccgagccaatgattagctatgaagaattatttctaacccgataaattgntgtggtggggactaagcagatccctgaagaagctccacccaatgaaaacaacgaaatgaagctggacttttcgtggaatcagacgtaaaaggaactataaatctctagaaataacctaaaatgatctacaaaa

SEQ ID NO: 31374 - DNA, 893 bp, Heterodera glycines
acgaaagcagtgaaagaaaattgccagcggcgctgtcagccaccagtcaaactttagtataaagaagtcccgcttttccttctcatcggtggccggtccgttgttggcccaacaaaagcaggcacacaaatgagttaaaggggagggggggggtaattaattggttggccaattggctctggcgctgaacaatttattcttgggagagcggcgggtgcacccccaaagaccaccaaacagaggaagtttattcggacagaatgacaaagcataacaaaatttatgggggaagaacattcgggaacgaattctgtgtcttgaattaatttaggactattttaaagaatttattgtgaggggttttgaaaccctagaaaaccataagtgtatcggaattggtttttggaaatttgaaacttctccagaattataaatttatatatgctgaaattttgaaaaaattaattaaattttaaattaaaataaaaaatgacagaagttccgtcaatatattccaacttttctcctttccaattcttattttgacctgccgttggccgaccgaatttttgaaaagtaatgggaggggggggggggggcagcaaaatattgtgacattttggcgaacaaaatgaagaatgggggcttggggttgggctcgaaaggatttgtgactaacaataagcagcatcaccagcaccacaccaacacacaacggccggacggacggacggagagcaaatgaatgggatggaatgggaaaggggggaggcaaaaggcacaatttgatgaatcgctttttgccaatgaaattcggatggaagtgagtggaaatggatgggttggatgacggagtagtttatagtagtatttatatgtgaagagagatatgc

SEQ ID NO: 31375 - DNA, 1933 bp, Heterodera glycines
  misc_feature (1211)..(1211): n is a, c, g, or t
  misc_feature (1214)..(1214): n is a, c, g, or t
  misc_feature (1218)..(1218): n is a, c, g, or t
  misc_feature (1224)..(1224): n is a, c, g, or t
  misc_feature (1239)..(1239): n is a, c, g, or t
  misc_feature (1245)..(1245): n is a, c, g, or t
  misc_feature (1251)..(1251): n is a, c, g, or t
  misc_feature (1268)..(1268): n is a, c, g, or t
  misc_feature (1275)..(1275): n is a, c, g, or t
  misc_feature (1283)..(1283): n is a, c, g, or t
  misc_feature (1288)..(1288): n is a, c, g, or t
  misc_feature (1300)..(1300): n is a, c, g, or t
  misc_feature (1303)..(1303): n is a, c, g, or t
  misc_feature (1313)..(1313): n is a, c, g, or t
  misc_feature (1316)..(1317): n is a, c, g, or t
  misc_feature (1410)..(1410): n is a, c, g, or t
  misc_feature (1427)..(1427): n is a, c, g, or t
  misc_feature (1433)..(1433): n is a, c, g, or t
  misc_feature (1440)..(1440): n is a, c, g, or t
  misc_feature (1442)..(1442): n is a, c, g, or t
  misc_feature (1456)..(1456): n is a, c, g, or t
  misc_feature (1461)..(1461): n is a, c, g, or t
  misc_feature (1477)..(1477): n is a, c, g, or t
  misc_feature (1491)..(1491): n is a, c, g, or t
  misc_feature (1508)..(1508): n is a, c, g, or t
  misc_feature (1515)..(1515): n is a, c, g, or t
  misc_feature (1523)..(1523): n is a, c, g, or t
  misc_feature (1538)..(1538): n is a, c, g, or t
  misc_feature (1545)..(1545): n is a, c, g, or t
  misc_feature (1564)..(1564): n is a, c, g, or t
  misc_feature (1576)..(1576): n is a, c, g, or t
  misc_feature (1612)..(1612): n is a, c, g, or t
  misc_feature (1652)..(1652): n is a, c, g, or t
  misc_feature (1695)..(1695): n is a, c, g, or t
  misc_feature (1816)..(1816): n is a, c, g, or t
  misc_feature (1827)..(1828): n is a, c, g, or t
  misc_feature (1832)..(1832): n is a, c, g, or t
  misc_feature (1835)..(1835): n is a, c, g, or t
  misc_feature (1841)..(1842): n is a, c, g, or t
ttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacatttttcggcatatttaaaaagcaattaaaaaatttttaaaatttaataattttcctgcaccgaaggtactcactcggcctcttcgcggcctcgtggtgggccttcgcccccccccctcccaccgccttcagagcacgacaaatattgcaacaaaaattttgaaaaattgactagagcaatcgaacgctaacggacgacctaatggaaaaaaatccccgaaggagagaatttaattaaatccattccttcgggggaccgtgccgggcgccgcggggtaagcagcgctggttcgactcatcccagtaccgaaccttatagaccaataaagaaatgaatttttattttaaagattccgacatccgaggaggtcgtggaacgagttttttcactggcaagcagtcaatggaccaaagaaagaaattcattggaagttgaatcggtgaaagcgctcttactggtgaaggtgaactttgatctctcgtgcgcggaaatgaggaaaatgatcagcggaaacaaaaaaatattggaaaaaatccattccgatgaaaaatacaaaccatttgaataaattttaaccatttttcattgcatataataaaaattttaaatgtgcttggatttcatgaattttccccactatgtccttgaaaatcggcatacccgtccttggaaacggaggatggacgatggcagccctgttttaatttaatatgcaagaaatataagtgcgtaaatatggagaaatgtgcgtgtttaaatatccgtcaacagcgtaggaggagcaaatttggacattacaaatgcgggggaggagcaaattaagacagaaaatggtgcacaaaagaatagtgactaataggacagaattacaaaatattaaaatatcacataaaataataaaataggaatatcacatgaaataattaaacatttaaatcacatttcaactccaaaatattttctctttcattttcacttttccattttctctttttccttcatttctcttccatttctttttcccctttttctccaattttcttcatccgttgcctccttggcgacactcccnacnacantttcanttccttcctcctccnacacancttcanattctctctattcctanacaactnccatattnaactncttcattctacntcnttcacttcanatnncataactcatttattcacaaacaacaaaaattcaacataaacaattcattttaccactttattaactcctcttttttcttatccccacaactntcatttaatcatcatcntcactnctttcantntacacacaatttcnaattnattaacttattaacancttttatataccantcaatccacaatttttnctctctnacaacatnaatcatccctaattncacatcnaaaatcttaaaatactcantcacacatattnacaccaaacttttttcctaataaaacaaaatatttntctaaaatttcttaacatttttcattccactcactaattnttctcattaacaaataatctttcactacatcacacaaccaatnaatctcactacattttactccattaaaaaacaatctatctatttcttttatttcttattctcattttaattctccttttttttattatttcttttaataatttacataaaaattaaaattnttaaataaaannattnttnatattnnttattaaaaggttaactttttcatatttttaaattttataagccccggggggatgttttttttaatgttttctcaaaaaataactttagaa

SEQ ID NO: 31376 - DNA, 1206 bp, Heterodera glycines
gccaaagcagagtgggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcctttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgaccaatttaaatttccttacattttgggtttactttattatgctggcccatgaaaaaatgcagtttttccggtgccaaatttttgtgaattttcattcggcgcgtcataagcggattgtttggtggcaaatgcaaacaaattttgtgttattcgaatgcgctaggcgggctcgacatttccaaatgtatcaacaaagggtctatctccactctctggcaaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcctttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgaccaatttaaatttccttacattttgggtttactttattatgctggcccatgaaaaaatgcagtttttccggtgccaaattttttgtgaattttcattcggcgcgtcataagc

SEQ ID NO: 31377 - DNA, 1206 bp, Heterodera glycines
ggctgagcttcggtccggcctcgtcgcctgcctctccccccgcccccgggggtgagagtgtctctttcttctgtctctgtccgcccttctgcttcattgctttctcgagtagtctcagtgaagagaaagaattgggcaataaattgctctcgtcaatgtgttgaacaaaatcttttttcatttcgctttaaaataatttttttttcctcatttgtcagccgtaattaaaaggaccattcattgggtaaatcttaattaaaaatcaacagcaaaatttgtaaaagaaaataaataattaaaaaattaagcatttcagaataaaatgtacggacgacaaagcaataatcattattttccccaacaaaatgtcatgggcatagaagaaagcgcaacaacgagcagtcggaacagcgccggagggggagagcaccgagtgatccgatcggaagtgtggagtcgcttcagactggagggactgaacgcggtttgcttggtgtgcaatgagaagctgaaagtgggccccacgcgacagacgtaagcccagcgcaatgggctgatcaacagccgatcactaattcacgcattgaaggtccagcctatggcgccatctgaagcggcacaaccgcgtggcggcggcccaaaaccaacgcattccctcgggctttctccaaatccatccgcagagccaactgtacatccagcaacagcagcagcaaatgatgcgcaacagaagcaacaacggttttgcggcattgaacggtggcgactgcacaattcaacagcaacaaaagggcgttgtccattcgcatgcctcgcgggcactttctctgcaccaattccgcctccagcagcagcagaaaatggcggcacttcgggcagcacccgcgacggcactgcttcacaacaacaatttccaacaccaaaaccaccacactcaacagcaacagcagcagaattttcgccatctgctgcacccgtcctccgcctcctcctccacgtcaccgttcatccagcaacaatcggcttctcctcccccatcctccgccgtcgaaattccgctcacgcatccgccgctggtgaccgtggattgcaagccggtgcagaaccgggaattggaccaactgctgggcatttgtcgagaggagggggaggaacagcaggaatatgatgggaccatcagcagcagcagcaggagaggggggatgg

SEQ ID NO: 31378 - DNA, 2341 bp, Heterodera glycines
  misc_feature (1446)..(1446): n is a, c, g, or t
tcccaaataaaattaaaacggtagtaaagaaagaaaattcatcttcatcccattcgtaaaattaattaaaatttaatcgaacgccaaaagagcaaatattaaagtttcgttttcgtaaaataattaatttaatttaaaacgccaaaaaagttcggaaaaattaatatcgagttttatcaaaaaaactcaaattttaaatcgcaaaattagaaaacaatttcgatctttttaaaatacatttaataaaacgctaacgaaaaacaataataaacgtttttcttccatctttcaaagaaaaaatatatcaaaaatttcgaagatgggtttttcggtccaatagcccgagattctgcaatcgtaacccccccccccccccaatatccaccaaaatccttttccccgtgaggggggcaggtgtgatgcatttggatgaataaattttagccctcccctccttctcggggcgggatgagcaaatattatcatctttgtggcgctagtggacgctcccatcacattacaatcctttccctccgctggtgctggcgctttccgctctccccccccccctctttttcaggatgggatttatactgtaagcagtggcccacccctccctatcgccaaaatgccaaaagagagaaaatagtgtgtgccaacggtcatcaatggtggtgccaaaattagtcaggctaaattgggagagggagaaagtgcgtaaattctagcctggaaaaggttttttccaaaaattgaccaatgaattttttgcacgaggtgtaaaaactaagtatgtttatttaataatcaattttataaaagtacttttattttcaaaacatttacaaattttttctgtttttgaatcatcggataagggggctaattgtaagccaacgcggaccacatcctttccaaaccaattgaaagagattgaaaatttcataacaaaaatttcatcattagaaaaaagcctcaattttcaaaacaaaaactgctcgcgggcaaaaaggacataagcgcacggaaaaatgttggacaaatttggtgccaaatattttcgcgacttaataattgtaaaaaaatagttcattatttgtggcggcagcagtttttggccaaggttttaagtatcaaacggtttagccaatgccgtcggctggttttgggtggaaaaatttaaggcgccctcgccggtcacgcataccgtatcacgtctaattatcccccgtctccaattatccccccccctttctgagaaggttgaacaataattccccgggggataattagagataatagggtatctgtataattttttggcctcaattatgggccaccagccaaaatattttgaatgcaattaggctgcttctgcctattcgacccttggcagtattatattattgttcattttcttggaatttaaagtttttttggaacganatattacaatttctcataattaatttatgccttaaagcgacaaaaaaacaatttttttaagtcttaggaataaattttatttcacgtaagaaaacattttttctaaaacacggcaaaattattaagaaaatggaaaaatcaaaaattcggagaaaaaattttgggtcaatttctctgaggtgcttttaagccattcaaagagatgacttttgttaaaattaaagaaacaaaaagtaattttttttaaaccaagctcaaaaagaaattcaaggggaaaagacaaaacgataaaagaactaaacaattcataaaatgagcaaacttttaaaatataaaatttaaaatagtaacaaatggaaatagattaaagggatttaaactcaaaataaattcaaaataaaagggctttaaaaattaaaaaaaatcaacgtatgggactcggcagaacctatggatgctgccggagaaaattttttgaaactttaccggcttccaaggacaatcctggaaagaacgccgctttcaaatttttcatgaagaaaagtacattttcgaagttttagaaaaagcaataaattcgaaaaacatgggaaaatttatttttagaaaaaccctattttaaattgataccatttccggtgggtttttggcgtactaaaaaaacacaataaacactctcaaaggtagaaaaaattctttcattttcctgagttgggggtgagcaaggcaagtttaatccaacgatggataaattaatatatatcccatggattttgattagatttggtgggtggggtgagaggcaaaagggcgacagtgccagcgataattcactgtttgagagttcctccctataagatcgggacaacaatttttgaccatttttgttcagcct

SEQ ID NO: 31379 - DNA, 1168 bp, Heterodera glycines
cgttgttgttgcacagagcgttcagctaccgctgcggttggctcaaagccggtgggcccaacgtacacgtcagtgccatgcaacaccagctcccacttgagcaattcggcatctgtgcgagtgagggcagaattttttttgtggctgaattttcatacaaaaaaaaaatttttttttaaattttttgtttttgatacgatttaaaaaatgtacgaactgtatcctcattcgaatgtccaataataaatggaatttttttctttcaatttgtccatccgtaaataaaagcggcacaacaaaatgccatggaaaaaaatgcgaattttcgctctcggcatttataatagcaaaaaaaattgggaaaaaatatgctgaattaaatgtgataaatttcatggaaattagcccttttttggctcgataaacatgattttccatcatgaaataatgccaaaaattgttgaacccaaccaaagcaatcaaaatgccaattgccactgaccatcgttgccatcgttgtcaatctccagggaccaagtgccgtacgcgctttcgccccaattgtgcgtggtcataaatgcccactctttgaaccccgttctgctggtgtcccgttgccgttttgccaaaagcgtagagcgagtgcctgaaaatttgcaaatttttgaaaaaaacaattttttttgaatttttgactcacccctcggcgatgtcaaataaatttgaatgtcgccccgtcttggcgcgctcagtgtgacaattgcttgcacatgctccaagtatttgacctgctgctcccgccgatcggcacatccgtccgtgtacacttgcaaatgcagccgattgccgttgggaatggtcctgacaaaggagagtgttcgggtgatggtggaacttccaaatgaaactttgtaggtgggtagaccacccctgggttgtattgccaaattttttttctagctgcggaataagcttctgtgccgagatatgaggctttaaatatttaataattatattatattaaatttaaaaggagaagcaaaaagcgaccggttggcagggtggttgtgtgtcacgatttcatttttgtaatggaaagttcgagtcccccctacgcaaacatttttttttattgtttttaataaattttattttaattttctctaaa

SEQ ID NO: 31380 - DNA, 1193 bp, Heterodera glycines
cttcataaaatatataaaatatcaaaaaaaaaaaacaataaaatatgaaaatatgaaaatgtttaaaatcaattttgatcggcctcagtttcttcaccactctctgaatttccacggacgtgaaatccctccgcaaagccttgcatcacgagcccgtgcaagctgctctcttcggacaatggaatcgtcggagttgatgttatggcgaatgcagtccgaattgtattggtccactgcctgtcattatggacgcctgggacacactgaacgctaaaattgataaaaattttcataattttcatgacaaaatagttgcatttacgagttgtgcttcgagtgcgtcgaagaaataagcgtcctacatctgcattgggttcaaatgcctccgcttgagtgccaaagagaggactgatctgattttgaaaaaattaaaaaaaaagacttgctaatgaaaaaacttacctgaatgttttgtgaaccgattttctttgacccagtgcttcggcattgttttcggcaaataaatgaaaaatgcccatgctcctcgcttttctgaacaatgcctgcgccatgtggaagttgcagccggagcgctcgcatgacgggaagacatgccgcattgccttcagcattcctgctcgaagtcgcacatcacttaaatagtaattattaaagtcattatgtagtttttcttgcctttaattggccggatgggatcaatggcacgcttcagttgttgaaggacttccgcgtaatactttgacgctttaccaggcagtaaggcttgcgctgcgacgaccatccgattgttcacgtaacagccgatgacaaacacttgcgtccaaggctttggtgcactgcggaaagtgccgtcaaggctccaccgacgattttgtttgagcattgatacagctgattgatttctgggccgtttaattggcttttgcaaactctcaagaatttcgcgaacagttggcatttcttaatataatatgaatagaaaaaaaacaaattttaaaaatttggcataaaaaatagaaagaatgatgtatttgatatcagaacagattcatttcctcttatttactattccttaataattgttttttgatcagttgacaaaatgtcagttggcgaaatgtcagattttggttgttggcgaaatgaatgtttttggctgagttggcgaaatg

SEQ ID NO: 31381 - DNA, 1482 bp, Heterodera glycines
aatggtaattaggtaaataaatacatttactatttcactttttggactcacagaaattttttaaaaataaataaaattgcactcaaaaaaagccaaaatttttggagttgatttttaaaaaatctggaatatggcttatattaaaaagtctaaagttttataatttaaaaccggtacccccccccccccggttttcggtttcgtaattgaaatttttccggcactttctcagtatttgatgagtgccttcatgcaaaatgaaatacctatatgattttaaattattaattaattgaccaaatgagtttttcccaatgtaccttacccattttacataaatagagttattgttcaaacgatcaacgattttaatcctacaatctaaaatttaaaaaatacttttgaatgtgaaaaaatccttctaaaaacattttcataaacaaaattattcaaaaaaacaacaacaaacaatagaaagaaagtaaacagcaatgggagaaatagtacactaactattacattattttacggtaaagaaacgagcgctgcggagaaatagtgcatgaatgtgcaccactctttcacccatttctcgctctctttacaccccagcaaaaaataaaatatcaaatttctatcatatataatgaaaggcgctccacgttgacgctgtgcgattgctcgccggcgccgtttcccgcttctcgcggttggccctcgtggctggctgcgtttgtgttcgctgttcgctcgcctggcgagcagcgacacttgcgacgcatttccctcgttggggggtgcggagccaaatttggcgaagcgtctgataagacgttgagccgaaatagtcgctgtcgctaataagcgccagtggcaaatttgtccttgtggcgattgccgcaagggcaaaatgtgggaccatgtccttaataaaggtcatgggcccagaaatgggcttggcctggcaatggccttgccctcatgtgcgatcgcttagcgatcgccatgctccccgccggcggttgtattcggttggagtcggcttgagcgctaaatcgccaatttttttttcagttagccgttaaaaaaaattaattgtttttcaaaatactttcgaattttttccatttttcctccaattttatccgaaaaagcctttcaaaaagaacaataaatttatgtatgacaaaaatcttttaaaatctaccaaagtttcaaaaaaaaattttgccggcgctgcctgctccttaatttgttcttaaacccgattctttttatggtttgcttttaattttgatgaaaatctccaaattttccacggcatctatcggagaacattggcccaatttcattcttggcaaccacgacccagggccgcccttctcacccaaattttcaaaaaaaaaaaaaaaaaatttagcttaactatgaaaaaattgtattccatcgcatctcaccacaaccttttgctagcgtacaact

SEQ ID NO: 31382 - DNA, 1543 bp, Heterodera glycines
  misc_feature (1524)..(1524): n is a, c, g, or t
cttattattggactttgaacgtcggtggcgacctgttggcggtcgatttgttgtcgtcatcgtcttcgatgccgttcttaatgccgattttggcactggactttgataattaatttcactctttgtggtgcacattggcaaaatgccggcaaatgtgccgggtattggcggtcgatctgtggtcgtcatcgtcgtcgatgccgttcttaatgccgattttggcactggattttgataattgatttcactttttgtggtgcatattgacaaaatgccggcaaatgtgccgggcattgtggcaaaaaataactgagtaaaaatgacgaaaagcggcaccaaattcatcgcttcttgaaaacaaataagcagaattttcttttttatcttaaataaaaattaacatttttaattgtaaattatcattaatgcataaaaaatgaaaaatgttgtataaataataaaaaacttgttgcattttattgatttacattgacaaatatgttttttttataagaaaatataataacaaatatcatgaaggctttttttgaaaaatatttgtattaaataaatagaattaaataattaacgttttcttttatttttggtgaatattaaaacccaaaatgttgatgtaaattgaataattggtccagcttatgagcgctactttcttatataagtttatataaataatacttattacgtaaatttttgtgcgctacttgctacgtgtaatattttaataatttttattcgtattattttataccatttttgttgcattattacaattataataaataataagtattcaatgcatttattaaaagtgcgatgaaacttttcaacttatagcacaatgagatacaaaaagtctgaattgccattatttttttatttgtccacaaaatctatggtatatcatttcaatttacatgtttataagataattattagctatttctaagcgattaattaacccgtaaaaagaagttaaagattgaaaattgcaaaaaaaaaatgtcagaattttatatatctttttcagaaaaatctgtattttttgtatatttattttgctgtttttgtttttttagtgttttttaattatatcaagccaaatatgtttgatttgattttcagattggcaatcatcatttaagtaataaaaatttatgaaaaaaacaactttatgacacaataatacagtatgtacattacaaaataaatcaaagcatgtatggaaatcattcaagaagcctttaaagttaaacatgcaagaattaattacctagaaatgcctgttttacatttataaaatttttttccctttcgccaataaaaatgccaaaaattccatactgttcaacatttatccggcttctttcgtaaaatttttccttttaaagatgcaaaaaacggatttctttgtagctgttgttttggactacgctgctgctgctgctagtgcttctgttccggtgcgatttgttccggtgtaattcgtggcgcgttttggcngtctgtttcgatgcacagc

SEQ ID NO: 31383 - DNA, 1070 bp, Heterodera glycines
  misc_feature (857)..(857): n is a, c, g, or t
caaaggtactcgctcggacgcttcgcggcctcgtactggagccttcggccccccacaattttttgcgccaatccaccatcatttaatcactgggactcaaccctccagcatttcaatcactgggactcaattctccagcatttcaaccgccaacacttaaccctccagcttttcaatcaacgggactcaatccaccagcattccaatcaacgggactcaatccaccagaatttcaatcactgggactcaatccaccaacattccaatcaacgggactcaaccctccagcatttcaatcactgggactcaatccaccaacattccaatcaacgggactcaatccaccacattcaagtcactgggactcaattctcccgaattcaaatcactggactcaatctcatcaatccttcatcaatacaattaccgggactcagttctccgacatttcaatcaccggaactcaacctcagcaacggaatacagaactatttaaaaggaatccagaaattgaaatataacccataataaatcaaaacactatggtgtataattattgcccccaccccataaattcaaattaaaactgacctgtttaaaactttccacctaaatttgatccgcaagtggcacgtcaatatcccaattgcatataaatattccactcgaacacaggcaaaacataagatgtagcatttatattgctttttctatccatcaaaggctttttctttcattttttattactatcataatttttcattcattttttattattatcataacatgctttttattcaaaacaaatatcaaaaaccacatcagattcttttcatattataaggcaggaaaagtancaaaaacttaacaaacctttttcattcaaacaaatctaatgaatttttttaaccaaacaattctccattatcgtttacataagcaaaacaaaagctttcacatcaaaatcaaatcaattaacaaaaacaaaatttagacaaataaataatgataaacagcaaaaccacaaattttttcttacacacaaaaatgtgctcttcttttattaaata

SEQ ID NO: 31384 - DNA, 968 bp, Heterodera glycines
ccaggggtattattttgtaaagtcttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttttcataccccattttcgcaccgtgaatgttatttttattgaattctgaaccggtttgagtagattagagtagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctccccaggggtattat

SEQ ID NO: 31385 - DNA, 1387 bp, Heterodera glycines
gaagttctgttaagtcaaaaaaaatccgaacattttataatctatatagaatttaaacatgagaattcatgcgagattttctggaaataagcttaattgcggcctaggtaagctgtaaaaaaaatttggggcgatttgaaagagaatagaaagaaccaggtgcgatgaagttttggtaagccaaaaaaaatgcaaacatttaaccatctataaaaaatttaaaaatgagaattcatgcgagattttctggaaataagcttaattgggcctagttaagctgtaaaaaaaatttggagcgatttgaatgagaatataaagagccaggttcgatgaagttttggtaagccaaaaaaatatccaaatatttaaaaatctataaaaaatttaaaaatgagaattcatgcgagattttctggaaataagcttaattgggccttgataagctgtaagacacccaccacttttgcacttaaaaaaatttcaaaaaatttgatcgtccataaataatttgtaattgatcagcggctcaccaaattttgcagagatacgtatcggagcactacaaatgcttactaattttcctagattttttaaacccggtgaaaattttttgcagacacacccaccacttttgcacttaaaaaaatttcaaaaaatttgatcgtccataaataatttgtaattgatcagcggctcaccaaattttgcagagatacgtatcggagcactacaaatgcttactaattttcctagattttttaaacccggtgaaaattttttgcagacacccaccacttttgcacttaaaaaaatttcaaaaaatttgatcgtccataaataatttgtaattgatcaggggctgactaaattttgcagagatacgtatcggaacactacaaaagcttacttattttcctagattttttaaacccggtgaaaattttttgcagacacccaccacttttgcacttaaatatttcaaaaaatttgatcgtccataaataatttgtaattgatcagcggctcaccaaattttgcagagatacgtatcggagcactacaaatgcttactaatttttctagattttttaaacccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaataattttcctgcgcccaaggtactcactcggcagcttcgcggcctcgtggctgtaaaaaaaatttggggcgattgaaaga

SEQ ID NO: 31386 - DNA, 1207 bp, Heterodera glycines
agtttttagtttctaaaaacctccaaaatagttgctaaaaatgggtaaatagttgctaaaaagttccgaatttaggggtgtaaaatcgaaaattttcttcaaaaagcaaaaatattttgtcaaatcattaaggatatacataatttttaaaattaaaaattatcctcaagaaaataaaaatataaattttggaggtgaatttttgagaaatttttcatttctcaggggtgtgtttttgaaaattttaggggcaattcttaggggtgtattttttgaaaaaaattttaagtcgattcttaggggtgtatttttcgtttttattgcatttttgttaacaaattttggacaaaacgccaaaatggttgaaaatagtttttttcaaaattttatagttttttagttgctaaaaataaaaaactataaaatagttgctaataactcgaaaagtagcttaacaacagccgaaaaaaacatgtttttcgtgcatttcatgccacggggagctcaggaaaaaaatagtgaaaaaactataaatccgagccctattcatgactttttaaaacaaaaattttgcaaaaataggagaggggaaccgatggtatttccgataataaattaatcacaaagtaatcaactttctccacctcaaagtcaaaaagtcgagcctgggtaaaggccaagaaaacattggacagctgaggaattggaatttgcaaacattcattaaccaatccatcgatgcaatactttttagctgaaaacaaaaaaataaatattattgttgttatgtccgaagataacaaattaaataagtttatttgccgaagaaaataaaataataaaaatgaagagaataaattgggaggtccaaattggtggggcacaattaccaactggatgaagggaatgggagggggaagatggcgaagtggcgtggggtcatacacttaatcaataattacttccttctctaacaattatctaatgaaaaacgcaaaggatcggtaagatgtaattctttttttaggaaaatgtgtttttgattaatttataattaaaatataattatttatttataatattaagttttatttttaaaaaaattcccataaaaattaaaaaatttttcgacccgcgtaaagcactgccattgcgttgtctccgtcaaattcgcttaaatcgtccgcgtaaatgaaactgagcatca

SEQ ID NO: 31387 - DNA, 1331 bp, Heterodera glycines
tttttataaattatttaattaaactatgtgtacaaatcttatctttaaatatgttttggctaaaacttttttttgtgtacagtttcatggctatcctatcccctttgtttcacaaaactcataaagttttgtattttatctttttttaatcaatttatttttgaatttatttttgaaataattaatagaactgagttattgtttataattattattttttcatttctttttaagtaaaatgttttttatttgttaatccctattctttattgttcatttcttcgttttgtgaataataaatatttaatttgtcatagttttaggtattatattttgatataaaagtaataatattcatttcttactaaaaaatagcaattgaataaaatgagcttttgatttgaaatttcaattcttttctctgctatttttttatagatccattttatcattaatacgctaacaaagtttcttattattttaaattttcaaattcaccttggtcaaaaattgaaccagtaaaccatattattttaaatttattaatatttttatgcactcataatgtaaagttttgctataatttatttttagtaattaatttgtataaattaatcataagtccttttagaaaatgtaactttatgaggttttcatgtttcccatgagccaaatgatttaaattcaaattttatctattaggctgaataattaaggtgatcaaatttgtgtttttaaatttaatttgaacaacaacaaatcatccagggacgaagatcaagttgaaaatatttacaggaaagtaaattttaaacacttaatttaaataaagcaaatttaaaaaatcgacaatttcggcgccgacttttgcggcgccaacattttatgacacccccataattaatgcgtgaaatttctcttgagttatgccgaattaataaattcttgtggcagggcagcgacgggatataataaggaagattatagctatacggttcgacgttaaacattgagatctaagtataatcttgcagaatgccgagtgatcaccactgatcatgaagggcagccagtctcgcaaactttttttttctaaatgataaaataatgatgaaaacgaagacgaaaacactaaataaaacaatatatcacaatttgatgaattattcatttcattcttgcgtccttattcgctcgaatccatgccagcacaacttgattttcaatcacaatcagagaatttagaaaataattatatttcttttaagggaatacgcaactgacgatgcaaattcttcgtcaaaactttgacccggaaaaacaattacttt

SEQ ID NO: 31388 - DNA, 1362 bp, Heterodera glycines
taataagcttgatatttgatgtggatttagaattattcttttcaaataaatatttgttattataatttaagtttagattatttaaaatattaaaatttgcttgttgaacttaaaatgtaaactattatatgtattgtttttcgtaatttaatgtttacaaataattacctttagtcgaaaatttatattgtcgtctcaagagtttaatgtaaactagcagtttttatttttagtattaattatatgtgcgagaaatatttaaaagagtctacttaattgtgaaatttttaatttctgacattcattaaaatcagctgataaagaaagagttgaacaattaaaaatcttttgaacaataaaagtctttaaaaatcttttcatgtgcaaatctacatgtatttctttctttcttgaaaaacgtttcttaatggcaatgaagtgaatattacttttatattttcttttttagcattctttatactaaattaaaaatatttcatattatttataaaaatttatatattatgctttttcaaatgtagttatctaaaatttattttctgttttatcgttatagttttttgacattttagtttttaaatttatttatttttttattaattcaattatttatattgcattctgtgccataagaacttcattttgagctgcgcatattaatttaaaattcgataatttattcgttcaaatatttatactgttcaatttttggcaaagcattagttctttcaatggtgtatgttttagccattcattgtttatgaagtgaatttaaatttaattattattatttcatgaagtttttttctttgctttcagttttttttattttttcaattagttttatacattttagtaattggagacatagtttattttttaaatatttatgaataacgatcgctatcattttatttttttaatatttatgaataaccatctctatctttcgcccaattccaacaatttgccgccataaattacacaaaaaatgctaccaatttatgccctcaaacttgggtaattaaaccaaacttttacaacaaaatgtgtgaaatgggggttggggttggacaatagaaaatggcaaaagagggaaaatggggacaaaggaatggcacaaaagattgggggaaaaaggggggaataatacatggaaattgggagaatgcctagggagtgaacagggcatgaaaaatgggggtagggcacaaaatgggggaagggtccgggcaatcaaggggggggggggagaagagcgaattcacaattcgccaaatgatcacaaaatgattattttttccctttagtcgtccgcctcggacttgtttgtcactcgtt

SEQ ID NO: 31389 - DNA, 1444 bp, Heterodera glycines
  misc_feature (29)..(29): n is a, c, g, or t
agaccgagactcttcgaacagcagggganaaactggggggagagaggctgtgttaggaaaattattaataaactaagcattaaccagcgagaaaattttttattgaatgtaaaatgattgaaaaaggcagccaaaaaagtgtgttgtttttttttattaataaaatattttaattaatatttttaatataatttttaataaaaaattaaggttttatggtgaatgcgaaacatttattaaaaaatatctaattttgtaatgtttttaaattaagaaaagacatttccaaaataatttagcgattgaaatgatagtcattttggaaattttaattttttatttttacatacatttatttatatggacatgaaattaaatttgttgatttaaatgagacacatactgtatgattaagttaacttggttctttttcattttcttcatttttcatcattccgttttcttccgcttttatgccaatgccatcgaacggacaatcgcagctaatcaaaaatattaaataaataatataaatcaaatttgaattaaaaaacaaaaaatttaattataaaattgcttaaaatgcattattgacataatacataaaaactcttaagtaaattcatttttaaaagagattgattttctcaatggcaaatttaattttaattaattattattttttaatttaaaatgctttttttgtcactaccgccgatgatcagcacaacaaccgtagtgatggcggagattgatgctgtggttacggtaccgctttcgctcacgctcacattaaattcgacaaaaatggccgccagattggctgaggttgtgcgttgatgttcatcgggggtggtggtcgtctcgccaaccgccggtggatcaacgataggacctttaccagggaggaaattttaagaattcccgggcatcgcctttcggcacgcgcgtctgacccctaaaaaaattgtgtctcgacgaaataaaaaattttggtttttttaattattggatgaggcttcagcgaaaaatttccaaaattttgcaaaatcgcgacgaaaaaataagagaataaatagcaaaaaaatgatctcatcgtttaactagctcttggtgatctgttgatgaataaaagaggctttccttactatgaattttattcagctctttgaactccttgttgcagggataaaaactgccaaccaattggatctgatcaacacaatctttgcaatttgggctgcctcccgcttccctgcaaaagtcttcgaatttccgatcacatttgttgccatcataacatgcgctgatcacaaaaatatcattcccgttgcctggatgataaaagcttggtaaagcaagacctttaccatagagaattgcataccaccaaattttggcatctttacagttccgtcccttccccccccccctcgcccacgac

SEQ ID NO: 31390 - DNA, 1292 bp, Heterodera glycines
tttatttttatctcttttttgaagaaagtttaaaaatgaaactcattgggattcgggaacaaaaggaggtgcacatattttcgagtggaaaattttttcaccaaaatcttctaaaaatgtgtctttaggggtattttaaggctaagaattgaagcatcattctgggggggagcgttaggtctggatccgggtgaagtaaatgatttttctatattatttttccatgtttattaaaacatttaaacgaatttcatttagaattaattaatttttataaaatagaaaaagaaattatttcgaaaaaataaaaattctatttaccccccgggcagataaatagagacggggagattatttttcaacctacttcgaaaggggtagataattggagacgggcatataattagagaaaatacggtatattttgatttcgggctattgttcttatttgttttgatttcgaaaattcatttggttttaaaaaatcaccaaatcatcagaattttttcttcaatgacaaatttttcaattttcatcctttctcgagttaattatttaataaatgaggaagtaattcttgtgcttttaatcatttttacgatcattttaagtttgtaatcacaaaacagaaattattattcattattaaacatttaataatggcaagggcaaaggcttctccccattttcttccgccaaagtcaaagtgattcccccgccacccatcgttaggcaataaaaagggaaaattgaagagaaagagaaggggagggagggggaggagaagcactaaaacattattagaggtgtttttaaagagacaaaacaatgtttacggacagaataccaacagaaagaaacagcgaaagcgcacacaaaatgcattttatccgatcaaatcagtttactgattgataatgaagaattacatttgaatacacatgaataacccaatcgatggcacgtcgtttaatgacgaaaaaaacgcagtatttaatttatggcttatagacttgggcccggcttcctaaagggtcgaatgctgaaatatttttgcgtttccgtggtatcttctgaacatgtactgaaacaaatatgtcggcagcatttcctcatttgaaccacgtaagtgtcggtcagcagtaatatagctagtcgaaacatagcaaccggagtttgaagaatggagaaaaaatgccggctggctgctttttgccaacgaacggagagaaaaagcggctagtattggtttttgccgacaaatggagagagaaaggccggctgttacttgg

SEQ ID NO: 31391 - DNA, 991 bp, Heterodera glycines
gattttcttcatgttgataagataccacagaaaaacagtagaacaaccgcagaataaatcaaataaaacaaatgatttgaaaattaattttctttaatcaaataataaataccatctgaaaaatgaagaaaagatgagaaatatttccaattttactattttacaacagtcaaaatagtttcatatttttaaattggaatttcaaactacagcagcaccaaatacaattagtgagtgattaattatagtttgaaaaacaaagaggggaaaggcggaaaagataaaagagagagagagagcagcagcaattgactttgttgtggtggatttaatttgaaattagtgggacgaaattcccgttaatgacaaaccgagagcacaaattgaattctcgaaactctcgaacagtccaatagaataagtgagttcaaaaaagtgattttcttcatgttgataagataacacagaaaaacagtagaacaacagcagaataaatcaaataaaacaaatgatttgaaaattaattttctttaatcaaataataaataccatctgaaaaatgaagaaaagatgagaaatatttccaattttactattttacaacagtcaaaatagtttcatatttttaaattggaatttcaaactacagcagcaccaaatacaattagtgagtgattaattatagtttgaaaaacaaagaggggaaaggcggaagataaaagagagagagagagagcagcaattgactttgttgtggtggatttaatttgaaattagtgggacgaaattcccgttaatgacaaaccgagagcacaaattgaattctcgaaactctcgaacagtccaatagaataagtgagttcaaaaaagtgattttcttcatgttgataagataacacagaaaaacagtagaacaaccgcagaataaatcaaataaaacaaatgatttgaaaattaattttctttaatcaaataaataaatatcatctga

SEQ ID NO: 31392 - DNA, 1355 bp, Heterodera glycines
tgtttttggaagatttttggttgaaaaaatttttctatcaaaaatcatgttcacacccctgtggtcccaaattccaaaatcacttttatttctataacttttttcaaaaaagtgataaaaagctaaaataaaatttatgaaatagagcaaaaaattgcggattttttgagtatattatttttataaaatactttttcagaagggagttaggaatttttttctgaaaaatcgaatttttccagaaattctggaataacttttttattttggaagatagaaattccaaataaatctcataaaattctcctaattttttgctatttttcaaattttattccactaaatttgaccaaaaacgaagagagttatgaattttcaaaatttcactggatttccggggctcaaattttcgcgcccgttttttaatttttttagggacattcggccgcttcgcggcctcaggacgggcgcttcgcgcccgtcttttaattttgtagagaacattcggccgctccgcggcctcaggacgggcgcttcgcgcccgttttttaattttttcgtgggcattcggccgcttcgcggcctcaggacgggcgcttcgcgcccgttttttaatttttggggaacattcggacgcttcgctgcctcaggacgggcgctttgcgcccgttttttaattttgtggaaaagctaaaataaaatttataaaatagagcaaaaaattgtggattttttgagtatattatttttataaaatactttttcagaatggagttaggaatttttttctgaaaaatcgaatttttccaaaaattctggaataacttttttatttttgaagatagaaattccaaatgaatctcataaaattctcctaattttttgctatttttaaaactttattccactatatttgatcaaaaatgaagagagttatgaattttcgaattttcactggattttccggggctcaaattttgacgatttttcaaaaaatttttaccaccttccaaaaaatctgaaacgcaaaataaagcgtatatacgtattcagcaccaaaaattaggccataaaaatgcattttggctaatttaggagcaaaaaaaattttcatgaaatgcaaaaccatggggtcccccctatggttttgagtttcaaaatcacaattaattttataactttttttaaactcatggtaaaaacatgagataaagcacattagattgggcttaaaattctctacaaaaatgctcttgcatgactttttgctaaaagcaacccctgagaagttatagccacagaactgaaattgaggcctaccaaccaaaaattttctatttccaaaaaaattttaa

SEQ ID NO: 31393 - DNA, 1178 bp, Heterodera glycines
  misc_feature (1160)..(1160): n is a, c, g, or t
agaatgaccgatctcttcccctgggcttgtatttgatgtcatgatggcgcaggcgattcgaagcctggacggattttcatatacgatgacgctcaacacaataccgaatttggacggaagcaagggttctgattcggtgaacacctttttcaagcaatttgatatggcgacagaagaatggcctgagtcgaagcgattgcgggcactgcgctcgaaatgttttggcaaagctgagagagctttcaattccgcaattgctgaaaatcgtcatgattatcagctgatcaggagagcgatcatccgacaattagacgacacagatgccaaacaattgacggcgtttgaccaactgatgaaaggagtttggcttcggccgaatgaaggcattgatcagcttggcgaacgtgtttcgcgcttggtccgttgtgcatatccggggctcagcgaacagctctacgacgaatattcggtcatgcatttcattagggcactccctaactcagaattggcaatgactttggagatgactcgtaaaccgggtgcaacattcgatgagttcatcgcacaagcagcacgagccgaggcagttcaaaatgccgcacgaaatttttggcgaaacagccaaaacaacggctgtttccaaaaccaacgaaggcacattgtttgctataattgtggccgagtcggacacacttctcgaaattgctattcacagccgacacatcaggcgcaccaggacaatccaagcagcaatttccattcatcaccatcattcaggaaccaaaattttcactttcagcaaagtgatgaaccacagaaaaggggaaatttgtttgtcggagccgtaatcagtgcttgtttttacaagaatttttgattttaaatattatttatctaaataccgatggcttaatttttattactttttgaatagatttttgtcattttacgtccctaaattttaggttttttagtgcatactattttggggtttttagagcctaaaaattacatcccgtaataaccagagctgtcaaaaaatatgcaaatgcatatttttttcccggattatacatagtctaactagtaggaaaaacatcttctttttgtatttttgcgtataaaagtggtgacctttatggttttatgcatatttttgngtttttctgcatattttg

SEQ ID NO: 31394 - DNA, 972 bp, Heterodera glycines
tcgcctcccaattgaatgatgacttgcgtccggccacccgtgttgtccatttgagcgttattcacttaacaatatgttaataaggtggtgtaattttgcattttaaataaaaattaaaaaataaactcactgatcggaccgaggaattggtccatgaacaaagtgaggaggtcgttgtggttgatctgttcgtgctgctgcggtcggtcggaagcctaaacaacaataacattgaatttttttgtctaaagcccatgtttttttttgtttaaagagtgatgccgagggcagatttcttgggatttcgttcaattttgattgcccagccaagatttttttgtggcgcactttttcaaaaaattaattttgggagaccagtggtggggtgcggcggcgctgtaaaaaatttttataatttaacgcggtttgttaacagcttttgtctaaaaaattggccaactttttgctatttaaagttcaatttgttgatgacaatagtttgggttacggcagtgccgagttcgatgacacgacctttccccccgtccccccattgcacagctatttatgataagcaatgaaaaagtcgcaactccgaaaacaaacaaaaactgtgcatggatggtcctgttttgtgacaagtcccccacccaatccgactcaactcccattcgaccattttgacacttttaattttaatgatttttcctaaaaaattgcctgctgctgagcgtgactgcgttgcgtgtgcggctgctgatccatcggcactggtggcggcgtggcagcggcctggcgatgctgcggctgatgggtcgccgtggacggcccttcgcttgcggaccggcgatggatgagcaccgttggacgaccgtcgttcccagccgcggcggtggtggtaggaaaaatattgttgtggatgagttggaagagctgaaataaataaaaggatggaattaaatgattcaattg

SEQ ID NO: 31395 - DNA, 1183 bp, Heterodera glycines
  misc_feature (22)..(22): n is a, c, g, or t
  misc_feature (1091)..(1091): n is a, c, g, or t
gagaatttattatagaatgcanaattcgccttaaattaataaggtgaaagtttgaaatgtttattaaaatatttcaggtgaaatacaattaaataatcaaaaagaaaaaaaataaatttattttactaaataaaaaaaaacattgtcagaggcagtgcctgccgaaaaaaaagacaaaaaattttttgaaaaaagctaaaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggccagcaattaaagtcatttaaataggcatatttaaaagagcctatttttttgccttttcacaagagaatttattaaaaaaggcaaaattcgccttaaattaataaggtgaagtttgaaaatgtttattaaaaaatttcaggatgaaatacaattaaaataatcaaaaagaaaaaaataaatttatttttctaaataaataaaaaacattgtcagaggcagtgcctgccgaaaaaatagacaaaattttttcaaaaaagccaaaaaaaaatgaaaatttaaataaatttataagtgaaaaaaggaaaaaagcttacaacaccttcgattcccaggacgtctccgttccaagtactaagaaggcccaacgttgcttaacttgccagatcgcacgggatggcgtgctttcaacgtggtatggtcgtaagcgaaaggacagcaattaaagtcatttaaataggcatatttaaaagagcctattttttgcattttcacaagagaatttattaaaaaaggcaaaattcgccttaaattaataaggtgaaagtttgaaaatgtttattaaaaaatttcaggatgaaatacaattaaataatcaaaaagaaaaaaaataaatttattttactaaataaaaaaaaacattgtcagaggcagtgcctgccgaaaaaaaagacaaaaaattttttgaaaaaagctaaaaaaaaaattgaaaatttaaatanatttaaaagtgaaaaaagtaaaaaagcttacaacaccttcgattcccaggacgtctcccgttccagtactaagaaggcccaacgttgcttaa

SEQ ID NO: 31396 - DNA, 1277 bp, Heterodera glycines
  misc_feature (64)..(64): n is a, c, g, or t
  misc_feature (138)..(138): n is a, c, g, or t
  misc_feature (150)..(151): n is a, c, g, or t
  misc_feature (203)..(203): n is a, c, g, or t
  misc_feature (248)..(248): n is a, c, g, or t
tttggttttcattccaattttctatttttttgtaattcattttgtttctgcaagatttctttgntcgctttgtcctctttctcgaacctttccgacccaaatcatgtcaccacgaaaaagagaagtcggcacttcgtncgagaatctgannaatgtgccaccacagcagagcaacgtcgccgagctcgaccaggacggatganccaagcaacgcaaaaagcgcccggccattgcaccagtgactgtgnagatcggacagttgctggaggccttcaaatcatcattgtcggccgagatccgttcatcagtcgaacaacttcacaaggagttgacgggagaagtgcaccacgcactgaacgcactttggaccaaaatggagccggtgctcagcgatcagtcgcgctgcattgcggcgctgactgatgcgattgacgagttgtcactcaagggaaccgagcaatcggtaaacccatccacggatggaggtccagctgagttggccaaagaagcaccgatgaacccgcagggcggaggtccagcttctgagctggctaaagggcgtaccagcccagctcgttcgaccggaagagcatggcacggaaagcaacatcgacaacccgcacgcaaagccggccgtctaaactacctgatgcgccaattggagcgcgaggtcggcggcagccaaatggtccgatccccgcatccgtactgggaaaaccgccgagggaatggttatggaggaccgcgcggtgggggacgcggaggctacaatgcgtatcgcggagaccgttctgagcgcgtcggcccgtcaaacaatggacgttgaatctgtggtgtggtttggactccggaaggggggagagatgttgaatccccttttgacaaaatcatttatttaatttaatgatcaattttcacttatttattttgtacaacttttcttctctctcttcaccgatttcctctcccatcctaaccaatcgttacactttactgtaaacccaagccaagccaatttgtgtccatcccagctcactctcgactccaccccttttctcttttgctatttaaactgaattcattccttgcattattacccctttttttctactcattttgactcattcccattttacttacctttctcacttttgctaaataaactttcattaacaaacttaaagtcttgcttttgattgggaaataagtcgggaacacaacaccattcgaagagatcttagctcaaattgtggcatttatgcctcagaaattatttt

SEQ ID NO: 31397 - DNA, 1269 bp, Heterodera glycines
tttttggggtttgtttgcctttttgaaacccagtaaaaaccgtttaaattgtattgcattaattagttattcataaattttcaaaaagccatgccacaaagtgctttttattccgatttcattttctgggccatcatttgttaaatgtcaattcttccccctcccagtgacatcaattatgtgatggtttcgcgcattttttccgtgcctcgactgaccaaatattatgtgaacgcgacgacgaccaatccgttcaaatcgaagtgacccttaaaaatgcattcgtttcattacgcttttgtccctctcagcgacatttacaaatgcaccgttggcagtctgagctccgactcggacaaccagtccaactattcgaccattcgttccctggagggcattcaggtcgaggcaaattttgatttttatgcaaatgtttcgggagttttaggaatttatcaaactcaaggctcctttcctttaggaccgtcatcgtgaagtggaccatcccctcattgtcagccaccaccagcaacagcaacaattttcccaccattcgtgcgcccgctttcccctgagtttctcgcgtaattccgccaccagcagtgagccgccggagcggttcaaccgcgtgcggaattcgtcgctgcaattggagaccaacgacgtggaggacatcatggaaatggaggagttgcgcgccttctcccccaaccgattgtcgcgcactcgacgacgccaactgtcacagctcggcctggacgacggtttgtaatccgatggggcgggggacatccagtcactgactcatcccaaataaaacttagcccaggaaacagttccgaattaaccactaaaatgggtacaaattgactactttattggtcctcaattggctgcctttctaattctctttaattttctagcgctttcgttgcgtctgagcaatcgcagtcggctgagcagttgttcctccattgccgatgcttgtgcgctgggcgactcatccgccgagtggaagcagtacggattcgcacttattttgccaagtttgtccattgattgctgccatttttacaagtttgactcgctttaggcgaattccgttccttcattttcctacacattttgcaaattgaacgcgaactcgaccgattgatccttcaaattcacaaagcggtccaggacagagcacagtttttccagctgatctacgaggtttggtggtgtctaggaaggcttctatttctggctaatatctgatatttttag

SEQ ID NO: 31398 - DNA, 986 bp, Heterodera glycines
  misc_feature (108)..(108): n is a, c, g, or t
taaaaaggaaaaattaatttggagttaggaatttgattaagcaccaaaggcccccgcgtctttagaagccaacggaagtccgaggaaaccggcgcccgatgagtcctntgataaagttgaacagaatcatccgagtagcttaagggataaaggcaaagatgccatgattgaagtttctctcacgaaatgccttccttccgaataatttctccgtcattcggcaaaatggccgacccctcttcttcctcctgctggtcatctttctgttcattgtgagcctacaatttaaaaaaggagtttcagaagtccgtttcgatgagagtatttgtgtacttcttcggcgggtggcgccgtttctccgtctccaaaattcttctgcggctgactttgctccaccgctgcgactttgtcactgtacgaacgaatggacgaagtcatttcatttgcgatttaaaggtgtcgtaggaaaaagaagacacaaacacaaaaaataatatggccatctttcacaattttagcaatttatatagccttgcaaaatgggttactccattgcttcctagggaaaatattgatcatagtccccaaactcaaaaatgcttaaaaacggtcagaatcgatgtaaaaatgttcgaaatgggttggaaaaatagaattagaggcgcgcttgccctttttcaggctgaaaaagtgccggaatttgagtgccaaactcagctgggactcaattaactgcactataaagagcactcaaaacacatttgaaataatttttctaatttgtgccgctgatcacgaatatgacctttgtttttcaaaattccacccgaacccgaattcgaacaaaaattcgatccaattgaatttagcttattgcgctaaaaaaccgccgcacactcgactacggcggccagtaggaggggcgagagtacgggctagggtagcgttcgcgcgtgatccgcatgcggttgactgattggcggggg

SEQ ID NO: 31399 - DNA, 1598 bp, Heterodera glycines
caattggtctgtagcaaaacaaataataattttgaaaaacttaataagacacaaaaacctaaacatttaaaattctataaaattttaaagattttcaatttacttcagctattttattaaatcatgaaatatttttaaaagtcattttaaaatttataaaaattttctgctaaagtataaagttcttggcgtttacaaaaacttttttcaacaatgtaagcaatttttagtttttacttaaattcaaagaaaatgcaatttattcgttttcaattgaaatcatttgttagccctgatttttttcattgaaaaaatgcactgtaacttttaccatttgttttggcatttttcacccttatgttatagtaagttaatattttacattttttcattaaaaccctctctttgtattaaaagtcgagtgccgatttaccaagttaacatgcactttttgtgacttttttgcgttttttatgactttttgaagatttttaatgacttaaattcccgggagccggaaaatccgacacctatggaaaatccggcacttgcggaagatccgacactggaaaatccgacaccaactttaaattttaaaaataatttgattgtttgagttaatatctgcctaggtttaccaagttctcgaattgaatttacagagaattgttttgttttgcgtcaattttttcatgaaaaatggtttgatcagcttcggttgctggggaggcttaggtccaggtgaattctcatgattttcactcttcggaagacattgacaaactcaggggctgggctggaaccgaatgattcgagaacagaggacggtatggcatgcaaaatggataacatcccccctcccatatgctaaaaactgttaaacacttttttttctcgattcccaaggatcacagagatttttttaattctttttttgagataatcaaaaaagggcatgcaaaaaaatataaatatatatgcctaccgtagatagattatggcaataaaattatttattttggataacttcagtactgtaactttattatatgtattttaaatattaaagcaaagaatcaaaaaattatttttaaaaattaaagttggtgtcgattttccagtgtccgattttcctagagccaaattcccagccctcgttattatataatttagtccataccaatttttaaattttttctcggaaaatgtgttaatttttgggctaaaaaagatatggtcccttattttctctttcccgtcgctttgcttccatctgctgcccctccggtgaccttcaattatggctctaaccgccactgtcctcccccccccccctcgactcacacatttcccttctcggcacactctcttcctcttcatttctcgtcttcctttcctcctcatcccctcttcctcgccaacgctttcctcctcgtcgtcactccgtcaccctctcctttctctcctcacttttcccctctccattttccactctctctatctcttcaccggtgcctatttcgactcttctcaattattgtgctattttgatgcattcattccctcccccattcccgttgaccttttgggcaagaaca

SEQ ID NO: 31400 - DNA, 1050 bp, Heterodera glycines
  misc_feature (1030)..(1030): n is a, c, g, or t
acttgccagttcggacgggaggggggttttcaacgtggtatggtggtaagtgaaagcccagcaattaaagtcatttaaataggcatattaaaaagagcttatttttttttccttttcacaagagaatttattaaaaaaggcaaaattcgccttaaattaataaggtgaagtttgaaaatgttattaaaaaatttcaagatgaaatacaattaaataatcaaaaagaaaaaaaaaaatttattttactaaataaaaaaaaacattgtcagaggcagtgcctgccgaaaaaaaagacaaaaaattttttgaaaaaagccaaaaaaaattgaaaatttaaataaatttaaaagtgaaaaaaattaaagtcatttaaatagacgttttttaaaaaagcctatttgccttttcacaagagaatttattataaaatgcaaaattcgccttaaattaataaggtgaaagtttgaaaatgtttattaaaatatttcaggatgaaatacaattaaaataatcaaaaagaaaaaaaataaatttatttttctaaataaataaaaaacattgtcagaggcagtgcctgccgaaaaaatagacaaaattttttgaaaaaagccaaaaaaaattgaaaatttaaataaatttaaaagtgaaaaaagtaaaaaagcttacaacaccttcgattcccaagacgtctccgttccaagtactaagaaggcccaacgttgcttaacttgccagatcggacgggatggcgtgttttcaacgtggtatggtcgtaagcgaaaggccagcaattaaagtcatttaaataggcatatttaaaagagcctatttttttgccttttcacaagagaatttattaaaaaaggcaaaattcgccttaaattaataaggtgaagtttgaaaatgtttattaaaaaatttcaggatgaaatacaattaaaataatcaaaaagaaaaaaaataaatttatttttctaaataaataaaaaacattgtcagaggcagtgcctgccgaaaaatagacatattntttcaaaaaagccaaaaaaa

SEQ ID NO: 31401 - DNA, 1618 bp, Heterodera glycines
gtcggtgccgagcaaagggttttctgtggcacgaattgctcgcctcaatggcgagtaaagaaagccgcgacttcggcctttgaccgtttggtgtcagagagaacagaggccaaattttgggcgaagctgaagaaaagtgtaaatgatcatttgagatgaaatttttttaacaattcaaaacatttgattccgtttgataattcgattgaaattttagctgattcggagcagaatctcctttgtgtccatgcattggctgctgtttgtttgtccatccatctcaattcgtccccctttccccactttaatcgaccatttatttatccatcggccgcttttcgccggcgtttcttacaccgattggctattggtctgcacagacagataaaccacaaaaaacaaaagcagggcgtcagttggttcaaaatggcagcagatggtcggtcggcttttttgtgcttttcatttgttttttcaccatgtgcaaaaacacctttttgttagcaaattaaaaacatgaattaactatacttaattatagaactcgagaacatcatcatcatcaacacaacagaacactcactcatcgcaattgaacagccacaactctttgacaaatgaacgaacggaatgagaaaagtgggactaattagagaaaagggcaaacgacttggacttgatgaggcgaaggaatgaatgccaaagaaaaccggacattttctcaaaaatagtgagtgaataatagccgaaatttacagataaagaaattataattaattaaatttacaattcttttcattattcttaaaaatattatttattcgtttaaggagcttaacatggaatacgaaagagaggaacaacacccgtttaagaaagcgatgtgtgggaaaggaatccgcgaatgggccttttggtttatcgtcacttttttggcatgtctcactattaaagatgtggtgaatttggtaaaagattatggcaaaataaagcattgttttcaagaaaattttagatcagagaatacggagaaaacccaaaaaaatcggatatgaatggtaaggacaaaagttgccaacccagaaaactcaatttcccgaataattggctacagaaattaatggaattagtgaatcagttgctactagagtgccacgggaccgggacctggtagcggacaactgagtaccaaggtcccggttttttcccggttttcccagccaaaaattcccgggttttcaacccgaaaaggtcccggtcccgggtttgcccaaaattcccggtcccgtggcactctagttgctactctccattaaaatggtaaaaagaaataaacatttttagtgcgtttcaacgacacaatgaaagtgccaaatatgacattttgtatgagtcgtgcgcaggcgtggagccatttcaaagtgaatgcgtcagaaggcgaaaaaaagtgggacaaaaaagtgaaagtaagcaaaagaatggagtaaaatgtataaatgccaatcctggcaaggaacaactcggaaaaatgatcggacgcgaagggtttttggcattgccatgggaattggaaatgacgatggagacgtacaatttggtgatggtaaaaaagacaatg

SEQ ID NO: 31402 - DNA, 746 bp, Heterodera glycines
agtgaagcaatggatgacggtgggcggcaacgatttcctctcaagacttaaaatggccaccatttcttggtgcgcttcactttcatggacaaacaacggtttgccaagatcgcatgccaattggacctggaaaagccaacgcaaacaaaaatagcactaacaaaaaggaaaaataatttttcgatgtttgttttgaaatcagttaggaattggataaaatgaatgtcaaagccccgcggaaaaacattttcacgatttttgaatataaagaatttaaaagaatggaaaacgctggaatttgtgtgtatgaaattgcatttaaaaacgccaaaaaaaaaacctgggtctcgaaaacccgaagttgttggtcccgtggcgagaaatttctgttgaagtccaacccgcattcgccgaccgcgacacattgcgaatttacggtcaaatgggagcgaaggaaatccaacgttcgtccgtcatcgaaatcttttgcgtcatgcggatgaacacctttatgaaaagcggaaaaattttttttgcaattaaaatttttttaggaccggcagtgtaatagagaaagcccggctctttgctggccaattttgccgcttcatctgtgattgattcgcttgcgccagtgatcaacaattttacgataccttaaaatgaaaaaaaattaatttttgattcaaaagtcattagagtctggttttattatagccaatgcttttcctaaggccctatgtagt

SEQ ID NO: 31403 - DNA, 995 bp, Heterodera glycines
  misc_feature (935)..(935): n is a, c, g, or t
  misc_feature (982)..(982): n is a, c, g, or t
gctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtactaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtactaaattggccgaaaaagagatagccattttctgaggcccgaaggaaaatttgagagggctaatttatatgtaatattcgnaagtgccagctaattagcgatcaggcgcacattgggggctgaattangccattttccctt

SEQ ID NO: 31404 - DNA, 995 bp, Heterodera glycines
tttattacaaataaaaataatactttttcacattcttatcaccaaaataaaattaaaaaatttctaaaaaatgtttactcatggcttcattaagtactttgatcgccgagtttgggttgtcgaaatggatccatttgcatatcgaaatgcgttgtcgcgcgcaaatcaatacgctgatcgacgagtccgtcacgcatggcactcaaattttgtcagtgcattagatttttggcgaaatgttggacaacggatgccaatgtttgccgcagttattggcactgaattgttggcacaactgcaggatgagcaagtatttggcaaatttgcagttcgttttaatcttattacgtaaaaaaaaatttctttttttgaaaattgatttttgaaatccaccaaaagttaagaaaacacattaagaaattcttgttttgccgacttaaaataaacactaagataaaatccatttttgagaagaaaaaaaagtttagaaaactactaatctcgattttgtcgagatcccgatcccttccttatttcacaataaaaccgggattggcgggcgggatacggtaatcctggcgagaacttgatcccttccactgaaacattttcaggaaatcctgtaaaaaaaccaaccccaaaccccacataagccctagtctatgcttaaaaaatttatttagttaagatttcgggggattaacaaaagatttaacgataattattttttgtcaagatataattgttctataaaaattttttccctatttgaagcaaatgcttgaaaatggagcacagtttgccaccgtggaagtgctgggcactaaccaaactcaaagcatcgacgacaaaaagctcaaagccactttggtatgaatatttaataaatctttattattgtacataaacgcttttaagaaattttttctaatatttattggaatatttaattgaaaaattttaaattttttcttttttaggatttgcttcgttct

SEQ ID NO: 31405 - DNA, 696 bp, Heterodera glycines
ttttgccgatggatgccattaataatgtgacgacgccggcacccattgggcccgccaaacagtcccacgacgcgctcaaggcggtcatgctggtggtgctcttcttgtccacctttttggcctcaaccgtgcgttgtttttctcactgttttgaatgggccataaacattttggcattttaatgggacaaaaaaaaagttgccatttcaaagtgccaatttgaggtgccattgatgaacaatgaatgagtgagtgttttgatcagttcataattttgtgaactttccgagtctcggtattacagaaaaaggtacttattcaaatttgtcgcggaacaatcaccacaaatttttgtgcattttaatgccaattttgggcggtgccgggcacagttgggccaccccccgccaaatttaagatatgtttccggaagtttcaaggtcgttgattacacgaatatgacatttattttggacattacaattccaaatccaaaaatttgaataaacagtcgagaattataatttttaaattatagcctaaaaatgaagattaaaacactagaaaataatagtgaagcgaatgtctatggaatccgaaattagggaagcggttgttaaggaagaatttggtaaagaaacggtggtaaggaaacggtggtgaggaaacggtggtaaggaaacaacaccaacccct

SEQ ID NO: 31406 - DNA, 1672 bp, Heterodera glycines
ttgttgtttgtttgtccatttaagaataatggctgtggataattttttccaattaccccccccccccccctctctccccaaacttctctttcctcctttcagggaaaatcatccgcaaaaaaatgattaaggccgacagagagagacaaattcaaatttggcgagtgccgtcaacagcgggcacagcttaaaacatttgcacgcgcagcagaagggtctctcaaaaaacaaacgtttggtttatttgttttcagtttggtccgtcgtccatcccatctttcctccccccttttaagtttttgtttctttctgtgcctttttgtgccaatttgccacctttcccatttttcttttcatatgcaaattttctttctccccacgcactttcaatctgttcactttacgtttggaggctttcacagtgtttttcgatttgcatattttccttttttataattggcaaaggttttttgtttgccttttgttccccgattctttggcctatccatcacaacaattcatcaacacttggcaattccctcgagagggaattggccaaggccgttggaaattcaattttaacgcccgagggacaaattttggcacaattgccgaggtcaatggacgaggcatttgtgggtttgttatttgagaagcagtcaaaaattcaaagcctttccgcttttccttttggtcccttcctatcgaagcattgccattttctgcaatttaatttattttttggatatttctctttctttttcttcgaaatatttatgtcaaggccaaactcaccaaccgcacaatttaatttttaattatgaattgtaatattttttccaaacatccatatttaaaattattttacttttttattttatttaaaattactttattttttatttcatttccatttttattttcccctttttcttgccgatgtcaaatcgctaaatgaatgtgaccttcacacgctgagtgccgaaaagctccgcctgccgtaaaattgatttattaatgccacacaaacgatattcggcaccctttagatggatttttccctgtcatcaatgccaaaaatagaaggacaggcggtcgattgttttttgttttttttttgatcaaaataagcgttttcttcttttctctgttcctctgatttttcttttctcttttctcccttttttgctgttcccccgggggataagccaaatccccgccgccgtcgttcttttgtcggctcctttcatctgcgaattcatttcctttgtttttggctaaacttcttttgacacattaattttgtatgaccttaacaaataattgctgttgtaaacagttttagaatattttttgatcaattaatacatttaatttgctttggatttgaaatatttttttatttcaaatttatattcttatcatttattgtggaaaagctgccaaaaatggcacggcaaaatgggaatccgacggcgtctgcctcggccatttaccaccggtctcggtttttgtgcagcagtgacgacgattcgggtcgaattgggaattatgaataattgggggaattaaataattgaaggctgtgcaatggacgagatttacgcgtgggtgcctccccggacaaagcttgacttggtaaaactgttttttattcataaaaaacattttg

SEQ ID NO: 31407 - DNA, 903 bp, Heterodera glycines
actagcgagtgatgtccgtaggaataaaagccaagggcgtggctgcgtcccatccaacaatttcctaatgcttagtgatggactagcgagtgatgtccgtaggaataaaagccaaggcgtggctgcgtcccatccaacaatttcctaatgcttagtgatggactagcgagtggtgtccgtaggaataaaagccaaggcgtggctgcgtcccatccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaggcgtggctgcgtcccgtccaacaatttcctaatgcttagtgatggactagcgagtggtgtccgtaggaataaaagccaaggcgtggctgcgtcccatccaacaatttcctaatgcttagtgatggactagcgagtgatgtccgtaggaataaaagccaaggcgtggctgcgtcccatccaacaatttcctaatgcttagtgatggactagcgagtgatgtccgtaggaataaaagccaaggcgtggctgcgtcccatccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctaatgcttagtgatggactagcgagtggtgtccgtaggaataaaagccaaggcgtggctgcgtcccgtccaacaatttcctagtgtttagtggtggactagcgagtggtgtccgtagg

SEQ ID NO: 31408 - DNA, 1803 bp, Heterodera glycines
  misc_feature (1755)..(1755): n is a, c, g, or t
gtcccggtcccgattttttgaaaaacagaaatcccggtcccagttttgccagtcccggtcccggcgggactaaataagcactggtaagaatgggggtctgggtgagaaaagagaagggaattggtggagatggagaaatttttggagaaaaaaaaaatcaatttttattttatttaacgcatttgtgtatatccttttgtggtttttttttcattttcggcaaagaaattttgtgcaatttttttagaaatacctatctaccaaattttcccggtaactcatttataaattgccaatttttcggtttatatttgaaattttatctcttttttcgtttcatttgtcgtcaacaaattaaaatttttgggagtaaattgtgactaaagacacaaagcaaaaaattgtgctgaacacaaattttcgtactgaaagattaaaaccatcacaaactataaaatttaattcggccgattattttactgccaaaaatttaaaataagttttgaaatgactcacataatatgcatgcaatttacttttaaaaaaatattttatcaaaaaatgaacattaaataacaatacataattcaatcgtaatacttttaatttgattgagcctcaactgttacaagacttccattattgttataggaatagcgcttaattttttatctcaatttattctagcatattaaaacaataataatttcatttttatatagaaacttttacctattatcttttctttatttttaatcaatttggattgataaaatcttaaaagtgttttattcagattaattactgcagaattcgcacataaactttactttaattttatggcttgctaacgcttcatttttaattttttaaattggatttacataaattacttttttttttaatattttatcttgcgaatgtagaccggtatttttcccgccaaatataattcaacgatcaatatactcaacttggttgattaagtgttatacttaatatgacatttggattttcaaatgattttgtgttttgcttttatcgcaaattttaaaaattgttattatttttcaaatattctttaattacgaaattttataaacagtaatagttcttatttcccaaatccatgggatttaatttttcaataaaaactgttactgggccgccttgacgagccaaatttcttggtcactcatgttttcctcaatttttttcaaaattacagttaaggtgtaaacattgcttcatctaaaatatagaatattttatttatttatcatattttatccaatttctttatttatttattaaaagttatcttttgctaatcagtcgtttcttttttgcagtttttagtttattgtatttattcgaaatgttcttaaacttcagtttatatattttatataggtgtagttaaccctattgcgttttggtatttttagtcgtttgtctttgtttttaatgaatttgacaactttaaaaaattttactacaaaataataaattagaaaactctttgcaaaatttatatttattttagcattaaaatttattaatttttattgatgaaatttaacaatctctttccttttacttttttttcattctgttaagtatcgggaaaagaaaataaataatttttttcataaattctatatcatctataaaaaaataaaagaatttttcaattaaaaaacgaacatttaaacaaaaaaaatatatgataaattgaacctatttatatgtatntttatatctttttaaataaatttaatattcagaaattacatgtacatg

SEQ ID NO: 31409 - DNA, 1547 bp, Heterodera glycines
gatttatggaatgcccatgttggcggattttatgaaacgacccagcatgattttaaaacacataaatgggcagaaacttacatgaattgaataatttcttattattaattatgaccaatactttctgacacttttgtaaaaaaaaaattaagttcaaattaagcaaatcaggcctttttgataattgtaaaagggataaaaaattgggtgcgattggatccggattttttgagatttttttcgaaggttcagtttttatggaagtcaaaatatttttttatatttaccatattgactttcaacgacattggcaaaaaactgatgcttcaaaactgcaggaagaatattttttttaaaatataaatcccagccctacttagtccattttgtattatgcatggattttttaaaaattaaatttaataaaatattttttgcatattttgttattatgattttgctcgtctgtttgcccaacaattttataataattaacccaaaagaaatttatttttcttcaataaaatttctttattaaatcaacaaattctgatcacttttaacatcaaaaaatacactaatcatttctcttagttttttcttaactgatctgtctattttttctctaattttttttacttattttttctgtccgtctttttcccccgtcgttgtccatctccagctgctgctgctgctgctcgaaactgttgaagttcatggctaggtgttgagaagctgcttttccttgcttcttcttttccagcattaatatattctgaattaattatgaaacaatttaaaattaacaaaaagtaagtatattgtttaaatgcagcattaccacgcatggttgggccttgcccaactgaaacaagtcttggctccaatttttccaccttcctcgcagcttttcgaccagatttactacctgacgacgagcctgacataacagacaaaatatttttcatgtaaataaaacaaatgcatgccaaaaaaattttaaaatattatcaaaacaaataataatagtaattttcatacgaatttgattggcttattgtcgttaatttgatctgtttaagcattttgttgttttttcaagtgagcatttttagcgttacacgaaaacccccaaaagatatcttttcagcatttgagaaaaaaaccgtaaaaaggaggttcgaaaatatgaaaaatacgaatatttaaaataagttagaattatcattaaatagttgaattcgattaaaaatttctaattcattgttgtccatagaaatctcccgaatttttggtcaaattagtgtatattttaccatgcatagttggagttggcaggtcaataattgaaacaagtcttcgtccattacttggattattaatgccagatccgtcgtccgcttttgagcatgacatacaaccacctgccaacactttttgatcatcgcggaagcagaagcagaacacaaaagtgatcaaaattacaatgatgtagcaatgcgtcatcggttcgcttgtgatcagcagagaaaacaaattaaaat

SEQ ID NO: 31410 - DNA, 984 bp, Heterodera glycines
tcaaaacatttaattgaatttcaaaaaagttagggtcaaaattgttgagtctaaattttttgagctttttttagttacatctttttataatttttttgctctatttttaaaaaattataatatattggaggtttcgtagagatacctttcaagaacaagattgattaattttatttagtttaagctaagttatgattaattatttagcaaataaaattaaaataataattaaatttaattattacgaacattgatacttttgtcacttcggctcacacgaggtcgcagcatttgcattttctaaaaatgttttcctcattttcaaaggttttttacattttaaataccaaaaaagtttttgaaaaatttgattttgttttaattttttttttctctatatttaaagtccgaaacgaaattccgttaattgaattcataaaatttgattttaaagcaattaaatggaaatatttgacgaatttattattgtttacgaacaagtgatcagtcaattaacagtaccacaaaacggtgacgactacaaattgtcatctgtaaattttgatttttttaatttaaaaatattttaaaagaatatttaaaaagcaaaaaaattttaatagcatataattaagccaacatacttttttctatataaattaatcacttacatattttagtgaatttacgataagcgattatctcgtattgaaaatcaaagacattggcaatgcttcttcttccaatccgtcgaatttggagccattggcacaaattgtccgttcgcattgggaccaaaatggggcacaacaaatcattagtgtaagtttaaagaaatgatcaattaaaaaatgaattaatcaattaaatcatttagacccatacactgaacaagggcagtgaagttaattacaacaacattgctaatgattcatcaattgttatccgaattcttaaaaagcgggagaaatagtccgaaatgtg

SEQ ID NO: 31411 - DNA, 1168 bp, Heterodera glycines
attagggtaggtcgggaccgggaattttgggcaaaaccgggaccgagacttttcgggttgaaaaaccgggactttttggctgggaaaaccgggaaaaaacccgggagtttcccggttccggtcaaaactggtcaaaaccgggacttcggtactcagttgtactcagttgtccgtgttcatgtcccggtcctgacctaccctagttttgatgaaaatttcttcagattaaaaaaaatatatttattttaatttttatattttttgttaaaattttcctggtttagaaaatattgacaattaaatatcttaatattttataaaaaatatggctaaaatataaatttagcacaagaattgttaattttcaatgtttgaaatattatttttaacttcatttataaatttttattttatttttttaattaccagtaattttccaggaatgcattgggtcggcaaggatttcagtaagccgctccggcaacacatagaagttaccttcctcatcctggtcaattgcaattttcatcagctcacctttaaaaaattgtaccattatttttgaaaatttgaccccaaaatggcaacaacaaaaaaaaatgtctgttctgcccttgaaaattgttcgctttatcatgtccttgaaaataggttaaggatgatgaatgagactccgacattgtaccaatttttcccattttaaacaaatgccaaccaaccctcaatgttttgttgccgtggccaacaatagccgacaataattgccatcgcaccgccgagcagcatcaacaggccgatcacggtcaacaaacggcacacatacaagcccatccgttgcgcgggtggtggtggcaacaaatacctgagaagagcgggggccgtagtcaaagaaggtggttatggttgaataaccactaccatcatggtttacccgtagcaaatgagcaaccacgacgggtgcatggttatctaacctggtcatttgaccatgatggttggtgggtggtttgtgaacgcacagtaaacatggttggtggttacctaaccatgtaaccatggtaaaacgccaaccctgccccgacccatggtagcagtcgtaaccaccaacttttaaaaatctgccaaaaatcagcaaaacaagataaaaaccacaaataaaatttataaa

SEQ ID NO: 31412 - DNA, 1420 bp, Heterodera glycines
agtgattgaatgctggagggttgagtcccactgattgaaatgctggagggttgagtcccgttgattggaatgttggtgggttgagtcccagtgattgaatgctggagggttgagtcccactgattgaaatgctggagggttgagtcccgttgattggaatgttggtgggttgagtcccagtgattgaatgctggagggttgagttccactgattgaaatgctggtggattgagtcccgttgattggaatgttggtggattgagtcccactgattgaaatgctggtggattgagtcccactgattgaaatgctggtggattgagtcccactgattgaaatgctggtggattgagtcctactgattgaaatgctggtggattgagtcccgttgattggaatgttggtggattgagtcccgttgattgaaatgctggtgggttgagtcccagtgattgaatgctggtgggttgagtcccactgattgaaatgctggtgggttgagtcccgttgattgaaatgttggtggattgagtcccagtgattgaaatgctggtgggttgagtcccagtgattgaatgctggtggattgagtcccgttgattgaaatgttggtgggttgagtcccagtgattgaatgttggagggttgagtcccactgattgaaatgctggtgggttgagtcccgttcattgaaatgttggtgggttgagtcccagtgattgaatgctggagggttgagttccactgattgaaatgctggtggattgagtcccgttgattgaaatgttggtgggttgagtcccagtgattgaaatgttggtggattgagtcccagagattgcaatgatgatgagatgagtcacagtaattgaaatgctggaggttttgagtcccggagattggaatgttgtatgcattgagtctatatagattgacatgttcgtagtcatgcgaccccagaagattgctaagatcagagcccgtgtttccgcgcttttatatgaagctcttgtagactttgtggaccattcgttgggtattgtactctgtttggacaatctcgtggtttagaacgaatacggggacttgggaccacttcgtgtgcttgggacaagaacggtgggcttggcacaattgcgtggacttggtacaattccgttggcttcgcacaatttcgtgagcttggacaatttcgtggcttggacaatttcgtggcttggacaattcgtgccttggacaatttgtgggtcagcggatttatttcgctgatattttatttatttattttccctttaatactattttctcttcctctctttccctctcaccataactttttggtttttttgggcccacaacctattgtcagacgcataactacttcccatttttagcttttttacttttccccaatgcccca

SEQ ID NO: 31413 - DNA, 1715 bp, Heterodera glycines
  misc_feature (45)..(45): n is a, c, g, or t
ttatcccctccgaataatgatttatcccttctaaacgcttcatanctgtccttcattgcgtcgcaatacgacccccttggccttatttccccactcattctcccattaaaaatttttctccaatcaatattccaaaatggcagcgattgggatcaaactctcccaaccgaaattcaaaacgactgggattgcgcaattaaaaattggaaaaatgcagaaaaggtgtccattccccgttgtcccgttacactcccattggagggaagaaattatcagttacattgttttactgattcctcatctctcgccatgtgtgccacagtgtatctccgaattacccatccctctttctctcaagcagaagtgtttttaattttttcaaaaaccaaatcctcgcattaaagccaccactgatcactcccgagaccgtgctcccaatacaatgattctcatttctctttttctgtgcttaactcaggtcgagttttccgatgcccacccaaagggaaagggtacaccaattcctttcccaatccgccgagttgggaaaccctttgctaaaactgccgtttcactccgctccactacggcaatttattttggattggactcattggcatcctttcttgaggatgagcccgaaatttccgccgtccttttaaccattttgggctgccttatcatccttgttttcatgttttttctcaaaattatttcactgtttttcccgacattgttccgtagacgcccactcattcatccctccagtccccaaaactcaactgagctcaccgaaaatcgctgcgctgtggatgaactcatcaatcgcactaatccttcccgtatttcccattaatttatcattttccacccctttagcaatggaaaaatcaaataaaatgacccctctcatctcccaaattatttcacatcttaaaattgtccctgaaaacccaccaaaccccccaaaatttgccgctgtccccattcccatcgatgccgattcggtttctctggcatctgatattccacacagtgaaatgccacccgcctccccgcatgacactcattcggccccacttgttttggacaacgacggcgagcagcaggatttcgaatcatcggacctggcaaaaatgccatcaccaccagcaatcaccgttgatgggtctcagcaacccattcaggtcatgattggaaatcggggaaagataggagggggggcgaccaaaacactccacgttcgaagggacgtcttttttgggcgtactgagcggcacgccgaacatccgcaacagtggcggccgccgaaaaaacgtgtgttcttccgccgaacttctgccggccccacacgcacttccagtggccacagttgtcgtatgcctcgcttcaatccgatgggcccaagaccgtttaaccccgaacgtgtgcaatttctcccgaacttttgtcaaatgtcgatgccaaaaccgattcctctcaatcaaatcaatttccacacggcccaccctcgctccctcttttcccaatggcccccttcgcccatgtgctttttactgccccaggggtagtgtcgcgatttgcgaaataatttgtatttcctccctccgcccccttgacaaaataaaatcctttattttacaattatcccccctcctcttttcgcttcattacaccacttccgttgccgacggccgactggccataaaagactt

SEQ ID NO: 31414 - DNA, 1139 bp, Heterodera glycines
ttacaccctcccccccccccttctccccattacccccgcccgcccccctcgttggaaatttcgctagggaaatttgttcaaattttacaattttcccctttcgttataacccccccccccccctccctagacgaacgaggtaggggtaggaggtatcccaggcctcttaagacgagggggcgggaggtgtttcgatatatcccttacaatgtatgtttctcgagtctataaaatctttaattttttctcgagccaagaaacgtttctcccattctcggaaaggagtcaagcacattattaatatataaacttattaatgcataattataaaataaataaataaaataatagtacactttacttgctccaaatgctgaaatagacggcttgcccatcctcgccaaccaaactgccgcgcaatgccatcgtcgaactttgattcttttggaacaacgcgtactcattgtcaatgtgtttggcacgaatagcatctgcatcggcggtttttgagatgtcgaagtcgcgtaagctgtcgcttacattcttcaaataaaaatataaaaaaataaatttatttgtgtaaaataagaaaatttcgaagccaacatcaaattgtgcagcaaaaatgaccaattttgtgagtcaaattttgaaaattgttaagaatttggtggtccggcagtgcgctaaaaagctagaaatttctggaaaataaaatgaaatttgtctaaaaatggataaaatcccaaaaaattttatgactcaaaaatattacaaaaaatgattttgcatttgaagaaataaaattaccgaatattttcactatctgtataatctatttaaattcaattaattttatattaataaaaatttaatttattttttctattttttactttgttgtaggcaacaaaaccgggcatgtacttgagatgcagctctttgccgctatttttgagcatgatcatcagggaaaagaggcagaatcctgaacattttaattatttttaggttttttagggccatttttgtaatttaaatatgccaatgggttcagaaattgctgaaattttgtaggaaaaggaaaccttagaaaattgttttagtgacttggccttaatttatgatctttaaagcct

SEQ ID NO: 31415 - DNA, 1726 bp, Heterodera glycines
attggtatgtgatcggataacatgaaaaaataactgagtttcattgatcggtcccacggtgaggggcggggcgtgtcctgagcagggaccttgatcacaatttgatttgtatctgcttggccagatcattggcataattgtgacggagaccagaggtctaatcacagtttgaggagacccaaaacataaatcttggttggaatgtcttgccaatttgtgtgttcagttccgttcggtgacgtgtcgaagtgccaaggagggcgaggagggcaaaatgttgccggccgaagcatgcaccggccaaatgccacctgaggagcgcgattgcaacttgggcccatgcaaaggcctccgttttcacaccaccgaatgggaattggtcagtttgtgtttattcgtatcagggattatagcctgatcaattgattatcaataatgattgtttaatttaaatccccggggattatagcctgataaattaattgattaaaaataattattgattaatttaaatccccccgacggattaaagcctgatcaattgattgatcaaagataatgatcgattaatttaaacccccgaatttttggcatagtgccaaaagtgcaacgacacggaggaaacacgagaagtgagctgtgtagacaaaaatggaagagagtatccgctggagaagtgcttggatgggaagaaggtcaccaaaattccggaggacacgaggccatgcgcaagccaagcggtcagtcacaaattttcccaattctgaccaattaaaaaataattctgatcagttcttaaaagcattttcaaacaaaagtattcaaatttgaaaatttttttgttttattgttggcattctgtttagccttgcgtttatgaatggcacacatcgcaatggtcaaagtgcagcacggaatgtggacatgggcacaaacaacgaaaggtccaaccaaccacagacatggctaattgaaaacattcgaaaatttattttgctatttcgaaataaatttactgtgaaaaagaaggtaccttgttttaaaattgtggtttggttctcgagtgctgggaatttttctatctcgggcagtgttttttgagattcccttgactataaaaatttttcaatatttttagttttttctttggggagggggtggcacaacattaagggattgggacggtgccgggatcgttactcaaaaaccatcaaaaaattacaacattttttttggaaggcagcacaaatttagggagggcggggtgcagggacactgttgtaagcgatacagtaaccttggtaaaatccattttcgaaacgattatggtaccaaacgccccccgcatttggcttccttcacaggtgttctgtgccatcaacgagctgggccaaaccaagcgtgtggatgaagcgctgtgtggccaaagcctggaggaaaagccggtggctcgggaggagtgcgtcaacgaggagaaatgcactgtaaacatgtataagtaccttaacacataataacatccaataatattgcataaattgactaattaaacaagtaattaattaattgaatataaatgtgtaaaaaaataataataattaataataataaatctatttaaaaattagcttaaaattctcatttctgaatcgcaccgctctactctggttaaaaaatactacaattaccaaatgaaaaatattaattataaaacaaaacttgtccc

SEQ ID NO: 31416 - DNA, 1217 bp, Heterodera glycines
acgctttttcaatcaatcaatcaaagttcattaaatcaattaattaatcaatcaattaattaattgtttgatcaataaataaataggtaattaataattgccgatttcattagaggaaaattacaattgctgaacattacaaaattttcagacgaaaaaattacattttagtataaaagcaaccaaattctttcgttgtcttcactcttattcagttcatttcatttcacttcccacctttgttcggcaacgaccaagcagtcgaaacaaccgacgcagaagtaagcgcaacggcaccagtcaaacgacacagtgacaacaccattcattccttcattatttatcatcatcagcagcaacaacagcagcgacgcatgggccaaatgtgggaaagcgagcttaatttaaaaaaatgatgatgctaattgattccttttttccagcaatgtatgcgacgacgtttggttggacacattggcatggatcaatcgtgtagaagtcggcatgaagttcgcgctggtcaatgttcggttaaacgctttggcggacaaacatttcaagcagaggaagtggtgcttcggcgagtttcatatctgtgagcggatgacggaagaatcgggcgcagaaatcatgacatcgatcgacggctccgacttcagcacgttgccactgcccaccactccgttgccggacagtgtcgtcggcttccgatcaatttccatttggtcgtcatttgctttccaaattcatttttctaactgccttctttctgcaggtacatcaatgaagaggtcgtcaattttctgcgcacaattcgccgtctcctcaccgaagacattgcgctggaattctccactttcttcacggaatatcgcagttggaaagtgatggcacaacacatttggccactgttgaaagatgggatcagcaccttgtgcctgaagaagtgtgacttggccatgctccgtaaacacgtgtcgcccaccgtgctgttcgactgtgccggcctgcaccgaatccacacgcaaatgctgcccgagtgtccgtctgctgacggtgctgtcgatgaagagaatgttgttgttgacacgacatgccgtgaattgtacacgtgggttcactcacctcgtgaagaagggcacggaccggtgtcactgaagctgaacaaatggaaggagggcaaatgggacaactttgtgaacaacttgaacaaggtg

SEQ ID NO: 31417 - DNA, 1102 bp, Heterodera glycines
  misc_feature (1025)..(1025): n is a, c, g, or t
  misc_feature (1076)..(1076): n is a, c, g, or t
aactttcaccatattaggcattaattaaaaggttcagatcttttaaaatgcacccatttctgttatagctcatagaattatggcaactgattaatgcacaattcagcagtgttgccaatgataaaagtgaaaatttagcaaatttacgagattctcagaatttataaattccagcccccgtaaaatgctcgtgtatataaatgcctttttaaaaatcattttgtaatgtactaagaatttcaaaaggtaaaccaaaagcgctcactttcgtaaattgctcgacaataataaaaacactcaaacaatgaaaagagtttgctaaactgctcgaagccctttataagacgatgaggggcgcttatatgttccgaaaatctgcctttaatccttacaaactttcaccatattgggtgggcattaattaaaaggttcagatcttttaaaattcacccattgctgttatagctcaaagaattatggcaactgattaatgcacaattcagcagtgttgccaatgataaaagtgaaaatttagcaaatttacgagattctcagaatttataaattccagcccccgcaaaatgctcgtgtatataaatgcctttttaaaaatcattttgtaatgtactaaagaatttcaaaaggtaaaccaaaagcgctcactttcgtgaattgctagacaataataaaaacactcaaacaatgaaaagagtttgctaaactgctcgaagcccttgataagatgatgaggggcgcttatatgttccgaaaatctgcctttaatccttacaaactttcaccatattaggcattaattaaaaggttcagatctatttaaaatgcacccattgctgttatagctcaaagaattatggcaactgattaatgcacaattcagcagtgttgccaatgataaaagtgaaaatttagcaaatttacgagattctcagaatttataaattccagcccccgctaaatgctcgtgtatataaatgcctttttaaaatcattttgtaatgtactanagaatttcaaaaggtaaaccaaaagcgctcactttcgtgaattgctagacnataataaaaacactcaaacaataaaa

SEQ ID NO: 31418 - DNA, 1472 bp, Heterodera glycines
ggaagaagcggaccgaagtccaatttaacttggtttcttttcatttgtttaccaatgagaggaagccagcaactgcgaatgtcactagcaaaagaggaaaaagatgcattttattgggcagtgaaagtcgattggagaaaaacgggtccgtttgtctataaatgattggcggttcaaataaacgaacaattttttgtaataataggccgaccaaaatgaagagaagttggggaagtgaaaagtgactgatggatggggaacgaagggaaagtgaaaattgtgacggactaaccgacggatgattaatagtttgatgtggttgctcatttaagaaaaaggagtacgtctgggacagggaatatcccaggattcgcttgggtggggaagatggtacacggccggaaattcgatgtctgcttgactaatagttaatgcatttttttaaagatcaaaatcaaacttaggggaggagttcggctgtacgtcatactccgtttaccctctccctggatttgatgacaccctccccccccccccccctcactaccgctaaaacatttgtttagcccatcgccgaattcggtccggtggcgatcagacaaccgccggaagtgattgagggtatgaccgactggtgcaaggagaccttttcgaagaacggactgattgaacggatcaaagccagcgacaaaggcgaacgcgagactgaaaaaatggtgaccgatcgaggaggggaggggacgctcaagcaaaaccaatgcattgatcgattaaggtcttggactttctgcgtgagcatacgccccccggggagtgtctgttggctggcagcagtgtgcaccaggaccaggtgttcttgcgcaagtacatgcccgagttgtgcacccatctgcacccgtatcgcatcatcgacgtgaccacagtgaaagaggtgccgaggaagaccagggattcttcacttcaaaatcaatgtgaatttctcacagttggccaagcgttggtatgagcacaccgagggatggaagaagttgccgccgaagaaagagatccatttggcactggacgacattcgcgagagcatcaacattttgaagtattgccgtgagcactttttcgccaaatgagcagccaatcaacggacacatttctacgtattgttttattttggcaaaattttgtttgttttatttattattgtatctgttttcattaacattccaatcaaaaaatccgtctgtttgtccatcatttcttttgtatgcttcttcgccttattcgtttctgattttgccatttgtcactgttgcttcatctccatgccaatttcctactctcccccagtcgctgtccgtcctcagccgttgcaaccgtcggcctaacattttgcattggcttcttcccgtttcatttcgctgctccgtatcgggcacgtcatttttcagcattcgcttcagctgaggcaccgcttaact

SEQ ID NO: 31419 - DNA, 1096 bp, Heterodera glycines
  misc_feature (1038)..(1038): n is a, c, g, or t
aaaagaaattgggtgaaatggggaatttaaaaatgaaatttctttcgattaggattttgaattttttttctaggcgacttatcaagtcccaatttttcaaaaaaaatttttttctgaaaatattatagttttcaagtccttctggtttgtaattaaatcacaaaacacatttgtttttctcttattgttcgcccattagcgaaagtaatgccattttcctctgttcgtttcggcacttttgccataattggattttttgcatttccgcttttgcccgacattttgcacccactctcaactaatgacattcacacgccttcctttttacttctccccaaacacctcttcccatgctttgtctgctaattttataatgaatttttgcgggcggcttttggcattactttttgtatgatggaaaaattggcatatttacttgtcaaagcctatgccaaaatctaatagtggggcaattaacgcttttccaataaaaaattcccatgatttatcgaaaattagtagccaccaaaatgcgaaactttactactcgagcagcaactcgggaacacatccaaggctttccaaaatgcgagagtttaaactagagtcgaaatgcgagattaagaccgaattcctcccccaacaaattcggtattaactcgagtcaaatcccgagattgagactaaccccccccccccccccacacctccgaactgctggaatttatccgagtcaaaactcgagactcaaaacattgagcagaaataccccaaaaatgctaaatattgaaagcgagattcgagtccagaaaatttgaaaagttttttggaaaagagtttcgggattcaaaaagctgcacacaaatgcttcgcaattgttccctttaatgagcatgttacgtttaatttcactattattgctcaaaaaatcgggtcgcatttgaaatttaaaaataattttttgattgtggagtaatgcgatgccggattttcttgcaccgcttttgacacctaaaataatggcttattcaccgagtngcatccttccactacacatgtttttgccgatggcaaatacagacgacacgacaccttt

SEQ ID NO: 31420 - DNA, 1656 bp, Heterodera glycines
aagacaaacagaagttataaaatccaaaaataattccatttaataaatcctttttcttaaatggttccatatttccttgaatgaatctttccattattttcttgcgcttccaatggtttgtctttctttcccaaaaaatgtcccccaaatcccccccccggcaatgtctctttatgaaatgccgacccgatttgtgccatcccccccctttcctttccctttcattttccctttttctcccaattatttccgtccatcggatgagcccattctgcgcacaccttgcagctggcgaacgcaagaaatgacaacaattattcttttcttttgtgtgtcgccactcgtaattaaaggccaaaatagccattaacgaaaaatcaacaaaatcagaacaaaaccccaaagtaaaaagcatcttttggggacgaaatgtacgtcgtttaattttcgcaaaatttcccgaatttctctcccccccccccctccctttgtaattttccccttgttgctttaggccataaatttgttttgtccggaagaaagggaagaggaagaaagaataatgggaaaaggaccgagaaaggggggggatacggtaacacttttggccattggggaaaggcaacaatggcattggcattgccacttgtggccatttgaaatggttgtgaaattttggaatcagtgccaattgctctgtttggcgttggcatttcacccggtcacaaccgaccgtttctggtgcagctcgcatcgtatgtcccgtgccgcccgcctcttgcgagccgtcgtcgccggtgagcagtgccgcctcgtcctccgtgccgtcccctgcggtgccgtcctcctcctcttcctcctcttctctgtttctgctgcttttgctgttgttacttttaccacgtttgtcatttccaatgttcccacttgcctccaccacaacaacaagcgattgcttctgaaaaagtgacaaatcaaagctaatttaattgaatgcttccctcttcgagcaaaaaagtaaattttaaatttcaaaatctcactaattacccctcaattgccccaatgtccccccccctccgtcccatgtcaattctcgtctgatatttttgttcgtatccaataattttgatctgccatacttccgcctgtgctgtgccgagttcggcatgcgttttgtgccgttggaagtgttgtggccccgctgccgatgttgctgttgccgcgtgctggtgctgctgctgtctcagcacatacgtcgcgtgttggcccaacgccgggggcgtatttccgtccgaattttgctgctgttgaatcggatggtaatgcttaagggagggagagcgcaagttgagttattgtttggcttcgatggattgtttttcagtgcctttcttttcccgctttttgccacctgctgaattccgttaatttggccggtccctccgaccaccactacgaagatgtcccttcccgcgttggacccgtcgctaactgtcgcgacggaccgctcccaacacggcggcggcggttgcggctccccagttaaaccgcagagcatttttaagtccagaaaggatgtggtgccaagcgagtggtaacccgtggcgatggaatgggggaaatgccatggaaatccggagaagtggcattttg

SEQ ID NO: 31421 - DNA, 1108 bp, Heterodera glycines
cttgtgacaaaagcgaaattctagggcactgaaaaaacccaaaaaaaaaaaacattttttttaatagtatgcccaagaagttagtgctgcgacgccgggcgccactttgttcggcagctggcatgtgctgttcggcaaccaggatcaggtggtcaacctgtggcgctaccaaaatgggtaccccgatttggacagatttgttgaggatttttcaatcggaggagcgccaatcttttttccctcatatttttagccacatccgggcgctcagctccaatacatcagtgaaaagtgccgagttagactaagctaggctgtgccgacgacgacgcacagtcatcaccaagccgttcaggtcggattgacgagagagtgacggattagacctttttttggttatttgtattaaagaaagagagtgagaaaaagaaaggagaggagagagcaagagagagatagaaagaaaacgagcgggaggagagagaaagaaagagagtgagaaaaagaaaggagaggagcgagatagagagagagaataagaatggaagaagaaaatggaaggcgcgatggaaagaagttattagagagtgaggacaacagaggaaaagcaagtgagagaaaaaatagagaaaaagtgaaactgagaaagggaaaagagagaaaataaaagaggagaagaagagagagagaaataaagagagagagagagagcgagagtgagaaaagacagcaaaaaatgaagaggaaggaagataaaagttaaagagagaagtaaagaaagagggaggcaggggttgggaggaagagagagagatgtgaagaaggatggagagaggggtggaggtggagagagaaagaagagacagagaaataaagaggacgagaagaagagagagaaaaatagaggaagaaagaaagtgagaaaagactgcgaaaattggagaggaaggaagataaagagagaagtaaagaaagagggagggaggggtgtgggaggaagaccggaaaaaaaagagggaaggagagagaggtggaggtgtagtgagaaataataaacaaaaataaaggcaaatactttaaaagggaaaggataaggagagaagaagag

SEQ ID NO: 31422 - DNA, 1160 bp, Heterodera glycines
gcccgagtgagtgggggcaaacaaataaagtgaaaatggaattttttaatttgaattgctaaataatgctcatttgtgtgaattatgcgtcctctttttcgcacagtctcgactcggccgactctgagcttcaacctcatggaaagaagcgagcaaagcattacgacgacttgcccgagcagtcgtacgggcccgggtcagctgactactcgcaaacgccggctgaactgcttgaaattgccgaaatggaccctgacgatttgtcattcaagtcagtggaataatgggatgaaattaaccaaaatttcatgaatcaaacaattaaatcagcattttactggttcaggccaaagcagacgggacagccgcagaaaagtgccaaagggaaagcgattggattcagaaagccgggcacaagccatgcaacgaaatcattcagaaaggcaaacaaaactgaattttgaccacaatttcaatggttaagattttgctgcggaataaaatttttgtggctaaatcgcgatggatatttcgttcgattgattttatataattaattggcttatatttgaatattttgttttaatttattagtacaaatttgacattgtttttttttttttttgaatttcgaatgctgaagtgtctcatcgtcaaaacaacgcattcagggctaaaggtgagataattttgaatcaattaaaatccttttcgactcatttagcgctttttccatgggactgcgcctgccgcccatttggcatatcgccccttctataataagcacaaaaaagtgacggacccggcgcgccaggacctggcctactttgagaaggaggccgacaagttggaattgagtgagtgacagtgtggatgacggagttccaattgcaagccgtactctcattttttgagttttgttacaatttatgaattaatttagtttttaagttgtttaattgccagtttttgtggaaattaacaaattacctggtttaatataacctacaaaattacttgtgattgatttgagcattttcacggttccctttcgtttgcatggaatttgaaatgtttatctgtttttgttggtcagatgactattacattgacgcgctgaaatcgctttgggaagagaaaatcgcagtgaacgcgaactg

SEQ ID NO: 31423 - DNA, 587 bp, Heterodera glycines
cgcatttaatgacaacatttacataagcgaatcgaattacaatgacaaataaggaaaatggaggagagaatgggagaaaatggcgaaggtacgttttttatttgacgttttttgacggaattttaaggaatcgctgttgttaaaagtgaaaaaataatataaaaatttaaaaaaatcaactcctccattagcccaaattttagtttcgcaaaaacggttttcgtccgccctgacccaatccgtgccattatttccattcctttttccctctaaaattcttttttgaacagcgatttacagtgggttaattccatcgcatgaactgctcgtgacaagaatggaggctaacctaagggtttagattgagtgtaaaacttgaggaagagatgctcgaattttttaatgaggccaaaacgatgggtttttcgtttttgaggaaacgtcggcacatctttgactccccgaaacgaaacttgtcctaattgattgagcgattactcacatcccatctacttttttttctgttgaaagggtcttctagaattttcaaattccacccccactccctcacaaaatgccatacccat

SEQ ID NO: 31424 - DNA, 1533 bp, Heterodera glycines
aaaattttaccaatgagtatatgtttcaacagataggccagcttggtcaatcgcaaaccttgaaaacatttgtttttttggtataaaatatcaaaaaatttatcaatttaaaatttttggttagataaaaacggcaaccgaaaacgacacacaagagctgcacagatcgcagtgttcttgtgatacgcctcaaagatggatggacctttgaacatttctccatgttgacttaaaatgcttgttgtttgcccttaagcaaggctgaaatatttttttaaattaaggttttcaaataaaaatgtgtgaatttgaggaaaataataataataaaagggataattggtttaaaattgtaattaactcatgtaatttcaaattgtaatcatataattaattagaggtacctgtaattaattaaaggtatatgatttcttattatgatggttttttaagtatcgcccaaattttattatgatggttttttaagtatcgcccattatgatggtttttaagtatcgacatagcacctttgtaactgcagcttttaagtcaagggtatcaaagtttggggaattttattagggaattaaaagacaattcataaaacataaataataaaatcatcataaaacaaaaacataaaatattacattggagcaaatctattatattatttgggtatgtcattccgaaaatttttgcgttttttgaacggaaaataggaatatttatcagcatgaaagtttttttttagtttattaaacaaaaaaggtgagagagagataactgaaaggataaggatagatgagaaaatggggtgctatgtcattataaaaaagccatcaaaaagggcgttataaaaaaaaccatcaaatgaaaatttcgaacaaaaaactatctgtaacttttgtcaaagtctaccaaattagacattcttgatataattcgatagccctaaaatttctctattagttcacctaaatttcaaaaaatttggccaagattgagcaccataagtacacatgtggccaggttttcgaatatttttggccataacttttttgaaacccaatgaaattttttgaaattttgcaggctaatagaggacacctaaggctatcgaatgatatcaagatcactttattttttcgttctaagaatgttttgatcagaattcttgatgatcaaaataattttatatttaattaaaaaatttctgttaggcgagaacaaatagaatgagagagacagagagaaagagagagagggaaataaagaaaggagagagagagaggggtgtggagagaagggagagaggggtgagaaagaaagaaggaactttgaagagaaagagaaggagagacagagagcgatagatagagggagacagagagggagacagagagagagggaaagagaaaggagagagagagaggggattggagcgagagggagagagggaagagaaagaaagacagagatagatagaaagagggagacagagaaagtgagagatagaggggggagagggat

SEQ ID NO: 31425 - DNA, 1990 bp, Heterodera glycines
  misc_feature (17)..(17): n is a, c, g, or t
tgagtcaacagtaaatncggaaagcataatttctttcgctttctcaaaagatttctgttgctcaactttccattcccatttggcctccttcttaagcaattcatccagcgggcctctgagctctcgcatcggtttgatgaatttgccgtaataagtgagtgcgccgagtaatgatcggagcgttgatttgtcggtcggagccggcattttctcaatggcttctgcccttgatgggtcaggtcgaatgccattttcagagataatgtggcccaggaaaagcgtttccttttgcaggaaactgcatttttccaattgaattcgaaggccatattcactgattttgtcgaaaaccgcgaaaattgttgaggtgtgatcgatcagtgatttattggcgatcacaaaatcatccaaatagacgaatgcgcctggaattccggctatgattttgtccatcaatccttgaaaaatcgcgggcgccgatttgactccaaacggcaaacgctggcactgaaataggccacggtgcgtgttcagtacgcaaagatttttcgatgattccgacagttccaactgtagataggcatcacgcaggtcaagccgtgagaaaaatttagctccggcgactgcgttgtagatgttctctggtcttggcagtgggtggcgatgcagttcgatggcatcgtttaggccggtcgaaaaatcgatgcagacgcgcgtttttccgctctttttcttcactgccaaaatcggagccgcccactggctgaactcgattggtttaattgcgccaatttttgaaagacgatcaatttcggcattgacttcatccaatgctccatgaggaacaggccgagccttgcagtagaccggcttcgcctcctttttcaggatcagatgagctctgaatttggtgcaatggccaagttcaggtccaaaagtgttggcgtaattggtttgaagtgccgaaatgagtgacttttcatcactgatttgtgatgaaattggcttcgttggcattgaattgacgatttgtgacgaatttggaaacatcaattccttcgggatgatttccaattcttcaatccaaggcatgccaagcaaatcctggtgaatttcgtcgctgacgtaagcaattaggcttgccgttcgtcctttgtacgaaacttggcatttgaatttgccttcgattgggaatgctttttcattgcaattcctgacggtgatggccgttttgcctagctttggtttgccaagcttttgccatgagtctgttttgatcaccgtgatttgggcagcggtgtcgacattcattgggtgatccatcccattgatttggatgatcacttcccaccatttgttgctgcttccttcaatagccatacattttggcttaattgagacggtgtgaatgtgcgtgtccttcacagaatcagtaaccactgcacgaacacgtcggatctctgtgccgcttttgcatgctttcgcaatgtgaccgttccgtccgcatttttcacacgtcgagtttttgaaccagcagtctttttgccagtgacttttgcctccacatgaatagcagggctgatcacgttggtccacttttcctttaggtgccgttgaatttttcggcaggaaattttggcctttgtggctttgctgcggcttcgttttgggcttctgcttgtccctgatttgctgcggtttggctcggatggcactggtgctgcagggatttgagccgagggagagcgcgctttcctttaggatttgatattttcggcactcctctccaagctcttgcagtgaggttgaccgtccgctcgttcgactttcttccaagcgctgaaggcatttttgcctcagatcggtgaattcgtcccgcaatgcaatgatcagtatcatgcatttgagctcctctttgctcagcgacagatcggcattttcgcaggacgagttgatcaatgcgatcaaactttgcacgtcctgatgcgcg

SEQ ID NO: 31426 - DNA, 1599 bp, Heterodera glycines
ttaatagtaatttttacataaaaaatatttttcttattcaaaaattagaaaatttattaaaaatccataaaattttccgagccacaaaattcctataagatttcaaaatttaacctaaaaattgccccttttcaatgaaatctaatatcaaaattcaaaaatctatggtttcttcagactaagcccagcggaccccaaaaacttatattttttcaagaaaaaatggccttttttgtgtaaaatctattgcttaaccgcataaaaaaatccaattttttaccggcagggcccccggtgaattttcttaaaaataaaaatttgaacacttttagctaagatctgttaacaaatcacactcaaaatctatatgtgatgtaattgattgttttcagcgatttagttggtttcatttttgagctgaattaagcctcatgggccttagtttctccgggaaactttgaaaacccaacaaaactcagccgaaaagacagatttctgtccgcaaaacaaacagaatgtgaaataatatttgttttttatttagttagtatatcagtttcttttagctagttgttgaaatttgctcacatttcattgtcttcttttaatttccatcattctcattcgccgatccttttgatctttaatttttatttgttactatttttgcatgtttttggttataattaaaattttgtattactgtattcacattaatttctataaatttttaaatataattcattattaataatatcaatcttttttcattattttacttcaaaaatatagtttttttttatttggttttgttaaaagtttttttcataaaaaacaaacaattctcaatcttaatataatgaatgtgaaatccaaaataaatattaattattagatttcaacaaatttttaatataatataaaagtaaaacgatattggaaaatataaattattttgcaaacttataacaatttaactgattattaaatctcttaaatgaattttaaaattattatctttataaatgttcggtgtttttgcaatttatctaatttagagctgctttcatttggttaattaactaattaatttaaaattagtccaattatttttgaatattacacattcttcgctatttaattgcttttgttttcattttctcttaaaaaacacttttagtaaatatttttaatttttttcttttaaatctcattttattttaaaatttattttaagtatttttaaaacatttaattttttaattttttctattttaggttataaatttcttttagtaacttcttattaaaaacatttaagctcacttttttaatcaatttaatatgattatttgtacattctacaaatattcacattttctatagtatttctttaaattttcttgattgaaggcggagcatgttgttaattgttgtgcgtatgcatgttaattaatttgaattttcttttcttttacttaaaaaaattaaagtataaataattgtaaataattattatcttttaacacttttctcttttaatctcatgattcaattgattgtttcttcatcaataaattcttcttcaaatgagagaat

SEQ ID NO: 31427 - DNA, 1008 bp, Heterodera glycines
  misc_feature (997)..(997): n is a, c, g, or t
cccccccccccccgaggggagtaaattacgctacgcttagggggaggcaaagaatttgtgtgacagcagctgtaaaatttggtggtgggggatggtaacatcggcgaacaggaaatgtgtttgctgggttggagacacacacaacaacacaacacagcccatatttgacggaatacgaaattgggctgacggggacggtcaccaccagcgattgtggtttcatgacgggacaaacatatcgccaaattgggggtggcaccgccaaatttttggaggtattggtgaaaaattaaataatctaacaattgtaaaaaggacaaaacggtgatgggtagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttcttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatattntcgcgtttttt

SEQ ID NO: 31428 - DNA, 1431 bp, Heterodera glycines
gctgagcgtgttgcgccgctgactttctgtacagctcggcgagctctatctcgtcaatttattaaatatctgaaattttcagaaattttcgagctaggccccctcatcacttttgaggtttttgaattttagtattttttacagatttttccggtgaaaacggagaccactttcaagcaaccgtttttgatgctctatcgattggtgtcattttcagaaaaattttttaaaatttttttggaaatagaaaattttggttgctaggcctcaatttcagttctggctcaataactcgtcaggagttgattttatcaaaaaatcgtctaagagcttttttgtagagaattttaagcccaatctaatgtgctttatctcatgtttttatcacgagtttaaaaaaagttataaaattaattgtgattttgaaactcaaaaccaaaggggggaccccatggttttgcatttcatgaaaaatttttttgctcctaaattagccaaaatgcatttttatggcctaatttaaggtgctgaactcgaaaatatactttatttttagtttcagactttttggtaagtgtttaaaattttttgaaaaatcgtcaaaatttgagccccggaaaatccagtgaaattttgaaaattcataactctcttcgtttttggtcaaatttagtggaataaagtttgaaaattagcaaaaaattaggagaattttatgagatttatttggaatttctatcttccaaaataaaaaagttattccagaatttctggaaaaattcgatttttcagaaaaaaattcctaactcccttctgaaaaagtattttataaaaataatatactcaaaaaatcagcaattttttgctctattttataaattttattttagctttttatcacttttttgaaaaaagttatagaaataaaagtgattttggaatttgggaccacaggggtgtgaccatgatttttgagaggaaaattttttcaccaaaaatcttccaaaaacatgtctttaggggttatttgggccgctgatcacgaatacgtgatcagattttacttttgacatagttaagacctcagaatccctgtgtgattggggattctgaggagtggggcggcatgttcggacccaggccgtgtttattattttttaatttattaaaaaacgggcgcgaagcgcccgtcctgaggccgcgaagcggccgaatgtccccaaaaaaattaaaagacgggcgcgaagcgcccgtcctgaggccgcgaagcggccgaatttccccaaaaaaaattaaaaatggcgcgaagcgcccatactgaggccgcgcagcggccgaatgttcccaacaaaattaataaacgggcgcgaagcgcccgtcctgaggtcgcgaagcggccgaatgtccccataaaaatcaaaatacgggcgc

SEQ ID NO: 31429 - DNA, 1804 bp, Heterodera glycines
tgagtatttaaatttgtctgaatgtttttctaaaactatttttcgtaatatattttcacatttttagttcgattcgatttttaaaatatttttaatgcaaaaaatttgtcacatttcttcctttaggcgtttagtgaatttctttggtgacgtgactgtgtgagaagaagaaactcgatcatccgaaagtatgttcctgggcattaatgacgtctggcgttctgtctgattaattagatgcttgacaaaaatgactgaaaacttgatgaaaaaaacatcaatcacttgaaataataaattgtaaaattttttgtccaggaaagccaggttttttcgtgtttagcctcaacctgggcctggattttttcatatttgacctggacctggattttctggacaaaaactacggcctggaccaaggtccaggccgatttcttatttgtttctaattttcctataattaatcgaggtttaccatgtaaaaaaaaggagaatgaagaagaatgaatcgaagagatgagaatgaagaaggaataaacaaaaatcaattacctagattaattactcaaaatgcgtacctccccactctgggggcgaaacgaaaaaaagtttcaattattgataaataatttaatttaattattcgagtcactaaagcattacataaccaattatttattcaactttgtcatttaaactgcataattttttgtcaatccaaattttactaattatatgatatggtggctccaaagattaaaattgattttatcaaactgtgagaccatacatatatacatgctttagtgactcgaataattaaaattaaattattatcaatcattgagacttttttcggttcgacctagcaccctttttttgacagggcggcccgggcccggtcagcgatttaggacttgagttataactagggttataaattgtatgattttgcatatatttttttgttcatatgctatgaagaaatgggctcaaaaatacaatttccatgttttaattttttggcttggtgaaggtttttcggcatataaatgcatatttgggggttttcgagaataagtgcatatttggccatttttgcgtttttagtccatattttggccattttttggaaattttcataagaaaaatgcaaaaaaagcgaaaaatacacccctaaggatcaattttttttaaattaaaaaaatacaaccctaggggaaccgcccactttggcgcgggtattttggcgccctatataaatctatgctatttggttaaaattgcagttattcgtccattttctaaatttaataatttaagtccaaaataatcggaaataaattgaagaacgaaaaggtcctttataccggtgggggccgattgccctccccctctcgccgaactttactaaccacgccgaagaaggcaaccctccggaaattttctgcttcacgcagcaatgctttcaggtccgtctcctccgacaatgcgcacatcggagacaaaaatattcgaaaattttataagaaaacaatttgatcactgaatacagtggtcagtgcaaaaggctgactgttcgataatttatagttttaattttaagtgtcgaggatacggtagaaagtgcaaatattcatttggctttttaagagcggaattttttttaaataacggtttttgaattgagcggagagtgaaatgcacgggtggcaaatgaggcgaaaaatgaatgaatgagttgcggatgtaagccgaggcgagagggggagagagatccacacaaagattggggaaaaaggaa

SEQ ID NO: 31430 - DNA, 1284 bp, Heterodera glycines
agaaaagttttttatttgatgataaaaaaatgaattttatctaaagctaatgaatacaaatagttgtttaaatttgtttcttttttaagtgccattctgtccaacaaagtgatttgggtggtgtggctgaacgcatttgccgacattgtgactgctgttttcctgatcacctatttgccaacttatgtgtccaaagttcttggctacggcgtgcgcgaaacgggcatttggagtgcggtgccggcactgttacacatccccgtcaaaattggggccggttggatggcggacacattgacgtgaatagcaaaattaaaatttaaaaaaaccattatttaataagaaatccctcaccaagggtgaaaatttgttcataattattttttcgaggcgctaagcattcgttttcgaagccgagcagaggaggataggagaaattttacttaaaaaccgcattttaactaagtttttccggcttattttgtgacaaaaattttcctgacaaatcggtcaaaaaaatttcaatagggcgcctttctgcgccgacggggctccttcaaatttttgaaaaaaactagctaaaaacatgcacaaaaatgactgtttttacagggccgggtttaatgaaaaaaaattttgtttttatcattcttaaaattccatgttctttcagttgcatgaacgagttgaaccgaatgcgcgcgttcaattcggttgcgctggtcggctctggcgttttgttcgcattgaccggctttgtgccaaaagaaatgccatttttggctgttattctgatgacattgaattttgctgtcgtctcgacaaattgtggtggtttttataagtgtgccacattgatcagtcggttggtaaaaaaaaataaaaattatttatttgtgccgcccctaatattaagttttgtgataaatcttagataaattcgtgatcagcggtacctcgaatttttttaaatatatatatatatatatataaataatttatatttgatttaattttaatcatttgatggggcggagtcgttatttaaaaaagatcacaaagggcgttatttaaaaaaccatcattatgaaaatttttgtcgaaaaattatttataattttgctccaaagaagccaatttttaattcttgatatcattcgatagccctaagtgttctctatcagtctgcaaaatttcaaaaaatttcttaatcgaggaactcaaaaaaccgtggttttcgaacatttttggccataactttttttaaagttaatagattttttt

SEQ ID NO: 31431 - DNA, 1042 bp, Heterodera glycines
tttttgttcatcatttactatacaatagacataaaaacaaaataattttttggtttgatgaaaaaaataattttaataatataaattaaaattaaaggttatcatgaaataggtttggtggagaaatattcttttaggagttgttttcaaaaatttttaggtttttttttataggaaatagcattttgatcgttttcgcttgaaaaaaatttaaccaaaatgccggaagtaattattagggatgatatttttatgcaaaagcatattttttcctgagctccccgtggattttttatattcgagtcaggtactagattcatgagtcatgattagggttataaattatatggattaacatatttttctgcgcatatgctatgaagaaaggggctcaaaaatagcatttgccaattttgcgtttttagtccatattttggccatttttggcaaattttcataagaaaaatgcaaaaaagcgaaaaatacacccctaaagatcgacttttttggaaatttaaaaaaaaacacccctaaaaagagaattttttcgaaatttcggaaatttttttagttattttgtccacttccgaaaattttcgctgaaaacagaatgagattattacaaaaattttgggttgtatttgattcgcaattgtgaagctagaatttaataaaaatcggcattttttaaatgttaaatccattttttggcagtttttagtgtatttttaagtctgttttaacaaatattgaatataaatacattttcggaattttataggggttaaaagatatattttggcagtttttagtctatattttggtccatattttgccatttttgaggtttttagtccatatttcgggcttttttagtccatattttatgtccatatttggcgttttttagtccatataatttataaccctagtcatgactaacaatgaccaaatcagaaaatatttatttaaagatttatatttgcatcataattttcaaaataattgaattttttaaacgtgttttgtaaaagtttgattt

SEQ ID NO: 31432 - DNA, 1131 bp, Heterodera glycines
  misc_feature (1092)..(1092): n is a, c, g, or t
ttttttgaaaaatttccgacttccgatttccgacgtttttggggtcggaattccgatttccaacttccgaaaaatttttgggcctcggaattccgatttccgaaaaatttttgacccccagaattccgattccgaaaatttttggggcctcggaatgccatccctggagtaaaccgtcggaggtgtcgggagatttaaaaaagcttgttaattttaaaccggatttgtgtttcttgtgtgctgactaatttgaaggattttttttattactgggatcggaggcatttaagaaaaaaaattttgcctgggaatccgagcactttttttgttttgtgttttttttatcaattttttgcagttttgtaatctaaaaaagattttgaattttatttcattttttcggaaattcggttcaccagtaaggcacacaaattcgttaagaaactgtataaatttcaattatttcattttgctgtttttaaaaatttgcccgattttttcctttaaaatttgactttttaaaccatttttataatttgcatattttctactaattcatttttatttgtttatccggtaaatatttaattccccgcttccaccatcaaccagatatgcccaatcaacttccaccgtaccaacactggccgagtgtatggcttactgtatgcatgagcgcgaatttgaatgcaaagcatgggcttatgaaaaattatccaattaacaaaaattcattatcaaattacagtcagccatgtacttttatgaggagggcgaatgcatcacaaacgtggaatcggcaacaacggcgccaagcgattttcaggcatttcctgattttttaattatatttttttggaattattttaatttttaaatttctgaaatagtatgataaggatttaatttctgatccgtaagaaaattgaatttctacatgaaatattttgaacatcgattttaagaaaatttgaaaaatttcataaaatgcataaaacaaaagcgcatcccaaaaaatgttcgaataaatttaaaatgatcttttttgacaattgaaaattgttgccattcatgcgtgtcgaatttttttanatcaaattttattgttgcaaaaaaaatataacataaaat

SEQ ID NO: 31433 - DNA, 983 bp, Heterodera glycines
ttgaagaaataaaatatgccactttgagctcacttattgccctgtttttaccccatacaaagccttgcttcatctcatctcatctgctcccggtccactttgcattttccatcctctttctcgcacttttctacctgtatattcagattgagccaatggttccgtgacggctcagtgtcactgaacgtaactttttcccagctaaatttatcatcgtcgtcaagtcggatgcaatgaaactgcgcaacacccaaaagctcacatattttttaaaaactttaaaactaaattccaaaaatgacaaaataacaaatcaagaattgatatttaaacggcttaattttactgaagaaacttggggttgacccattttggggatttattattattattattattcaaaaaaaatctaccgcaccaaaataaatatttttgaaggctaaaattattagtttattattaaggatgcaaattatacgtaaagaaatttcacaaagtttgaaaaatgattattcaattcgtagttgtcagaatcgcggggggaagtttgggcaccaaattgttaaagtttactaaattttattagatttataaaattttacctacttaatttattttattttttgaaattcctccctatggtgcccaaatttctggtgccaaacttcatgtcaccgtcagcagaatgacttgaaatttggcaggcaaatagcttagtgtaaaggacaccactcttcaaatttcataaccttttcaaacttagtaaaatttatttacatagatttgcccaacattgttggtatcattcgatagcactttgtatcctctattagcctgaaaatttcgaaaatttttgttaaggttcaaaaaagttatggctaaaaatgactgaaaacctggtttctgatgtagttttgcccataagattgttcaaattttacgaaattttttgcaattttgcaggctaatagaagacacttaag

SEQ ID NO: 31434 - DNA, 1196 bp, Heterodera glycines
caaaacaaaaaagccagatgctgtatcattccccagcccaagccatgaaattcgccaaggtaaaatcctgagaccattcccgctgccatggttcgtttttttccgaatgtgtttactaccttaggcacttcgggtaacaaatagcccaagtccaacacgcgtttgcccacacgaattcggttgttttcctccgcatttgcggcgggcacagcaacggggacgccgacagcctttgccctctccgcgactcttcgctcttccgcctcttccaacgccttggcgccctcctcctcccggatcagtttcgttcagttcgctctccaactcggcctcgtccaccgactcaccgcccgccaatggcaaatgtttgaagccctcgcgcaacgcctcttccacgtcttggtagtcctgcatcgtctccaacacgccgtccattgtgaggtccacctgtgggaacacttgttgcattattcaaatgctgaccgatattactattagggatgcattttatcacccgaaaaatttggatttacagtgagcaatcaaaaaatctcaatagtatacaccatccgttagaattttgaaaccatttaaaaaagggcaaaaatttcattttgttgcccaacaattcgatcaaatgtctgactttgtccggtgtcagtccctgtctagccatggtctctcggaatgcgttagagccctgcttgtacacgtcgatgatttccttggtctgtttggaggccgccaactgctcgagcattgccaacagtctttggtattgcacgtctttgtcctggatgtccttgcgcactcgggcaaccttccgcataatgttcaacgccccctttttatcctttcgtccgagtgccacgcgcgcctcctctttcaaactgaaaaagaaaatggcaatcaaaatttgggtttataaaatgcaatagtaaaactattttggcataatgagaattagtttttaaattattaggttatacgaaacaacaaaagttgtacgcctgtgttactttagcaaaatgaaaaaacctttgctctcgtttttctgcattttttatgtccaagtccaggcgttgcattgtgcgcttcaggtcatggacatttgcgtcagtctctgtgaaacgggcgggtcccttcgatgattggtcctaaattacgtaaaattaattaaagtttgtgattcaatg

SEQ ID NO: 31435 - DNA, 961 bp, Heterodera glycines
tggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgaccacagtggcacctttacgaaacattcccaagttggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgcccatagtggcactttttacgaaacattcccaagttggcacttttacgaaacgaccacagtggcacttttacagaacattcccaagggggcacttttacaaaacgcccacagtggcactttttacaaaaaattcccaaggtgggcacttttacaaaac

SEQ ID NO: 31436 - DNA, 1131 bp, Heterodera glycines
  misc_feature (1102)..(1102): n is a, c, g, or t
tcgcccgacggagagaaaaaaattggccagtacactgtggacggatacatcgcagcgaccgacaccgtgattgaggtcaacggctgccactggcatgcacacgaccatccacgtcaccgttttcagccccaaacagtgatggcgaatgggaaaacggcgcagcggatacgggaggacgatgcgcgacggcttctgcaaaaaaaaaaaaaaaatttttgttgaaacttttgcctttccctttttcttttcgattctttttggtgtgccactatattttgcaaaaaattccggattaaatccctattcaaacattcctttccctctcctgtaaaattggcatcaaaattcgaaaatgatgtgccctcattttaaatttttttattgtattgctgtcgcatccctctattatttttttgtgatttgttttttttccctctcttttggtcttcaaaaaattatttgcactcattgcttttttcatgtgaaattttaacacccttgtaaagtcatcataattacagtatctgttgaattttctgtacaacaataaataaatgggtgggggttcgggaggcgttaaaaatatgaattttaaaagattccttaaaaacgttccataatttcctcccgttttcagtaccgctccaagatgatcaagtttgcccgctcgcgcatccacggctggggcctgttcgcgctggaaccgattgcgcaggacgaaatgatcgtggagtatgtgggcgacaaaatccggccagaggtggccaacgtgcgtgagttggcctacgagcggcagggcatcggctcctcctacctgttccgcattgacgaccacaatgtacgtctacttttgtgttgaatcggaacttacaaatttttgtcaaattttaaaaatttaattccaaatcaaatattttggaatttttcatgaaaaattaatttcttacgctttcgctttaatattacgatctttcaattcatttgcagtttgaagcttaagagtgttttaattctaatctattttcacattttttttcgcaggtaattgacgccaccaaaaagggcaatttcgcgcggttcatcaaccattcgtgtcagccgnaattgctacgcaaaggtcggaataaatgg

SEQ ID NO: 31437 - DNA, 1475 bp, Heterodera glycines
cgacaaaattttgtggaacatatggaacggcaggggcttcctagggagggaagtcgatggaaatgtctacatcccatactatatcccaaaatttaagtaaattgatgggtgtaataagttgatgtctgcaagcgtttctgccaatttttgtccagggacaagttggcccgatagcctttggtttaggcattggcaacacttaaaaactgggtcaggttaggtataaattacgagtccaagaggcccaaagagaaagataacgtatttgcccaccattatgattggggttcagagagagagggtttaaaatgtattaacgatttttttaaatttttccctacagaggcacctccccctccaaatcaatggatgctcccaagaacaataaactgttcaaactcatttgttttgtgcatatgtacctgcgttgaagacatgtgttcgccaacatttgaatcacgcgtggaaagcaacgcagacgatctcttacggccaacaatcggtgcggcaagcaccccaccgccgccggcatcgacagccgttgacacaacggtcacgtccttcttggccgaatcgatgagcagcgaccgtgaaaaagccttgaaaaggaatggttaatccccacaatttaagcattttttaagggggtcggacctcccctcgctcgcaaagggggctcgcagcgaaggggggccggtgtaatgtaagaggcagggggagcggattcgcagcgaggggggggggggggggaggggcaaattttgaaaattttcttaactgattcattaaaaaggccaaaaatcttccccggcggcgtgaatccattttggctgaaaatccgcttgattgacacattttgacactacaactggacagggagcacataccgtgaccggaacgacggtgcccccgctggtgttctttttggacttgttatgactgcttttgttgtgattgttgttgttgtagtggctgttttccttgtccttctggctgcatgcacgctttggcctcggctcgtacttggagtcccggtccgacccggcggaagactgagatgaagcacggccgctggcgccaccaaccacctttaccaaatgagctgactggcgcttgggcagtggagcacccgcacctgcagccggctgcacgttcaaatcgcgattgcggagcatcatcgtaattagtttcagtgtaaagaaatttcctgaaaaacattaaaattttggttctagtcgattttacgcgtcccatgacattttaccgtcacaaaaactgtttctcgaaccgtcaataaaaaaaagtctaagcctagattaaacctaaagattattgtcaggcatagtctaagccattgttcgagttgactatgtattagttttcatgaagccttaggtttaacaacaaaatttttagttaaaaaaatactaaataccggacaaaaaataggtttcctcttagttattaggacggct

SEQ ID NO: 31438 - DNA, 1200 bp, Heterodera glycines
gatgcaatgggaaaattttttcagcttttctcgaaaagttttttccccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgttatgggggcaaatgaaaacaaattttgtgttattcgaatgcgct

SEQ ID NO: 31439 - DNA, 1663 bp, Heterodera glycines
tacaagccttttacgaaaattttttttttcaagtttcctcccggcgtaaaaacaacatttttattcaaggttttcggctttgctgatcacgaatatgacattcattttgaccatttccgattctcagacacgaattcgaacaaaaagtcgatacctcaatttttcgcctaaatggtttaaatacacggaaacactctgaaaatcataaatacagcgtggtatcaacggcagtattaccaacaaaaaaaaacttgtaatggtacaattttaatttttgagacatattcgtcggtctccgattctaataatttcaatattttagtcgaaattgtatgtcaataaggtgaaaaactatgggggggggggcatttgatttgtaatttttttgagcatccaaagagtcccatcccccactttgggttttcaatggtacacctaaacaagaaatgtgccaaaattaatgtatcacaattttaaaaaaatttttatatccgccattttacccaccggaagttcacgagtttgagactcgggatcaaccaacggcacaattttcttcgttgacggtcgtgaggaccacacccaccattgtggcgtcagcgccaattgagtacagcagtgaagtgttgccgttattctgttcttcattccaatcactgatgtcagcaattctggttaaattggagggaaatggtgtgggctccgtttttatgctcttttttttgtcaatttaatacggaatttagggggtgggggggggatcgcgggataagataaggcatggacggtaaaaaagggaaaaaagtggcagaaaataaaatggcgtaataaacaaaagactctattccagtttacgcgtccaatcgatgtttacgcgtccaatgagtgaccaccctcaattttataggtcataactttttttttacttggttaatttcttggtatcattcgaaagcttaaagtttagggaatttataaatacaagaaaagaacaaatacttgtattaagaaaaaattgcaatgagaaaaccacgaaatgcatattttttcgcgtatatttcaagaataatttttttgtgtattgcctttatccgagaattttgcataaaaaatctttcctaagctaaactttcgaatgataccaagaatgcatggattgaccaggaaaaaagttatgaccaaaaaaagtgagggtggtcactcattggacgcctaaacactccttggtattatcaaaaaattaatagaaatcatcccattctatcaaatgtcatcgaaatatttctcaaaaaatgattttatactataactaaataagttttaacaataaatctcattcatcgcaaaattttagaaaaattgtaaaattttctagactctgccttcggcctgtcagaagaatccattaaaaattgactcaaaaaagcgacctttgttcttatttggacgtataaaatctgttaagaaattggtgaaaatttaaaaaaatttaccggcggcgtttatcggcactgccgaactcccctattccgaaaattatttcttgaatatgcgcagcgcaaacaaagtgctgtaaaaaaacgactgaatttatcaaaaaaaccgaaacaatcgaacgacttttataaaaaatcgaaaaaaaacgaatggcgaattggagaga

SEQ ID NO: 31440 - DNA, 1934 bp, Heterodera glycines
  misc_feature (69)..(69): n is a, c, g, or t
gatcaattatcggctctgtctcgagtccgggaatttcgacttaatttaagccactaatcccgattatcnccgcaactccgtttcagctaagtgcggacagtgctcattgttcccaagcgttgtgctaccatttggcgtaccggtctattgacggagtgtgcaacaatttggcacgaccgacgctcggcgcttctttccgggcatatatgaggtagattttgaaagctttggcaccaattgttgatcactctcgtcagtttggagagctaatattaaggactacgagccaaggatgtcggaataggaaaaactgatattccgatgatttaaactatttcggatcggcaatttgtttgttaaagcgttaaacaaatattattcaagcattgtcaaaaaaatactcatttgattagatatttgccagccgaatattcggacggattctcagagccggctggtaataaatgccattgtacagtccatctcccaaatttgacctgtcaggttcgggccgaagaccaacggcacgcgaggcttctcgtcttgtgctggccaaaggtgctccatcgatccatgatcagatcaactccatgtttatgcagttgggacagttcatggcacaagaaatggcaaaaacggcatgtatttcaaccagtttaaattgccaccttttacgcggcatttgtccgatcggttgcttcaattaaaaccaatccctggccgatcaaaatcattctaggacatctgctgtcagtccagttagcgcatccatttggctttattttttaatttattttttaataattcttaattagccagccaatttaggctcatcaacccgttgacccatgcttatcttgtgccccgttggtcggcaaatgtatgccagtgccaatttcggagcaggacaacaacccaatgttttcaatatcatattactgatcaagaaatgcagacaaattactttgttagattgatcgcaaaaaataaattgttaaaagatttcgccagaagggatgtctgaaggtgtccaggtcggcctccgtttgcggtacgggcgatcagggaaagccgcgcgaacaactcaacgagaacactgcctttgtggatggatcaacaatttacgggtcaaatgccaaggatttgtacgttttaaatttaaaatttaattatttatcgaaactgatctgctgaacaagtgtgctctgatcacaaagaaattggcgatgatcagaaagagttgagcctttttgctttgaatgccttctcgatgtcaccacacaatttcagtcggcgaatgtttggcacaaaaagggggcaaaatttcttggaccaaaaaacgccaagttaaaaggggccacttcaccgaatattctcctgcccaatatccatacggatcagaatcaatttgagcgattttcaaacgcaaataatcattgacttcaacctgaaattatcgaattttttggcacccgaattttataaaacttcagctttttgtttgttgttcaattcttctggacttggcaaagattgtgaaaaaatgtcggactcatttcccttggcaatgttctgttgacattttgaaaaaaggttataaaattcgcttttggcctgcgactcagtcatgttttcttccatttcggccaacaattcgcctccaattccgtcctaaaccaaatgtttttttgtaggtaattcactaatacaattgctttgacctgaaggttttgtaaattttcagcttcaaaagttagccaaagtttgtactggctatgtttttctatgtcgaaaaaagagagcttaaatcttgggtccagcatagtggaaagaactagctctttattttcatcccatccaactctttttaggtttccgtttgcatcaattttttcatccatccgtttttgaagcccttccataattgcttgctt

SEQ ID NO: 31441 - DNA, 1010 bp, Heterodera glycines
  misc_feature (16)..(16): n is a, c, g, or t
acaattgtcctctatncggcccccccaaagtcaaacgtttccttgccccgccggtgacaatggccaaaagcagcgccttaggcgatgccgttcttccgctgaacttggcttcaccatcgtcggcggcattgattcgcctcgggggcccatgggaatatttgtgaagaccattttcccgcatggaatcgcttcgaaaagcggactgttgcaaaagggtaaatccgttcaaactgcgggaagggggggggggagtcatcaaaaagatgtttttttccttcaacaggagacgaattgctaagtgtgggcgacgtttcgttggttgggatgactcacgctgaatcacttcaggcatttcggaaaatggccaaaggccgagaagtgatcatttgcattcggagggggcaaaaagaaaagtaaaaaaagaaaagggatggaaaaaaggagttaattaattaattaagcatggaaaaaagtgcggaaaggcatcagcaaaatgaaaagcggaaaagcgaaggaaaaacggcgggagaaaaagccgaagggacggaaatggcggacgacggcatttcaatgctttcccagctaaacaaggcgagttggcatttagtgaccaagcagtatttttaaaaagtataaatatttttttgttttttatccatcaaatccccgtcctcccccccccccccgccattaatcgcctttaatccctcaaatgatgggaaatggaatcattccgatgagagaatttgtaggcgaatgaatcattccaataaaagtgcatttggcagagatcgcatttattgtaattgtccttttatacatttttaaaatgcgaacaaaagttgggagttttatttattaaaaattttacaatttccaaattttctacatacatttatatattattttttacgcattttttatttttggtaaatgtctcccattttttcgtatatattttcattttttaaatattttaagggtttgagaatttattttcttatgataaa

SEQ ID NO: 31442 - DNA, 1485 bp, Heterodera glycines
agcaacagtttggcaacaaaactgaaacctacgacacatattttcctgaatttatttggcgtcagcgctttggtgatcttgaaaatgtgttttataatttttggtcgcaagctatttttctatgtttgccccatttaacatttctcatcctttcctcatattttcactcaattatcataaattagctttgcaattacacaatttaccaagcactgggtttttatttgtaaatgttaacgaatcattttgtccatcagaattggcgtggtgttttctcctcaaagtgttggcgcatccgcttgaaaaccgcatttttgtccaaatcgtctggtgcttcttttacgccttaaatgtgtttcatggggataaagtgcttctaatagcaaagctctaccggagaaataatggaacaattcccattcggtgtgccgtccgttgatgatccggtcgtactgctccaactcgtgttcctccattttgaccaagtgttcctcagcaaacccacttacacacaaaattgccgtgaagaaagaatattttgccaaattttacctgatcaaaatgtcgttctcgcgtatcccacgctttctgctctggtagagaagccgtgcacgcagcacatcgacaggcccttttttggtggcacaatcggtcgaagcggtgccattcccgacggaaaaacgtttaaaaagggccgataattgggagctggacgcacgtggacaaagcaatgagtgcattctcaaaattattcgaaaaatgcacaaattgtctttttttagtaatttgaaaaatacaagaatagacacaataaatttacaatttcattcatttatgagatttcaaacaaaaatggtaaaaaacaatatttaaaatccgaatcatccaatcacttagaatttatgggcaacatcatcatcacttgactattttttgacaaaaaaacaaaacaatttttgaggcacatttgggcataaggaaaatgtcacaatgtcaaaatgctttaaaattgatgcttgggctctacttttgtaggaaaattatacaaaatttcattattatttgggggtccaaaatgcactccccccccccatcaagatggtcatttatactgaaatggacaggtgccggctggggaggctgtgccgttgcgctggtggacaaaaacaaaagcgctcggttggaagcgaacggactgaatatgctgttttggagcgaaccgtgcgaaggcatcgaagtttttccattcagtggatgaggcgaatgaaatttaattgaacaaacagaaaacgacagaaatgtttctaatagctgtttgactcaatttttatatttattgccgtaaatttaacataccgtttcaagaagaagagaaatgaacagataaatagaaaatgcaaatagaatgaactcattttagcgtatgttattcacagaggaaagaaaaaacatttaaatgtaacaaataagcacatccatcacatg

SEQ ID NO: 31443 - DNA, 615 bp, Heterodera glycines
atcttttattagcaaaaaaaccggagatattcatattaggtaaatttaacagtcaacaattatgagtttcgtaagttccttacactttacattaaaatttgtatccaaaatgttctcccactgtcagcaattgaatagtaatcattcgaagtgacaaatgagtggtcaacaagaacgaattggtctcaatttgcttgccattctccaaatattcgtacattgtttttgcattgaaatgccattccaaaaggccctggtcgagtgaaaaagtgccaacaatcacaaaactaatgctcaattaattagttaattaattaccctgatgaacaaaagaatgtccaccgattgcgagccgaacacgagaaatggtcggtatacaacacaaaaattgaccatcccgtgggctccgtcattgctcgtcgacttcttcaacagactgaacttcttgccgagttcagcgtgtttagttttgggatttgtttatttatttttatttttattatttatttatttttaatttaatttaattatttaatttttattaatcaataagtttaaaaccttcaataggtttaggttcactcccgcacccatccaataggttttggtttaaac

SEQ ID NO: 31444 - DNA, 1086 bp, Heterodera glycines
agtagattagagtacaaaaaaatttaaaatttcgaaatcatgtttcccactcccttctcccaggggtattattttgtaaaaagtctttttttccccaataaactttgcataccccatttttcgcaccgtgaatgttatttttattgaattctgaaccggtttgagtagattagagtaaaaaaaattgaaaattttgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaattttgaaatcatgtttcccactcccttctcccaggggtattattttgtaaaaagtcttttttttcccaataaacttttcataccccatttttcgcaccgtgaatgttatttttattgaattctgaaccggtttgagtagattagagtacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagagtacaaaaaatttaaaattttgaaatcatgtttcccactcccttctcccaggggtattattttgtaaaaagtctttttttccccaataaacttttcataccccatttttcgcaccgtgaatgttatttttattgaattctgaaccgttttgagtagattagactacaaaaaattgaaaattttgaaatcatgtttcccactcccttctcccaggggtattattttgtaaaaagtcttttttttcccaataaacttttcataccccatttttcgcaccgtgaatgttatttttattgaattctgaaccgttttgagtagattagactaaaaaaaattgaaattttgaaatcatgtttcccactccctttctccaggggtattattttgtaaaaagtctttttttccccaataaactttgcatacccc

SEQ ID NO: 31445 - DNA, 1743 bp, Heterodera glycines
  misc_feature (1577)..(1577): n is a, c, g, or t
  misc_feature (1660)..(1661): n is a, c, g, or t
gtagcatttatcgtgagcagaaaaaataatcataaaatttaattgtttgtttttcaatatcaatttttgttttaaaaatttgtcctttcatggaaaaaattttaaagtatcttaatagtttcatttacaattcgaaatatataagtttttagatattttaatacataaaaaccgttaataaaaaattttgtttcccaatttggtgtgcgtattttgcgggtttctatgcctttttaggtccatatttcgagatttttagttcctacaatggaagcccgtagttataagaataaaaatccgcttttagtcggttttacgcgtcccatcacattcaagcgtcccatcacacagtacgcgtcccatcacattttacgcgtcccataacattctattttttaaaatttcatcaaagtggtgaatgggaagattgggtaaatatcggtcatagggcccaaactcaaaattgctcaagaacggtcagaatcagggatggtatgccaaaacctaaaaaccgggcgcagaatcccaaaaccgggcaaattcccggctttccaggtaaaataccacccctggtcagaatcgatgtaaaaagattcgtagcaacacttctgcctaccattcccgaaaacatcgaagtcggcacgagtatcattagcgatgggtgggcagcaagcagcctggggacgtctcccaggcggggatcgattggccaagtctcttagatggctcccgactgacacgactgatcccgttggctggctctccattgccttttaagcgcccctcgggatgggaggagtttatcggagtaataaatggccgtgggaaattgccatttccggtcccggcattacaataataaatttcttattggataaagaaagatattagatattttagcattcgggtgtcatatatatttatcttttttaattatttcagttaatttattttcccaccggtccgtatttaatattttccgcattacggtcctgatttaattattttggaccgatcataatttcattgattttaattaaaaattaatattagaattatttttatttttacatgatatgtgtgttttattgtttttaatttattaagaattaattatttcatgatgtaaatattttaaacaggaaattattgtttcaataattttgtcatataaagcaaatactttatcattagtagtgggaaatgctttatttaattggatcagaacaattaaaaatttatcctttaattcattaatgctcatttagtcaaacccaaatacgataatttttttctagttgttttatttcgggagtaagatttaaataaataatttaaaaaaattttctttttaataagcgttacatcctccatttattcaactacagcgcttcaagctatccatttcgcatgatttagcatttatttttatctttaaattgatgttttttatgtctcgaaatcttaatctaacgcaaaccgcttggaatgagacttaagcggcggttgcctgcgcaactgtgaatgaataggccgttgcgagatagtaatttgagaacagatttttagccgattanacaatcgactaattgacacgcgagggatagcggttaaataaccggctaatgcgacagttagctgtgcttgaccctgatccacnngcgtcattggtcctcgactggtgtgtgcagcgatcagttggcgacagcgattggtgacaccggacctggtgatgctcggaca

SEQ ID NO: 31446 - DNA, 973 bp, Heterodera glycines
  misc_feature (951)..(951): n is a, c, g, or t
agaaccggcaggcaatggatggctttcaatctgcaagaaattagattggcaatatgtggttgtaaaaaaacttttgggtaatgaattattttttgaagtgagtcaaacaccctattagtgctttgctgtgccgagaaccggcaggcaatggatagctttaaatctgcaagaaattagattggcaatatgtggttgtaaaaaaacttttgggtaatgaattattttttgaagtgagtcaaacaccgtattagtgctttgctgtgccgagaccggcaggcaatggatagctttcaatctgcaagaaattagattggcaatatgtggttgtaaaaaacttttgggtatggaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccgtattagtgctttgctgtgccgagaaccggcaggcaatggatgggtttaaatctgcaagaaattagattggcaatatgtggttgtaaaaaacttttgggtaaggaattattttttgaagtgagtgaaacaccctattagtgctttgctatgccgagaaccaacgaggcaatggatggctnttaaatctgcaagaaattagat

SEQ ID NO: 31447 - DNA, 1793 bp, Heterodera glycines
  misc_feature (50)..(50): n is a, c, g, or t
tagtaaaaagtcccgggccattgtttgtccgcggtctccactctctccgncaaattgttgcaccttttcgatgacggacagtggtcattgtacgatttgcggcacattcgcttgaacaatgcgacgccaaaaagggcgcgttttgactatcatttggtacgaaatatttccacggacattttaatttgttgtcggaattcgaatgtataaacctttatcttgtttcagttgcacgtgtcacaacttcggtggatgttttcgataacgggggacccctttttcgaggaaacggccaaacgatgggagaaatatgcgaagggatgacgggaccgacagacattttcaaccgattgacaaaatatttaatagttctgctcaattccacagagaaagaggtggtcaaaattggacaactcaagcgcgaaaacgtcctgacccatatttttacaactgaccatttgtaacattgagttggaaaaacagtaaaatacaacaataaagggtttggggtgaaggagcaactcatttgttccccctcaggccattccgtccaaaacttttcggggcgcttcccactttcggtcgtatccgttccagccgtttttcggtggcgcaatgaacaaccgcgtgccattcagaaaacacgtgaccactccccggtacgccgttcgtggcaccccggcttttgagtccgccattacgcccactctcaaagcaatcgacacaaattcctccatcgattcgtactcaattcgacaatctccgctgtttttactccattccaaaatgttttccatttggactttttgcgccgaataaactctctccaagaaactggcgtcatattcacttcgaataaaaccgctgagatcaatccgcgtaaaattcacaggcattcgattgaggaatactcgtcgcaaatgtcggttgaaaaacagacccctgaagggtttttccatgttatcgtggtcttttaagtcgagatgacttgctcgctccaatgcgtccaaattcagtcatcgccgtccgcgatatttcaggacgaatgcacgaacgattcttgcgctgttcaggctcacgaagaaagtcgtcccaaaaagcgcgtggccatttcggcctcaattcattccaaaaatccctaaattctggtggaattggtcaacaaaaaagaatgtgaatgacttggtcatcatccatccgagcccagaaaagaagtcggaacggaagagaagcgacgccccaaaagagaggtcgacgagtcctttctttccgttgtcattccaagcagaaacacagaaaagggagcggtcggactcgaggagaggccgagtggccaagaagaaatcgaagaaatcaggcgcaatgtccaagtcgtctaaagaaaaaggggtggaaatgaaaaaccaatttggaaatttgagagaattttaacaaattccggaattccgccatttaaaaatctaacaaaatttgcaatgggacgcgaaagaaaaaccgccgtttcaccgtctttcccaaaaaaagttctggttaattgtaagtgacgtcataaattaaaaaatttcatgctctcgtaaaatgttccttcataattcaccttttcccctgtccttagcttcccttaccctccgttatgatgacagtcgtgaaattcaatttgtcaaaaaggtgtgccaatcccaatttgtaatgcttcgctattttatagtacgtgccgaatttgtcgtgctcccgtggcggcttcaatggtcgctttcgctgctgctgtgctaaagcgcattctgtgccttttt

SEQ ID NO: 31448 - DNA, 1734 bp, Heterodera glycines
accctcccgccgacgctgatgccgcaagaagtaatcgatattaataaaaaatacacaacaggaccacaaattgagggaccgtcccaataaatgaaaaaattttatcgtctctttaaattcttttgagccattttcagatagggaagcatataatggtacatttcgtcaatttcagaattgtttttagttcccgtaattacgactttaccggtccagaaaattaacgctgtcatgcttttaccccgcttgaaatttaaaccgcaaaatatttcgggttcataaaatgcacgacgattttttcgaaactcgttcagttcaatttcatgtccgaatttaaaggtcgaaacaatattttcaaccgtgtgtccggtgtaagaagcccccggacaccccgagcccttattatttctatgaaaatttttatcgcattttcacagtctatcagacttttcgtccccaaacatatcattttcccggattcccataataatgcggtggctttgatgggagttgtacatttgataaccgcggcattgaattttctagggttatacttaaattcgcattcggtgatcatcagagagtttagtttaattccggtaccgagattagcgagagcaattatatttacgattatcggtttttgcattttttgatacaatgtaccaatcaaatggtcctttcactcctttatataccccttctataaatagcaaccaaaaaataaaattaaattgaaaaaatgaactgtccacaataaaattaagtgttgtcattactgcccctgtcattacgagaatgtgtagcaggtgtaaaaaacacagtcttttgcatatcggtacatcattttttgataatttctggttatgccccaaatgtgcgaaacatgttccctatgaaaagaaaagtttttccaatttagcttttttatttgttatccaaatacaacaaatcttggtatcattcgaaaagatcttaacatgctctattagccttttcaaaaaattgcaaaagtttttcaagcctgaaaaaatcttaatgaaaaaaattgaaaaatttcgactttttcgcaatttttatgtataacttttttggtatttgtctaatcgtgaagtaatagctgatagaaaagtttctaaatgcagtaagctttggaaagatattaaaaatgttggatgtggatgacatagaaaaaagttatagaatcttatagtggaaagtcatgctggcgcccaatttatacaatttagcttcagtgtcgtatcaaaaaaccgcagaatgaggctgaagcctcagatctggcacctttggtcttgtgccagtagcaggggataggacagagataggaccaaaaaaagtgatgcgaagaacggtagagattgctgtttagtaaaatcacaggatctgcttggttgttttgttgctgtcagaagccgtcgttaattgatacggtaatggtttagtataaaaatggcattttttcttctcctgcgcacgcgtccagacacaggcgggcaatttcgggaaaaaatatttattagcattttagttataagggccatccatacgtttggaatcctcataatattggtttttatttatattcataaattatgaatattagtttaataaagtcatcagcaaatttgtttaataaggaatctaaagaccaaaaaatttcatttgcgcaaaaattacatgttagcagctccgttcatttatcagggcatacaa

SEQ ID NO: 31449 - DNA, 736 bp, Heterodera glycines
ccgggaccgggacttgccgggacctgagaagcctggaccgggacttgccgggacctgagaagccgggaccgggacttgccgggacctgagaagccgggaccgggacttgccgggacctgagaagccgggaccgggacttgccgggacctgagaagcctggaccgggacttgccgggacctgagaagccgggaccgggacttgccgggacctgagaagcctggaccgggacttgccgggacctgagaagccgggaccgggacttgccgggacctgagaagcctggaccgggacttgccgggacctgagaagcctggaccgggacttgccggtacctgtgaaagccgatcctgtacttagccggtctctgaaatacttggatctattgttgtttttgtgaatgatttgattaacacaataaattatatttcctttcttaaaagcaagtatttaagttatgaaatcattgtcgaaaactttcattggccaagttcagttgaagtgagcaaatcctccgaaaaagcccgaatgaattattattgtttacgtattaatattgttatttttggtacccattagctcattacttttttataatttgctttatttttgtctttgatgaaaagtatgtgtcgctgtcacgatcacttattttttaaaatttaatattatacgaaacgtcaaattggaacattgtatgaaagtcccattgtacgaaacgcctattgtacgaactgc

SEQ ID NO: 31450 - DNA, 1236 bp, Heterodera glycines
  misc_feature (1167)..(1167): n is a, c, g, or t
attaagagtagagtgtcacaggaccaggaattttccaataccgggaccgggactttttgggttgaaaacccgggaaaccccgggaataagtaattaaaacccatttaaagaatcaatttaaaacaaaaaatgaaattacagaaattcctagcctttttgaaaagcaaaaaattttacaaacaggagccatttggtaaaaatctgagccggaaactttttaagttttcataaggtttttcagtgttcatgcataccaaaatgctaaattcgaaaatttgtaccttcggctttttgttcgagtttagtcgaaatggataacgattcgtggtcagtgtcgtcgaaaatccagtctgatcacattaacgcatcgcgcgtaattatcaaattgaacaatttccggactaaactactcaaaaaattctgccttttaccttgagaaagaacttttacaacttttgatgaaaatttgtcgatttttattgttaaaaaatttaaaaacttcagttctaaataaattttttcatgaatcacacaatcgcatatgttatataaattgatagaaacaaaattatcacgaagaaaagcatcataaaatttattggtaaaaattaaaaatggttaaaatagaattgattaaaattaagggttgaataaaatttacaatgaaagtaggaaatcactgaaaataatgccagtagaaatttcatagtcacttacacatattattatttttatgtatagccagaaaaatttaaaagcataaagtttggtcaggcctgtttcaaggtccataattcgtcatcccgaatttaacagtataaaagtttcccataaaaatagttctttaaaattgttaacaattctaatttttttatattatggacctgattaagtaatgaacaaaaatttaaagaatcaatttaaattaaaaaatgaaattaccaaaattaatagccctttgaaatgcaaaataaaataaaaattatataatgaaaaattttccttcaagttatcaaatcaaagcaataactaaattttaaattttaagattttaaaagagataaaaaaatgccaatgatcaattgttatttttggacgagacccaactcgtacttggccaactcatactgttttttacaaaaaaaaaatcgtaataactttttgtanagtcaaccgaatgaaacattcattttttgtatcatttcatagctattaagattctctatctacatgcaa

SEQ ID NO: 31451 - DNA, 1334 bp, Heterodera glycines
  misc_feature (1224)..(1224): n is a, c, g, or t
agagatttaaatggtacaataaatataaattgatacctttcgtgattattttctataatcattttttgacttcaattacttagttgaggaaataagagatacaaataggcagaaaattaataatatgaaatttgaattatgtaaaatattattgaattacaggatgcaataaggtcttcataggttatttatatttgagtttttttgcttaattttcaacaatagctgcttttttcttcatcaattttttaagttcatctttatgacaaaataatcagttaacaatttgtatttagattaaattttaataaactcaaattaaaagttgttgagctaagtgaacacacttaatttccgaattatgacccacaaaatatcaaaaatgcatgtcaattttttttttgtgggcagaaagctgcactgaaagcaatagtgaacaaaatcaattaaatattgataatttataataaatttcaaacatacaaatgtaaggaaatatacatgcacattttttaaatacattcatgaattaaaatgtagattaggttattggatttggaaccaatttgtgaaatgaatcggcaacaaataatattctcgtactgtgtacaaagctaacaaaaaattagatgtaaactgtaggaagcttttctctttttatttgccaataatttttcattttctcccttttttctttctccgttatttttcggctaattccaaattgctttctccattttttaattatgaaaatgctaactccgattttcttactgatttctttcataatttttgttccattcttttttcgaaaattttcttcctttttgtttaaattcatttgtcatttcaatgaatttctgtacagtgtcgagtttttcttcatcagtttttgatttatagcatttgcgttttttaagattcaattctttgatccattcataaatatattggcaatttgtccccaattttttcgcaatttttccttcaattttactcctttctctttttaaatttttcttcctttttgcttaattttatcttttattttataattttttccaattatttctcttcttttctgttcttcgtttcttttttcttcccatttttctccaaatatttctttaaatgttttttgttccaattttttattttctgatccgatctgatcagttagggtgataaaaaataatattgaacagaataataggcacaatttcnaatgcattcttttaaatattactaatttttaaaaataaaatgctcaatttgacagaatttgtttaatgtattattaaaatgattaactatttaaatttgatgacgtaaat

SEQ ID NO: 31452 - DNA, 1116 bp, Heterodera glycines
actcgcataaccaaaaaatgctacgacgacggctcgtataaccaaaaaatgtcacgacgacgactcgcataaccaaaaaatgctacgacgacgactcgtataaccaaaaaatggcacgacgacgactcgtataaccaaaaaatgccacgacgacgactcgtataaccaaaaaatggcacgacgacggctcgtataaccaaaaaatgccacgacgacggctcatataaccaaaaaatggcacgacgacgactcgtataaccaaaaaatgccacgacgacggctcatataaccaaaaaatggcacgacgacgactcgtataaccaaaaaatggcacgacgacggctcgtataaccaaaaaatgccacgacgacggctcatataaccaaaaaatggcacgacgacgactcgtataaccaaaaaatgccacgacgacggctcatataaccaaaaaatggcacgacgacggctcatataaccaaaaaatggcacgacgacgactcgtataaccaaaaaatggcacgacgacgactcgtataaccaaaaaaaggccatgactcaattttgtctctaaaatgtgaatttttttgaaaaatggattttgatttttttgttcgaatccgggttcggagttcgaattgggcgaaaatagataccggaatcggtttctccgaccctgaaaacccctaaagcaagtttatttcaaaaaaatttttttgaaaatctggacgcagatacctaacccacaagttccgatttttctatcatttttcttcaaatttgatttatttttttaaacttctctacgtggtgttctcggttttacgcgtaccatgacattttggcgtctgaaaaatgttttacgcgtctcatccaaattggtttattgcaaatagaaattaaaaagcctcaatatttaagctgaaaatctgacaattaaatcagaccacaaataacgaattcatttacccctaggctcataatcaaatttttgaagacaaacgatcaattacggcttgaaataacacagcaaaatacgttttttccacaataaaataaccagttcgtgcttttgaactgagcataaaatttgaattttaaaaagtatacttgaattat

SEQ ID NO: 31453 - DNA, 1549 bp, Heterodera glycines
  misc_feature (122)..(122): n is a, c, g, or t
tatatctcttcttaattataaaatgccaaaaagtttggcacgttttatctcggcatagaagctcatttggcaaaaatggttaaaattttacaatagaacctaggagtgatctacccacccanccaaagttctcgcggggaatgcaattggtaaaaaaaccaaggaaaaacttttctacccccaattgaaaagtcccatttaaatgtcaagcaacaacactcaaattacaagtgcctgtttttgttggacggcaattgtccgttttgtgccgcgtcggcgtcttcagtgagtcgctgtacgtcgtcgataccattcgaatttcttggtttgaagaaatctgtgaacgaattgctgacttttgagccgagagtggccacattgaaataggcttgtcgaccggacgaactgttcgccttactccgctgttcatttacaaaatcagccagcgaagacattcgaatttacaaatctaaattgaatgaagattttcgatttatttagagatgtctcaagctattagggatttaataaatgcaaaacgaaaaccgttgacttaaaactttaaatggaatggaaaaggtatacctaatcattagagaacgtattttgaggcatatgccttttttctgcgcattagttccaatatattaatcaaatcggtttgaagcttctacgttgacattattatgccttttttgggattttcatcgcctttttggcgtttttttccaaaaaagcccattaaaaatgaaataaaaatcggaaactactcccctaagaattgatgaaatttctcaaaaaaagatcgccaaaatttaattttttttttcttgataaataatttaggtttaaaattttccagtgtcgttatatatacctagtcaggaaaaactctaacaaggacgaagattaatagaataatacatacgtttcttggcgatcttttgaggagctaaaattttttttctgaagctctaaaagttgggtttcttgtggattaggtagatatttttgatattcatttaaaataacgggcgccgaataaataaatgtttcttgtcggttttatgggtaacatgtgatttcgtcagaagtgaaaataaatttattttctcaattgtcaacctatatttgttgtggtaacttacatatgtatcataaaatgatttatatttgtgcctcgtctttgctacttttatctcctatgtgtgcatttctaggtggtcgtaagacattcattctgcattaatctcggcatttcgttttaaatttcttactagggttggagctcgatccgtaaacgcggcaatttgagtgcgtgttccacgaccgaggggtatttctgtccgctccacccctgtttcttactaatagaattgctgcattttgagtatgttgatgctcttagtcagttttctgccttcaaattgtatcgtagacgtcagccgatcactatggaagtgacgtttacctttttgagtgtgtacacgtaactgattttcgcgcagcctagctgacggaatgggcacatgaaaagcacaaatcaaaa

SEQ ID NO: 31454 - DNA, 1135 bp, Heterodera glycines
cttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttggaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttt

SEQ ID NO: 31455 - DNA, 906 bp, Heterodera glycines
aaattttttttacagcttaactaggcccaattaagcttatttccagaaaatctcgcatgaattctcatttttaaattttttatagatttttaaatgtttggatttttttttggcttaacaaaacttcatcgaacctggttctttctattctctttcaaatcgccccaaattttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggatttttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatttttttggcttaccaaaacttcatcgaaccctggttctttctattctctttcaaatcgccccaaattttttttacagcttaactaggccctattaagcttattttcagaaaatctcgcatgaattctcatttttaaatttt

SEQ ID NO: 31456 - DNA, 1026 bp, Heterodera glycines
  misc_feature (1019)..(1019): n is a, c, g, or t
taataccactgggagaagggagtgggaaacatgatttcaatatttttgttgaaatatttgtcgtgctatgaagggcgtgggagggggggggcgaaggccccccacgaggccgcgaagaggccgagtgagtaccttcggtgcaggaaaattattaaatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattatgcgttggatttttgctcccccataattgtttgagtaccccaaaacggacacttgaaaaaatcgatttatttttgttttcgngggacct

SEQ ID NO: 31457 - DNA, 1317 bp, Heterodera glycines
  misc_feature (86)..(86): n is a, c, g, or t
  misc_feature (90)..(90): n is a, c, g, or t
  misc_feature (99)..(100): n is a, c, g, or t
  misc_feature (157)..(157): n is a, c, g, or t
  misc_feature (1109)..(1109): n is a, c, g, or t
aaaaatgaccccatctttggttaatttttgggtttttaggctgtaaaaaaagaaaaaaataataattattaagttgaaatattttntatnaatcattcnnaattaaagtaatgctaaaaaaataagaaaaatattctattacatggggaagcgaacncaagcgaaaaataatgaaagtaagaaggtttagccaatagaccacgtaaacatgttggaagaatgctttgaaataattaatttaatttatccttctccaccatttccttctcttttctcactttatgcgattttttaatttaatggagaattacttctattttttctctaaaattttttttagaaagaatcgcaaaacttttttttaataatttaattcttttaaaaattttttgaaaattttagtttataattgaaacggtcctttattggtgcctgaagtgaaatagagccgaaatttaacactgggaaagatttttggtcaattttgggctgaaatacatgagaaaacgtaaatttataccaaaccggtttttgagaggcagggcccggaaaccggttgcttttgaaaaagtcagcccggcagattcggaaatctcgatctctaattttaaatttatctcaatattagctttattttgttgctttttgaataaaattttgtcacttgatatccctaaatttgaggctttttgacgcctattttctgggttttttagaacccaaaaatactagttgattttcaaatgaattttaagtgatgaaattcctgctcaaatatacggttgcagtttgctctttatacgcacgattaatttatgtacataatataaacaaacacacacaaacaacaattccactaaacgagaacatttgtacatgaaatacagtggcaaaaacacatatacgaaatgtagtacaatacaggctacaaggcataaggcatcacatggaaatgggtcaatgtcaatacaaattgctgggcagtgttcagccgtggcacatcatttaaattccgccggagaagacgcccatcagacataatacaccagtttattcttcttcaagccttgcacctgaaaagtttggcttattcctccaaaatttctcanattattacaattacctccaaaaattccgcccatgaaatccgcatgcagaaattttagtggagccacgacgaagtgcaaccattccctgtaaaatgagataaagctgacgcatatcctcaaaaaatgtttatccgctcacccgcttccacacaaaactgctcgacattgtgctccaaggaagccctcaatggcagcggcgacagctcaa

SEQ ID NO: 31458 - DNA, 1311 bp, Heterodera glycines
  misc_feature (48)..(48): n is a, c, g, or t
  misc_feature (69)..(70): n is a, c, g, or t
  misc_feature (72)..(72): n is a, c, g, or t
  misc_feature (74)..(75): n is a, c, g, or t
  misc_feature (86)..(87): n is a, c, g, or t
  misc_feature (140)..(140): n is a, c, g, or t
  misc_feature (1286)..(1286): n is a, c, g, or t
gcgctagtgtcgggcattttgacattaaaatgccattaaggcacgttngtagcaatgatgcacgtgtcnntngnnaattctcaggnnaataatccctgaatttcttttattttcttatcactcacaaatcactggggganaattaagatgattctgatgattagcgttcttgttcgattttggcgctagtgcgatatatattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcactagtgtcgggcattttgacattaaaaagccattaaggcaccgttgtagcaatgatgcacgtggtccttggaaattcctcaggaattaatccctgaatttcttctattttcttatcactcacaaatcactggggaaaattaagatgattctgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactggggaaaattaagatgattctgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccattgtagcaatgatgcacgtggtccttggaaattcctcaggaattaatccctgaaattcttctattttcttatcactcacaaatcactgnggggaaattaagatgatactgatga

SEQ ID NO: 31459 - DNA, 1437 bp, Heterodera glycines
aattaccatcactgatttatcattttgctgatttcaacgttcaatagattttttttttgagatgctgattttcaaagagcaaaattgaactaaaaattctaattttgaaaatttttagttaacaaccttgattaaaccattgaaaatctattttcatttttttcaaaaagtcattttaatgccacgagtcgggccgtcgtcatcgctcgcttttcccatgccattccccaaaaatggcattcatcgtccattagatggagcacaaatcgttttgcttcttcatttgtcactggttaaggtcatttcaactgagaagacatgcaataatgaagaaggaaggaggaacacaccttttcaattggtcgtcgccattggcggcgaatgtttttgcccattttgcccttctcatcggacgccataaatccggatttgccgtagaaacggggggcgggggggggggggggggggaaatggaaaggattgttggctttcaatgtgtcagggcaaggtcacatccatccatcccctcggagacaaaggcaaaatacctgtgggggaagggcaatcagccggcggaagattgaaaaaggttgccagcccatggaggagagagtgcgtattcaaattggcatgtcgtactgcccgtttggaataccaaatgccaaaaatggaaaattgtataatggacgatatttgaattttgaaaaattttagaattggacccgctaaaaaacagcccaaaacgagttccaatcaatctctaatttcctttaatcaacacaaaacacaacatcccaaggtgtggaaaaatcaaaaaactgggtttttatccgtttgaaatcacgaaagattgcaccaaaaccagccaaaagacattttaaataaaaatttgaattaaattggtatcattctaaagctcttgacgagctacgttttatttgaattgaaactttaaatgctagaatttgttttaattttattccctaacccatttttgaacacaaaacacaaaccaactcacatcagcttgtcaaaatgtcgtcagactgttaaatgactgccctaagggattaaaatgaaatttccggcgccgttgtgacggacggtcgttcgttaaacatccccaattacggtagtctcctgctgctgctaaagattggcttttggcattctatccgctgaggcggcaaagcctttatttttttgtgagttcgataacaaaaattggcaggggaatttgcggttggaccaccaaatttctgctaattgatttcggcggcacttttgttttcattgtttgtcaaagggcacacacaaaataacacaaagaaaagcattttgttgattgttggcactttgcctcaggcacaaaggacgattctcccaccatatgaccgccgtggggaacacgaccaaaagtgccggcgccaactttga

SEQ ID NO: 31460 - DNA, 940 bp, Heterodera glycines
tcaaaaaaagagataccctttttttgggatagagtataaatttaaaatttccttcaaaaataaaaggtctattgcgcaccgcctcccctatcatgctcgagagcatttgtatgtgtataaaatttctcaaaaaaagagatatccatttttctgggatagagtataaatttaaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttctcaaaaaaagagatagccattttttctgggatagagtataaatttaaaaattccc

SEQ ID NO: 31461 - DNA, 1173 bp, Heterodera glycines
tttttcctccaccttcaacctgggttttccccgaaacgccattctaatatccgttgaaccttccaaatgttcggttggaaaatgctcccataattaagaatagatattttcagaaaaatggctttctctttttcctacgcccttcaacatgaggttttccccgaaaacgcatttctatatacggttgacccctacaaatggtcggttggaaaatggctccataactaagaatagatattctcagaaaaatggctatctcttttttctacagccttccacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacaccttcaacatgaggttttccccgaaaacgcattactatatacggttgagccctacaaatggtcggttggaaaatggctccataactaagaatagatattctcagaaaaatggctatctctttttcctacagccttccacatgagggtttccccgaaaaagcatttactatatacggctgagccctacaaatggggcgggttggaaaaaggcctcataactaagaaatagatattctccaaaaaaatgg

SEQ ID NO: 31462 - DNA, 1219 bp, Heterodera glycines
tcgccccaagatccctcaattaactctgatttattaatttatgcatcattagcattgtcattgcttcttctgactgtgccgcgcgtcgttttgccggtgccgaaagttttgtgtgcgtttgcaacacttcgtactgcgattggcccgctgtggaagacgaaatggacgacggaggaaaaggaggaggatggcatggacagcgcaaaaatgaccaaaaattggggggaaataaaacggcggtggtttttgtgtcggaccctgacaaattccgactccaccgacagttcgtgccgattttgaacgaagccaaagaaaggaaaaagaggaagcgaaatggtagcaaatgggagaaaggtgcggcacttcgccccgggggatggaaaaatgccaaacggtggccaaaacgaagccgaaaatgaataacaagtgccaaaaacatggtctacaaaacacaaaattaaaaaaaaaaaaattaactaaaaatattaaaaaattaaaatttagttcaactaatattttataggatttcaaatctattgaccaaataaaaatgaaaactaaacaaagttcctaatgaaccttgagcatttcggactattttagactttatccaaaatcttccaggccattggctgaccgttcgtgtgaatgcgtccgcgcgctttcagtcactgctcggtttcggtggcgcgttcaccgactcggccacgttcaacatggacgcgttgagcgggccaacccgctccacccttctgaaggcttactttgacagaaacattggtcattttataatgatgattgaacactcttttgtgattactcccatttttgaaggcattcggtactcagtcggccgtgtgccaatgggtgcgactgatttctctgtgcgccaatattcgtactgcgacacgcccggcgatttgaatctgaccacatttgcactggccaaggaagacttagaatggaaggtaagcaatggcaatggcacgattcggtggataattggtaattaattatttaaatagttgcccaacattcgttcggccattgctctcagcggcggtcagctgcgactttttgccactccgtggtcagcgcccggatggatgaagacaaatgagcgaatgatcggcgccggaacacttaagtgagacagactaattgaaatgatcaaatgataaatgagtgatcagagagaatgaaatgatggcattgggta

SEQ ID NO: 31463 - DNA, 1172 bp, Heterodera glycines
atggtcgtacaaaatgtgatgatatgtgattgctaatcagatcaataaagatcgccgctgtgctttcgatgcgattggttcatcattttgcttttattacttgctgaaactgtataactctctctatactgagaagagctcgagaatctcggtaatttctcgttttttttttgggggggggggtggttctttctcgactttcggtctaataagtttctatcgagtcacgaaatttgaactctcgagcagccattatcactttggcgtgtgggtgggtattttgacgtgaagttttttgcgtggaccacttggcgcagccattttgacgcagtttgttttggtgttacttataaaatggattttatgatgccgtataaaattcccgcaaaaatttgggacctctgctcgaaaaatcttaggtttttagcctttattcagcggaaagttgggtaaaatttttccgcactttaattcatatttctctgtgcacacacaaacatcccacataggtagatatatcagggaccaggaaccgagtcccgctttaaaatttttttttagtggcccgaattccgcaaatatttttttggggtctccgcggtcccataaaatcgtaacgtaataatttgtctttctctgacacatttgcatagatcgcgacgacatttttgtcgttgcgataggaatgcttactgctgcgaaatgtcagacattattcatgtgagaatgattcacagcttcttttttgccggcgtgttgcggtgtcagtcaatgcttcttgtaaaaattttaatgctcggatttcattttgcaacatcatagttattattagggataacatttatagttgctaaaaactgccaaaataattaatttttagtttctaaaaaaccccaaaatagttgctaaaaacttccgaatttaggggtgtaaaatgacaaaattttatccaaaaagtaacaaaattaaacaaaaatcagtattgagataaataatttttaaaatcacacattcttgtcaataaataaataaataaattttggatatgaattttcgagaaaattttcatttctcaggggtgtgtttttgaaatttccgggtcgattcttatgtagtggtgtattttttgaaaaaaaaaatttaagtcgattcctaggggtgtatttttcgtt

SEQ ID NO: 31464 - DNA, 1007 bp, Heterodera glycines
agtctttttttcccaataaacttgtcaaaccccactctacccagggtgaatgttatttttattgaattctgaaccgttttgagtagattagactataaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaacccccatttttccaccgtgaatgttatttttattggattctggaaccgttttgagtagattagactaaaaaaaattgaaaaattttgaaatcatgttttcccactccctttctccccgggggtatttttttgaaaagccttttttttccccaaaaaaacttttcaaaccccctttttcc

SEQ ID NO: 31465 - DNA, 1648 bp, Heterodera glycines
  misc_feature (51)..(51): n is a, c, g, or t
  misc_feature (290)..(291): n is a, c, g, or t
ttttctatcaaaaaggaagatgaataaatttttaaatttttaattcctctntaaacaagccaaaaagtttaggcttaactttttagtgaaaattaatttactcatttttcgagtagtgctcagaagcgcaccaggctttgcagggtaacagctgagaagaatgcttattcatataattatttaactgtcccataatatttctttaaaaattttagacattgcaattttgcgtacttttccaattttttgcaaaattaattcataattattttttcagaaagtgctcttanncgcaccaaattttatttacatgttaaataaggctctctgatgctttttctatcaaaagggaagatgattaaaaatttttaaaatttttaattactttttaagcaggccaaaaagtttaggcttaactttttagtgaaaattcaatcactcataattttacgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattttttttacatgttaaataaggctctctgatgctttttctatcaaaaaggaagatgaataaaatttttaaaatttttaattcctctttaaacaagccaaaaagtttaggcttaactttttagtgaaaattaatttactcatttttcgagtagtgctcagaagcgcaccaggctttgcagggtaacagctgagaagaatgcttattcatataattatttaactgtcccataatatttctttaaaaattttagacattgcaattttgcgtacttttccaattttttgcaaaattaattcataattattttttcagaaagtgctcttaaacgcaccaaattttatttacatgttaaataaggctctctgatgttttttctatcaaaagggaaaatgattaaaaatttttaaaatttttaattactttttaagcaggccaaaaagtttaggcttaactttttagtgaaaattcaatcactcataattttacgagtagtgatcagaagtgcaccaggttttgcaggagcctaaaaaggtcaaggaaaggcgtctctgcgttgatttagcagtagtacctatgaatttaaatttcctatgaatttttaaatgttcacaatttatttattttttgcaaaattaattcataattattttttcagaaagtgctcttaaacgcaccaaattttatttacatgttaaataaggctctctgatgctttttctatcaaaaaggaagatgaataaaatttttaaaatttttaattcctctttaaacaagccaaaaagtttaggcttaacttttgagtgaaaattaatttactcatttttcgagtagtgctcagaagcgcaccaggttttgcagggtaacagctgagaagaatgcttattcatataattatttaactgtcccataatgtttctttaaaagttttagacattgcaatattgcgtacttttccaattttaaaagaaattaattcataattatttttttcagaaatgctctg

SEQ ID NO: 31466 - DNA, 1700 bp, Heterodera glycines
cttatgacgggccgaaaagaaaaattcccaaaaaatttgccacgggaaaaacttccatttttttatggcccagcataataaagtaaacccaaaaatgtaagggaatttaaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttacatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaattgtcgggaaagaggtataaattctgggaaaaaacttttcaagaaaagctg

SEQ ID NO: 31467 - DNA, 920 bp, Heterodera glycines
ttcacgtcacttgggcgtcgtccaagtcgcccatctcctgtgccgtgtcttctccagactggcgatctgagcaccattagccatttccgttgctctgctgatcactgttcgctctaatcacctttgtgttggccgcttcgttggcgtccgttagctcctgcactttcttctgcaagttgcgcttggcctcctcgatctcctccatcttgaccaatccttccgactcgaaccgcgccttccactgttggatctccgcgttcagtttgctgatttgacgcaggcattccgctttgccctcctgctcgtcgtcgagctgttcgcgcaatgagtcgttctcgtgctgcacgttcttcagctgtcccgcgagggtttgccgctcgcggctttcctcgtcggcggttcgtttcgcctcctccaattggctgaccaactgactcttcaggcgatgcagcgaattcacctgtgatcaaatgtccatggtgatagcattgtcccaatccctgctcgtccatccgtctcacctggttctccaggtcctccacttgatgttccaagtccgcgttttcgttgtgcaagcggctcttcagcgcggcaaagtcgttgagcagtcgcgactgctcgtccgtcttgctctgcagttcgctgagctgcagctcgatgttcttgatcactttctccgcttcctgccgtgctcgcagttccgagtcggccgtttgcgtggcgtcctccaactcgcgttggatctgctgcttgtccttctccaccttcactttgatcttctgcatctgctccaactggtcggtcagctcggccaccgcgtcgttgtgcttcttacgcaacgcattcagctgcgtctcatggttcaggttgttctcctccaagtccccggcgcagttttgccaattccgcctcgcgctttt

SEQ ID NO: 31468 - DNA, 933 bp, Heterodera glycines
gcttgatgcctgaggtcttttatttcattgatttcttttataaaacattcatctttaaagagtcaaaaaatgcgattgtaacgactggtcagtgtatgatcagtgtttgtttgtttgctgatcggagtgctttcgttccttctttctttcccgatcactgcttccccccccccccccccacaactcttcaaagcgaacgcaccgccgtcggtagtaatcgttttgtgattgatgcgtgagaatggccgacgatttgatgcttttggcgcgccaataattttcagctgtcgctggtcactaacccaaaaatcgttttgatgagaaaaaaaacaaaaaaaaagaaaaaaaacatccgtgggaatattctgtcggaagtaaagaaaacaaaggaagggaatgaattgagatcaaaaagtgagtgggaaagaaaggtcaaacggacgaaagagcggcgggaaggacaaaatgccaaaaaaggaagacaaaagggaatttaaattggacaaaaggactaaaggaagacgaacggacacagaaggacaaaatgccaaaactaaatagggtgatttaaaagcgggagccatttgattatcatttttattcgtcgcatccttaacataattaattaaacaaatgatcagccaatccctaaatttagttttttctcctaagtttgcgttattttgtaaaatgtataaaccaattgacttttcgagtttggcactaaatcagcgctattttcagacacttcaattccattttgcccatgccgtcgtcaatctctgccggtggtgatgggatgggatggcttggcttcttgtcccccctccccccctgccgtgttcatcatctccatcatccctccctctccctaccatattcaccaatcaccccccccccccattgatctgatctcccctctccccccgtttt

SEQ ID NO: 31469 - DNA, 949 bp, Heterodera glycines
ttaacattacacaaaaaactttcaataattagacatacagatatttaacgaatacattacaacacttttatacactaattaatttattatcaaagtacattaacccatatatatatagttaaactatcacccacctcggtaacttgtaaaatttccatctattgtaataatttttaataatctcgacattagatggtcaataaaaataatatttcgaataaacatttttctagaatataaaaattaatttaatttaatgaatattataaatttagaatttaaacaaaatagtgatggtaaaaaaaattgattttaagaaaaaattctttattttatgcagttgaaaaagacaataaaattagtagttactaccccctcccccctcccggtccctttaacctagtagcggtcagtcattagcgctcaaattatcacaaccgtgcgctcaaatggcccctgcgggcggcgctcatgtggtacgcgcgagtgctcaaatgacccggcgtcgcttccctcccgacagctgacgccctttcccttctccattaggctttggttttgcgaattatttattttatttttaatttaaattatttttaatcaataaaaacccttcaataggtttaggttcacccccacacccatccaataggtttaggttcactcccacacctattcaataggttttggttaactaataggctttggtttggaatggtggttttccaagggccaaaaaggggggtagtaactactaattttattgtctttttcaactgcataaaataaagaattttttcttaaaatcaatttttttttaccatcactagttttgtttaaattctaaatttataatattcattaaatgaaataatttttatattctagaaaaaggtttattcgaaatataatttttattgaccattctaatgttcgagattattaaaaa

SEQ ID NO: 31470 - DNA, 752 bp, Heterodera glycines
ccaaggtcctgcccctccgggggattgtggttcaccggccaaggacctgcccctctgggggattgtggttcaccggccaaggacctgccccttcgggggattgtggttcaccggccaaggacctgcccctccgggggattgtggttcaccggctaaggacctgcccctccgggggattgtggttcaccggccaaggacctgccccttcgggggattgtggttcaccggccaaggacctgcccctccgggggattgtggttcaccggtcaaggacctgcccctccgggggattgtggttcaccggccaaggacctgcccctccgggggattgtggttcaccggccaaggacctgccccttcgggggattgtggttcaccggccaaggacctgcccctccgggggattgtggttcaccggctaaggacctgcccctccgggggattgtggttcaccggccaaggacctgcccctccgggggattgtatttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtgtttcaccggccaaggacctgcccctccggaggattgtggttcaccggctcaggacctgtccctccgggggattgtgg

SEQ ID NO: 31471 - DNA, 1346 bp, Heterodera glycines
tttttccacattttttttgttttcacttatcattttcttcatttagcgacgacttttttctgctttaaaaacgctttttttgtggcgcgctttttccaaaaattttgtgggacagagggggggggggggggggggcggttacgggcgatcaccagccccccgggggggaaaaatttgatgatttgaatgcaatttgttaacagattttcaccaaaaactgcctaatttttgcgattttaagccatgcaacgactttttttgtttataaaatgggtttttttacggcgcgctttttaaaaaaatttttgaggataggggggtccggaaaaatttgtaatttttaatgcgagttgtttacagatttttgtccaaaaatgaccaaaatttgcgatttttggctaattttttaagaaaaatagtgactagtgacttaatgccataaaatttcaaaaattctcaaaaattacatttttaaatgacataatgccataatttaatcaaaatattgttgaaaattacaaagatttctcaaatttctttgatttttttaaacttttccaaatgctcattttcaaggacgtccttgcatacaaggacattttttattttcaagaaagagggcccaatttcaaggacgtccttgccattcaaggacggatggcaaccctgctttatggtcctgttatcgtttccaagatttggcgcttcatagatttaaaagttcacttatttttatttattttatttatttgaacaaaccgcaaggcaacatagttgcacttatagcggaaaataaagtaatgaatagaattagaaaaatatgatatggtcaatacagtaaaaatacataaaataaaaaataaaaagggatgaattaccactcaggacttattttctaaataaaattctttcacaaaatttttaaatttagctaaagttccgatttccatagctgttttgggtaagcaattccacggattaattgtacgattaaaaaagttattccgagatttattactgaatcttttattttgaatcctaaatgtttttcgttgcgatcttgttgaaaattcgaaatatttttttgggtctaaatgagttaagcccctaattattttgaaagtcatattcatatcagtgagcgaccttcgattatttaatttctccaatttgcaaatctcaagtcttttttcatatgatgcagccttgaggccacattttttgtatacgattcttgtgaaaaatttttggaccgtttccattcttttactctgttcttttgaggagatattccaaacttcgcttgcgtattcgaggtgaggccttatatagcttttatatgctag

SEQ ID NO: 31472 - DNA, 500 bp, Heterodera glycines
tttctctctcaacgcgaggtctgttggtgccgtttcgtaccccgggaaggaatttacctatgtttgttaactgatttgtccatttattttggagagagtgaggtaggggggaggttagcgccgacactcaactcaccccttgttacgcccttggaagaattttatgtttttttaatatatttttttggtattcagtaattcgacatactcttgtgaccattcgtgattgcgccaacgaggaaattggccgcattgatgcccgtcaggagggtgagtatgctgcttcaaactttctaaaaaatttcaataaatttaaaattcctaaaaatggctcaaaatcgcaaaatttcgacacttttttggacaaaattcgttaacaaatcgcattaaaaaaaatgcaaaaattttcccggcggcgcctatcggcaccgccggaccccctgtcccccaaaagtcttgtggaaaaccgccgcaaaaaaaagttgtgtaaagaaaaaaaa

SEQ ID NO: 31473 - DNA, 995 bp, Heterodera glycines
tgttggcatgacaaccttgagcgggcgaggtgtgttcgctgcgggttgaaccggccgagtcgaaagacggcggttggttcagcctcaacatcaagatggtccaagattttagtcacggcttccctgtcttctttaacacgctgcgatgggcgaacagcattgctttccgggaggccaatgagcaccaatgtgcgttggcgttcttgctcagcgagtgccgcagtgtttggacccgagtccggtgcaaatgccattgagcgttttggttgaggaggagtgtcttttgtcgtgttgcttcgtttcattgtcgataatcgatttatagagaaaatttagtgaaatatggacctcaaacttgggtaattaaaccaatttaataaatttaatagattgtccggaaccaatttcaatttccgtcatatcactgatctgacgtcatattttcaaatttctatttgattttgcaactatttctgacgtcatatcatatttaatcaggaaattatgcaaaaaatggaatttatagtaattcaaattaagtaatacaatttgaattaattaatttatataatgtgaataaaattaatgaaaataaaaaaatctaacgtacataaatgatggtgagacggcaaaaattaaatttagctttatttcttattttgacaatctttcgaaaaaaaaaaattttcataaaaattattagagaaaaacaatgaattttatagttttgaaagagccatacttcattctataaataacattttttgtttaatttttgattattattattaaatttatttttaaagaatatatgatttgggcacatacgcggtagagactaagtttttattgagacacattctctgatctgctgatgtcagatcagtgatatgacataaattgaaataggctctgttttttgccaaaagaaatcattgtcgaaaaaaacaacaatcaaaactaaaaatacactcaatcgtttaaatatttcgaac

SEQ ID NO: 31474 - DNA, 1060 bp, Heterodera glycines
tgccccgaaaacaaaaaatcgatttttcaagtgtcgtttggggtactcaaacaattatgggagcaaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatacggtctccccataaatctgggcgcatcggttcggggggactgccccgaaaactttaaaaaatagaagcctaaactgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaaaacaaataaataatgaactctcttccttaatattttcctgcaccgaaggtactcactcggccgcttcgcaggttaagttagtcctttaccccccccgcaggcctgcaaaattggagagattatatcgatttttaattagaaaaatgataaaaaaatgaaaaaatttgatgatatattggggaaaagatgttaataaattttaatgaaattttgaaagattttcc

SEQ ID NO: 31475 - DNA, 1416 bp, Heterodera glycines
  misc_feature (163)..(163): n is a, c, g, or t
  misc_feature (194)..(194): n is a, c, g, or t
aaaacggtcagcgagttctaccgtatgtggggcgcagcacaggcggcgactgctgccgctggaggtggcacaccagtgagaaatttcataattatatattttcactactttttatccaccggtttggtaccgttgtcttttatttccatttatattcattctntacaatcataattaatttaagaataaatttntaaattttatttctaaataatatttttaaatattttttcaattatttcaaattaatcatttttaattaattttttaaattttgttgtttttaaatatagtaatataattatgatatttattacactttttcagtaaaattttatatatttttgtaaaatattttcatatacctaaacactagagatcgacctggacctggatccagttccaggtccaggccatttttcggcaacctggatttttcctggacctggatttttgtccaggaaatccaggtccaggtctattgtgaaaaaaaatccaggtccaagcaaaacacgaaaaaccctggattttcctggacaaaattttagaatttgttattttaagtgaccgatgttttttcaagttttcaaaaaatgattaaataacttagaaacacattattattattaattagatatttttagaggtttataagcaattaattgattttttcaaacattttttgatttttaaaatgagtttcaaaaaatccaggtccaggcctggatccaggtcccgaggagtctggatttttcctgggctggatttttgtccaggaaatccaggtccaggtccaacatggaatccaggtccaggcttttttcaaaatgtcgatctctactaaacactatttttaaaataaaaaaagtatttctaaatttgaattttatttaaaaattattgattgtctttttagtcatcgattgctaacagttcaccgtttgtcaccatgtccggaaatgctgctgctgctgatagagtgacaaaatgctagaagagaagcgccagagaaggaaagaaatttttgtgatttttgatcgatagaagaaacaatttttgatcagacttttcttatccaatcaatgatctaatcaataaatttatgtttcccccgtaaaataaatgtcactgaacattttcaacataagcattttatcggggaaaaaatatatcagcatttgggttcaaaactaatcagtagggttatgattttgcatattttttctgcgcatatgctatgaagaaaggggcttaaaaatagcatttctacgttaaaattttttgatttggtgaagatttttagtgcatataaatgcatattttgcgtttctagagcatatttcggccatttttggcaaattttcatacataagaaaaatgcaacaaaaatgaaaaatacacctcctaatttgtaag

SEQ ID NO: 31476 - DNA, 1310 bp, Heterodera glycines
  misc_feature (1265)..(1265): n is a, c, g, or t
catttatctcataaagtcagattaaattaattactccgatttgtttttagaattggtcccaaacacgcttgctaatagcttttctttcgaaaagagaggcgaggaaaaataaggtttgcatccaaatgtaatttttttttacattgaagcatttggatggcttgctgtttacagttggctcagtcttctttgcaagaagcagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgattttcaaatttagtcgaactatataaatttttcaaaaaattattcatcttttttatggttagcgcatatgtctctagctttatagaaacggtccccgaatctgcgaggaactacttttttgagaatttctatagattattattctgcatgaatccttcgcttaaattcccatttatctcataaagtcagattaaattaattactccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactcaatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccgtttatctcataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtctttctttgcagaagcagcacaactttttgttggngcccacgaccccaaaccattcgaaatagcatcgattgggctgact

SEQ ID NO: 31477 - DNA, 999 bp, Heterodera glycines
cttaggcctagtctaacaataagccattgttcgagttgccctgtgtatgagttgtcatgataaccttaggtttaacaacgaaatttatagttaaaaactttattggatacctaacaaaaaaaagtttttctcttagttattaagacaactataataccatgagaccagggatggcacggaatttcgatttccgaaaatttttggggcctcggaatgccatccctgccatggacacaaaatgtcatgggacgcgtaaaatgtcatgggacgcgtaaagtgttgttgggacgcgtaaaatgtcatgggacgcgtaaaatgtcatgggacgcgtaaaatgttatgggacgcgtaaaatgtcatgggacgcgtaaaatgttatgggacgcgtaaaatgttatgggacgcgtaaaatgttatgggacgcgtaaaatgtcatgggacgcgtaaaatgttatgggacgcgtaaaatgtcatgggacgcgtaaaatgttatgggacgcgtaaaatgtcatgggacgcgtaaaatgttatgggacgcgtaaaatgtcatgggacgcgtaaaatgttatgggacgcgtaaaatgttatgggacgcgtaaaatgttatgggacgcgtaaaatgttatgggacgcgtaaaatgtcatgggacgcgtaaaatgttatgggacgcgtaaaatgtcatgggacgcgtaaaatgttatgggacgcgtaaaatgtcatgggacgcgtaaaatgttatgggacgcgtaaaatgtcatgggacgcgtaaagtgttgttgggacgcgtaaaatgtcatgggacgcgtaaaatgtcatgggacgcgtaaaatgtcatgggacgcgtaaaatgttatgggacgcgtaaaatgttatgggacgcgtaaaatgttatgggacgcgtaaaatgtcatgggacgcgtaaagtgtcatgggacgcgtaaaaccgactagaaccaattttaattattttttcccttagacccacatcggaccaaact

SEQ ID NO: 31478 - DNA, 1267 bp, Heterodera glycines
aaaaattttcatttttcgggggggggggtggggaattgccccctaccccctctggtaacgcctgatttaaaccactaattgtcaccagtttccagcttctccactgtgctgaaaagaaaatttactttgcgaaaatctcaaagctcgaaccgaacacggtctttagtttccgagtcagagtgtgggggaaaaatgtgggtccgattggcattttggcaggcctaggcggtcttctctcagtgcgcactcatccaaagccaaagaagtagtaaatgtttttctgttgcctttttgatttgtttacattgtttttttaattctcattcgttcacattttttatttttcacttggtgtcgtcaaaaaatagaagggtttgcataaagcgaatgtttgttttgtgcatttaagaagaaatcggtacatttcggcactgtttattcactccgtttcaaaaattgggagataaaccaataaattgagagtgcagagaaaaatatctcattttggcgtactatttctttgtctccgttaatagggaaaaactgaatttacttctcaataaacacattttttctaccagttctatttagactaaatcttccatactttttgagaaaaaaattacgaaatttttgacgcttgactttgtttttttacgctccgatcttaagttattcaaaaaacaaaaatttcgaacgctcaaatctttttcttcagaccttttttttgctgatcgggccaacgttttttttctccagtgttatttggaaatttaaacgctggagagaaaccgggaaaatttttttgagattttggctatatatttaacagattttcaatcaaaaattattaattttacaaaaaaactcatttcttaccagtgcatttttactcccgttttttgggtaaaatttccgggagcgggatcgggagttgaaaatttaccgggacgggagtcccgaacgggaatcccgtaaaaatcccgctccctttaaaaatcccgttcaccgaaaaaagcgggagtcgggagcggagacaccagtaaaatcccgcgggagtcccgatcccgccggactctagaatttatattaaattcaaccacattaaatccatttttatctcaaatttcgtctatgtagaattttcaaaaaatttcccgcggcgcctatgggcaccgccggacccctttgttcctagttttttgaaaaaattgcgccgagaaaagcggttgtgaaaagcaaaaaatagtcaaatttatggacgatt

SEQ ID NO: 31479 - DNA, 1728 bp, Heterodera glycines
  misc_feature (28)..(28): n is a, c, g, or t
aagatttaagttcatttcgggatgttgnaatttctgttcccatctcacccattttgtcaaaccaaatttttatatcaggctcttctaaaatttgaggattgttttctcgtagtgtgttagtttgggtttggatggaattcgatatattgttgatctgattaaaatgtctttctacgtctctcccggcgcgttctgcggccctctttgcgacatcaatttttgagtctttggtatcttcagccttggcttctctccttccacgttgttttttgattttgtaatgatgtgtgaatgcctcgttaattttatttcccaggcccccggcggttttaaaattcatgtccggtaaataaacttgagtcgggacactgctgtcgttttcccatactttaataaactcttgaccgtttataccgagtgcggtgaatgagtaggggtaaataattgatgagagagctactgaccaatttgtgcccaattcgagagtctcggggagtcgaactgtgaattttgatgtactgttccctggtcccggtgtgttcgagggtagtacaatgtaaaaatcatccatctattttcactaattcctggttataaaatatgccttttattaaatttccttccaaatcttcgatcctgtatgaatcgggtgtcgtcgaattggcaacaacgattttaaacaattcttcggtaaagtttgggaggtacccctttgaaaattttcccttttccttggtaatacgaacgatatcaccgattttaaattttttctttttcgaaattttaaattccttctccttatataatttttcccagagcgcacgggcattttcaaaattaattgaagacggtttggctcccagtgttctattcacactgttgttaatgtttgttattattttgtctattacgtcgacccatcgaagagtgtctttctttgtaaaatatctgtacaagcgctcctttattgtccgatttgccctttcaacgactccggcgtgcagatcaggactatacattacatttttgatgatgaatttttcctcaaaatattttttcatttttcttgcttggaattcaagcccactgtcactatatattttcatcgggataattttagacttttcgaacacccgatcaaaagcctcaatcatgtcctcactcttctttgacttggccggtgcactgaagatcattcgactcagcacgtcgatgcagaccaataaatatttataaccgtcgttatgctttttcaactggtcaaatatgcacaaatcgcactgccaatcggtatggaagccacttggtatcgtctttagtctcgggaatcttttcctgatgggcttgtgaatcgtgtatgttttctgcctttctaggaatttattaacgtcatcggtcgtaattttcgggtcaatctttttggcctcatttaaaattttttgaattccagcaaaacttgccggagattttaaattaaaataaattttcgataaaattttctctacagtcttgcccatattagtggtttgaagggtttcttctctcgcactatgccgggtgtttttatagattttattgcctttttccttccacgtccccacatgacctttgatttatcaaccatgtcttttactgttggatccttcagtaaccgatctttgagaaattttgcaccgcgcggcgtttcatctttcttccctgcgagatacaacaaaacatctctataat

SEQ ID NO: 31480 - DNA, 996 bp, Heterodera glycines
cccaaaaacgggggcccaaacgtcgggggcccaaacgcttttgtcgcaaccgctaattaactcttttaaatccaatttgcttaatttgtagctgaatttggggagtcgtcagctgctgccgatgtctgaacggaatgaatgaatgcgcggcggatcggataaagaagggccattaattgttgacaaattgcttttgttttttaaattatttattttttcagacctcttttcacagttatttttgttcgaccataattttgacagttatttgttattctttacaagaaaaattatacgttttttatacattttatgaatgggtagttttcacttcagatgaaatctgaatgaaaagaaaacttttgattttgtgggttttattcgaatttgttctttatgatactaccgttagaaaaattaaaagttcaatgccctgctataaattacatatgatatatggtggcactattatagaaattacggtaatgactagggctgggaattatatggaaatccatattttttttcctggactatgggaggtctgaaacgcacgaaaaacatgtttttagcttggtttgaagcttctaggaagactttccatatccatcaattcggaaaatttatatccatatttttgtaattttatgtccatatttcgcgatttttggtccatattttatagaatttgaaagcatacaaaatttgtccaaaaacagccaaatttaacaaaaagtgaaatcgtggcggatttattaaagcactagcacctccatcaatccctttcccagagaaatttttgaatttaatttttggttttaatttttgctatattgtaaaataaaggaaaattttaatttttatcatattgaaaaaaacatttaaaatagaaaataatttgaaataatcaataaaaggcgaaaaattttcttattaacgtcatcaaatttatagattaaaccattttaataatatattaatattaaacattaaaca

SEQ ID NO: 31481 - DNA, 1478 bp, Heterodera glycines
aggcattgcaaacaaatgcaaaattggtcatgaaacgctgtgcaacaaaacctcagttggccaatgttcttcagacgctgatttatgctatgcaatcaaatgcgatgacagttaatctgccaaataataatttgtttcattcagaattcggtcaaaatccctttttttgtctaaaggtaatcagccaaacaaatttgtccaagagtggggctgtacttcgagcttttcaaatgtttccaagttttgcatggataaagctgctcaacttggtttcggatctgaccagcgtttgtgcaaatgtcatttaaaaccaccaaacaaatcgcacaaaatcagtgcttctggtaatgcataggatttttagtggttaaaaatagtttttcttaagtaattttagggatgtaattttttaaatagctgttttttaatttgcaaataattttaaacttaagcaaacaattttattcactgattccagttactttttaggttttttattccattttttgggaaattttccaaaaaataccaaaatagtggagaaacgcaaaaatagtggcaaaaaactattttagtggccaacatccaaaataattttttttaatggcaaagctccaaaatagtgattcctagtgatgaatagtggcgttaaaacgaagaatttccgagctaaaattatgtttttcgtgcatttctcgtcgaaataaagccgcagaaaaaatagttaaaaaactaaaaatccccaccctagctataatataaaagcattttttaaaaatggttaatttttgtgatttagccacacatttgctgaatttaaatattttccaaaaattaacatgcatataataaaatttcagttagaataagctcaagaaaattcgggtgttcttatatattcgaaacacattttatttgaccgagaccgattgacttaacgaaaattttgaaaaacaaaactaattaaatttaatatttcgaataaaataattgaaagagttaattaattctgttaataaaggccaagatgaagccattgacaattaattggcttgaaaacggaacaaaaagcacaatcgcaacttaagaggttttggcttttcattttgtgtaacttttaaaataatgaatttaagtatttatatccttgatgaaaaatgttgccgaagaacatcctataaatgatgtctttttattttaaagataaaagctaattaatattttactttttatttggtaaatttttcaatttttcaattgcaataaatgtgcaatttttagttttgttatcttgaaattatatttatttactattaacaataatctcaaaaaatcaaaaatatgggcctttttaaatggagttttttaaaatccaaaaattaaaggaaaattaaattgattttataacgctaaaaatattcaaattgaaaattataaatgctaaaatctttataagaaataatttataaatggatata

SEQ ID NO: 31482 - DNA, 1023 bp, Heterodera glycines
tggggtactcaaaccattttggggagcaaaatgtgcaccgcagaagtaaagtccaggttaaagggaaagtacttcggaagggatccgtctccccaataaatctgggcccatcgggttgggggggactccccaaaaaaaaaaaaaatcgattttttcaagtgtccgtttggggtactcaaacaattatggggagcaaaaatccatcgcagaattaaagtacaggctatagggaagctattccggaaggattcggtctccccataaatctgggcgcatcggttcggggggcctgccccgaaaaaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcacatcggttcggggggactgccccgaaaacaaaaaaatcgattttttcaaaaggccgtttggggtactcaatacagattatggggagctaaaaa

SEQ ID NO: 31483 - DNA, 1211 bp, Heterodera glycines
  misc_feature (1164)..(1164): n is a, c, g, or t
ttttgattttgaaaaatttttgaatctagatccaaataaaaaatcattcgccagagtcaagatgttttaatttaactggagttacctttccgaattttcttcctcaaggttattgtttcccccgtccatgtttaatgccaaagcattttggaattcatcgtacggaacgacgtcttgatttggcctccagacattgtcagtttcaccttcctggtattctccattggtattcgcctaaaaatagagtttagttttaagaattagtttttctcgcgtcggcacaatgtgagaaaatgctctgcaaaaaatgctctgttaaatatttaaaatcaccgcttgaattaaaaatcacaaaaaaattatttttagtaaaaatctattaacaaattgtattttttccatcccaaaatctttattttctataaaattttcaaaattgaagaattcgtctttcttttttaaatttgccaaaaaaatcgaattgacccttcataaaaacaggcagttgacctgcttcttaccgaatcaattgtgatgttctcaccaacaacaaggtccgaaattgtgtccataaaattttcgacttcttcgttctctccattgcgaatttgttcggaacaaatatttttatagggagctattttaattttgtttaacatattctaaataaaattttaattgtttcggcattttaaataaaatatttgtaagcatttaaaacgggtaaaatttccaaaaaatatcaaatcaataaatgattgctgcgcaaaattaaaacgaaaaggcaaattagcaggatgggggggggggggggagaaccaacaccatatacgcaacaaaggaaagattgtgttgcgaattgttttgcaaagttttggcgttctgattactaaataaataataaacttatttcactgggagcccaaaattgaatcgtcgtatggtcacattaattttgtaaaatgaattggcattaaatggttcaggcaaagggttgaggtcggaaaccaattaataaggccacaatacaaaattttgaagccttttacacttgcattttgcttttcaaagttttcaatcgaaaattgagcgtgtcggttttccactacggcgtcacaccaacattgtaaagtgccgagaaattttcggcggcgtcttccaaantattctctaagggtcttcggggtaacggagtgcgccgctttggccaa

SEQ ID NO: 31484 - DNA, 1161 bp, Heterodera glycines
  misc_feature (944)..(947): n is a, c, g, or t
  misc_feature (949)..(952): n is a, c, g, or t
  misc_feature (973)..(974): n is a, c, g, or t
  misc_feature (979)..(979): n is a, c, g, or t
  misc_feature (1006)..(1006): n is a, c, g, or t
  misc_feature (1022)..(1022): n is a, c, g, or t
  misc_feature (1025)..(1025): n is a, c, g, or t
  misc_feature (1030)..(1030): n is a, c, g, or t
  misc_feature (1034)..(1034): n is a, c, g, or t
  misc_feature (1063)..(1063): n is a, c, g, or t
  misc_feature (1108)..(1108): n is a, c, g, or t
ccggcttctcaggtcccggcaagtcccggtcccggtcctccccagaattcccggtcccgtggcactctaaaaaaaatcctcatttacctatcaaaaagccacaaatgaggataaatcctcagatctggcaaccctgcctatgatggatttgtgtttttttttgagttaattgttaaacgatttaataaagtggtggccggtcggtaggggtcaactccgtctcaacaatgttcaaaaagctaacttttttatttgtaggccaaacttaacaagcatggtaccattcgaaagccctggatgtttagaagataattcggtacttttccgttttgaggccaatgtttgaattttttttttaatcaacaacttgcgtgtagaattgctaaagctacgcgccaaaattattgcggaggcatatcaaaaacaaaaagttgtattgactcaaatttggttcattctaaatagattaagctttcgaatgataccaagattgttggatttggttaacaacaaaaaagttatagtccgaaaacttgggctggcgccaaaacgatacagacccccggtacggatggtcaaaagcaccgtcgagaaaatttttacaaatttggatgaaatttgcgatgaaaatatttattgaatgaggatatataattcgagaaaataaatttgcggatcccacgcgggattggaattggaactaaaattttttctgcattttccaaaaaattttgaattgcggaatgggacccctcataggacccttcccccggtctttgccgggaaaaaatctaaaattttttaatgaaatttgttaacagattatgtccaaaaaatcaactatcattggttaatttgtgaatttatggctgttttaaaaataaattaaaataatttttaaaagtttaccactaatttttcactcaaacccccattcttaccannnntnnnncccccacaaaaaaatcccccnntcccngattcaatttccccccgtcccaaatcncccaaaaaaaaaatcncgntcgcncatnttttccaattttttaaaccatttttaccnttttttaaaatttatgcttatataaaaaattaattaaaatcccgnatgccctgtggtgagggaagggactgaatgggtgtagggagggggggggtaat

SEQ ID NO: 31485 - DNA, 1468 bp, Heterodera glycines
atctaattaaaaacattaagcaattttcataatcgcaattttattattaaatattattattttttagaattattttttattttttgaaattattcttgaaaaaaaggttttaattgcatgaatcatctccgtaaaatatttaggccccgactgtcaaagtttcatcaccgaaactctgttcgatgtgtaccaaaaattcaagacgcacttgcgaattgaatttgtcccatttggcaatgcgaaagtgttggaggtgaacagctgagaacaaatggaaaaaaataaaatgaatattttacgtttttagaatggcacaatcaaatgccaacatgggcctgaagagtgtcggatcaacaaatttcatgttgctttattttattgaaactaatacattctcagaaggggtccgattttatgtaagaaaatcgtaatagcaatatattggcatgccaaaaaaagacataatttgcttgtaactttttttatttgtttttttttcaaaaatatttttgatatccgttaaaaaatttttgaagagtgcctttgttcaaaaattttttggttttcataaaaaatctcgaaaaattctataaacacaactaggtcaaggatttttagatctttctttacctgcctaaaatttaattttatccaaaatagaaaatattttgtacttgcactttttttggcacttctccagccatcccgacaaattttgtcgtgaatttcctccccgacttttctctttctgaggggcggggagaaccctaatttaaagcatgaagattctgaacaaacaaaatatttcatcaaaattggatcccgagttaaaattacacaaagagctaattaaacacttatcactgtagtcgtgtgccattcacttcatgcacgacccaatgccattcatttactgccttgaaaagctgatcagttcaggcattccgctggagaaagcatccaaaaaatgctatgtcaaattgcatccaatcccgcacatttacgaccaaattacgtgagcaaatggagctttacccattaaatcaactatttttgaaattagaaaagtatatttatagttttcatggtataattcgagaatcttaattcttctttattaacatttaatccaataaaaaaatttctcattcggctttgaaaaagttatgaaagcgcgtcattaaataatctataagttaaattaatgtattaattttacttaaaatatgatcaacaattacggcttgttctgttaatgccatttgtgtttttagtcactgtttcaatgggccgaccggcgatcgacttcagagggaagccggtcgtcggacggcacagatttggcctgatcaggtaaaaatgaaattaaataattataaataattatttttgcctattagcatgaatatgtgccatggattttggtgaacaatgccagtctgcaagcgactcaatttttgatgaacgg

SEQ ID NO: 31486 - DNA, 1009 bp, Heterodera glycines
ttaatatgatcggaaaattgtaatttgttatcaatgtttactcctaaatccctaattgtatccacagcatttattgtatttccatcaaattcatatgtttcttttgggttttttgaacccaaatataatacaaaagttttttgcattgaaacttttatttgccatttatttgcccattcgaataaattatgcaatgctttatgcataatttctgtgtcggttcttgctttataacaaatatataatttaacatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttatacctattttttccaatttgtataaaagtaattcatggggcactgagtcaaatgcttttgaaaatcaatataaatacagtcaacattttttccatttataattgcctcgtaccaatcttccacaactgttattagttgacttgtcgtagacctatttctaacaaaaccaaattggtattccgaaattttattgttttttaggagaaagttgtaaatattttggctaagaattctttccataaccctgcaaagtgagcaggttatagaaataggcctataattttcaggattaaatttgtccccttttttgaaaagaggaaaaactattgattccttccagatatctggaagagaaccagagtctaatgaaatcctgaataggtcagtaataacagttgctaatgaagaatggcagtttttcaatattttatagctaatattatccggggaggtcccgtttttattcggaagttttttcaaaagtttttgtgtctcgatgatgttaaagtctatatctgatataaaacattgattaacaaaagtattgcc

SEQ ID NO: 31487 - DNA, 1131 bp, Heterodera glycines
  misc_feature (9)..(9): n is a, c, g, or t
  misc_feature (12)..(12): n is a, c, g, or t
  misc_feature (16)..(17): n is a, c, g, or t
  misc_feature (20)..(20): n is a, c, g, or t
  misc_feature (35)..(35): n is a, c, g, or t
  misc_feature (40)..(40): n is a, c, g, or t
  misc_feature (42)..(42): n is a, c, g, or t
  misc_feature (49)..(49): n is a, c, g, or t
  misc_feature (70)..(70): n is a, c, g, or t
  misc_feature (78)..(78): n is a, c, g, or t
  misc_feature (80)..(81): n is a, c, g, or t
  misc_feature (108)..(108): n is a, c, g, or t
  misc_feature (115)..(115): n is a, c, g, or t
  misc_feature (120)..(120): n is a, c, g, or t
  misc_feature (141)..(141): n is a, c, g, or t
  misc_feature (148)..(148): n is a, c, g, or t
  misc_feature (150)..(150): n is a, c, g, or t
  misc_feature (165)..(165): n is a, c, g, or t
  misc_feature (189)..(189): n is a, c, g, or t
  misc_feature (320)..(320): n is a, c, g, or t
  misc_feature (348)..(348): n is a, c, g, or t
aagggaatnatnaaannaanatattttttttaatntttgntnaaattangtttggtcttgggaaattggnagtaaaanannaaaattattatttattgaattattgtntgatttnttgtnaattaattgagtttgattttngaaaaananagtgtaagggaaatntgaattttgtatggttatgtgganaatatttatgataataataattaggttattaaatattttgggagttggatttgtgaaaaaaattagaattttattaattgaaattgaaatttaattaatttaagaaatgaaatttatttttaatgggaganaaaattgttaattaatatgagaagaagnaattaaaattgaaagtgaagtaattagaaaaaattgtatatttgagaaagattttattttgaggttgaatttttgagtaaattttatgttgttagggtatttatgaagcttttttccattgttttagtaattgaattttaaaaagcaaaaaatagtagaaaatgtcaaaattgggcgtcgtttaagaaatgcgtaattcaatgccttactcgtataatgggattaaaaaggtcggcaaatatttttcaacaaaaccattctgtccaattagcaaacccagacgaattgccaatgcgaaaagtatttcgaacagtgccgaattaagcagcggcgcaatgcaaaacgaaggcttttcgcaaatgaaattgtcatctgccgacacaacactttgaattgcttttacaaaattaacttcatcattgaaaatctcctctgtcatttcactttttgcaaaaaaatttattaattaaaatataaaaacacaaaattaaatgttattgtttctaaatataattatattttaaatttaaatgaattttcggcacttttttctgtggtgttaggtcgaaccgaaaatagtctcaatgtcgataaatatttaaatttaatcatttcggttcaactttttcggagatcgaatgcttttatagtattattttttagtttatttttaaaaataattgtctaattaaattaatattttttcgagaccgacttgaattgtaaattaaatttaaatatttttattgacactgagactattttttcgattcgtctcagcac

SEQ ID NO: 31488 - DNA, 1012 bp, Heterodera glycines
  misc_feature (81)..(81): n is a, c, g, or t
  misc_feature (109)..(109): n is a, c, g, or t
  misc_feature (162)..(162): n is a, c, g, or t
cagtatagtatcttcgtaatcatttacacaaaatactccacaatgcgagaattgttgtctgtttatactacgaccgtttcncatgtaggatagcgcttccgtcctcctnacgtcacgcctgccgcggcagtatctgaaaacatttgtctgggtccgatcccngcctcaacctttgttacttacaaatctaatttggttgcagtccttgtttcttctacaagccacagcatgccctgcctcgtggaatgaaactcggtgaatttcacttacgatctctccctgcatctaaatgccgtcacgatttttttctgaaacatacataaagtttgaaactatttcaacggttaaaattttgactcgttgaattgcttcctcgatgtactgttgaattcgtctttggatttcgggatcggcaagcctctcctttgaacacactccttttccgaggacaagttgcacaatttccaatccatcttcttcgattgcgcagacctagttacgaaaaatttaacgaattgaaaaaggtttttacgataaattccgctgcacgacgagcaaagtgcatgtcgcactccattccaggtacaaacggggccgcgaaaaacaacaattcagcggcggttgatccttacaggaaataacttcagtataagtcggtaaatcatttaccaacaaaatactccacaattgcgagaatttgttgtctgttgtagctttcacggcctactacgaccgttttcccattgtagggatagcgctttccgtcctcctttacgtcaacgcctgccgcggcagttatctgaaaaacatttgtctgggtccgatccccgcctcaacctttgttacttacaaatctaatttggttgcagtccttgtttcttctacaagccacagcatgccctgcctcgtggaatgaaactcggtgaatttcacttacgatgtctccctgcatctaaatgccgtcacgatttttttctaaaagatacataaagtttgaaactatttcaacggt

SEQ ID NO: 31489 - DNA, 1549 bp, Heterodera glycines
tgatcagaggagaccgacggggggaggatacgaattgaagggaccgcccctttttgccgcaggaacatttgttaatgatagattagggagaacaattaaatgtgttaaatgagtaaattattgtatctcactgcctttaagaaccgccatcgaatagtttccagaaaggttaaaatgttcaaattatttaaaataaacttttttaagatcacaaaatttatctccaaaacccattttatcaatcttgaaaaaattaaaatggaatcccaacaatttgtggaacttacgaggcaatttgttgaaactaaaatgtttcaattcgagacgttttaaatgcagaccaaagtggtttcgagctcgaattgcaccagaaaagatcactggcaccaattggaacaaaattggttgaatgtgtagtccaatcggtagctagcactacccacagttatacaattatgccaattatcactgcaaatggtttattgttgtcaccattgtttattgtaatagcagagcggaatggaaaatttccccaaaaaggcatttttcaggttaaaaatatatttttagaaaataatagtaaaaatatttgatttatcaaaattaatattaaggctaaaaatgtttatgcggtacccaatacttcccatattatgacaaaaaatttaatggtcgaatgggtcaacaccgtcttatgtccagtgttgcgacctggagaaagatcggtgttgttggtcgatagttggaacggttggaatgaatttcggctcccacaaaatgtccaactacaagtcaaacaaatcccaaaacacgggactggattttcccaaccattggacgtttatgtttttcggtactaaagtcggggtagtaaaaaatccatcaaatatttttagaatttggaagcaattcacaagaagaataacggaatttgttatggtttacgacattaaccaaacgcacaacctccgcaccaccgaacaacacaaaacggtgcaaatgtttattcgatttattgggatagaaaaaagtttggcacgtcatatctcggcactcgtactcatttcgcagaaaataaaaccacttttcttaagaacccatgggtgttctatgcacccaccaaatttcattccgaaactccacggacacctccagaccttcctttgtgagcatttattggcaaataaaaagtgaaaatccaaaaatgagtgataataaaattgcaaaaatattgaaaattcatctaaagagcattttcaattggaagaaacaatttggagaagaaatactttgaaccattcttaattccaccaaaaagtaataaaatttaaaaataaatatattttaattgtataaattcgagtacatttaaattattgattactttctatagctgaaggtatttcatctctttaattttttaatttttttatgaaaagaataaaaaatatgcattaaaatcttaaaaaccctcaaatggtcatattaatgcaaaattgaaataaacatttataaaaaaaaaaattaaaatttgataaaaaaaatttaa

SEQ ID NO: 31490 - DNA, 1096 bp, Heterodera glycines
ccatatttccttccgcaatcgaacgaaatacgctcggtccgaccccttcttcccattccaaaaccccaaaaagtacgactccatccgcacaatggcaattagcgaattgtcgtaatggcactgctaccgctggttacggtcgtggcggttacggtaaacaatatgtgccatcaccgccgatgcgtgtcattcgaaaagaattcgccttgtggattgattgactccctacgctgatcgctatttttttttttgaactttctgccccatcaaactgatttttaatggattttaagcgcctcaatgtgggcaattggggtgccctttacgacgaataatatatattttttgcgatctttggcatttaatttttttaataaaaagtcatgatggcccggtccgaaaaataggattggtttcccggagaacggaagttttagaccattagtcccggtccatcgtcaaatgccggtcccggctatttcaatattatgagctgtttaccaccataaaattttaaaaatttagggattatatcaggaaattaaatattgtgatacaattataagctcaatttcatttatcactatttaatttgtatttgtgaaagcgtaaaaaaatataaagtcaaaagaggaaatttaaaagttccaattaataatataagaaactttggttggaatttcaggtaaaaataaatttgagggcgggagggggagggggggggggagagtactagagaccggcggagatcagagttctgtcggatttattggctaaacagaattagattaagtaaggaagacatgtgtccccgaaccaatttccaagtcatcccaagtttttgcaaaaaccggtctctaggtggtacaatcacaattctgttaaaaatttaaaaatattaaaaatatggcggtctgtgcaccgcacgtccctctctctcgtcaaaaatcagtgtcagtatcttccgccggtcatttcgttcaccgcatgcgccgcagccgcacgcgccgcttggttggcagcctaaaaggagaataaataaatcgtcacggagaaaggacactgacataataatatcagagaacgactacggtaa

SEQ ID NO: 31491 - DNA, 1173 bp, Heterodera glycines
  misc_feature (194)..(194): n is a, c, g, or t
tttttgagtcatccatttgctggttttttgagtattacatcatagcatctttttgagtatgaattttaaaaatgaaaaagtaaagtccaattggacagttttgttgctcacatcatctcacgtataaatgttttgtatttgtaaagcactatcgtacaaagtgattcacattttttaaatattttatttggatntatttcttaatttccttttcaattccaaaaataaaataataaaactaattatttatttaattgacatcatttaggtataattttcggattaaatttacattaatcaccacaatttccgctctccctaacggtggtcctaaattgcgtccatttccgccattttcccgatgcccaataaagccttcttggccaaccacccaacccccacatttccgatgggaaattgagccaataatgaaagtgcaaactcatcccaaccaacatacattgagaaggaattaatttgaataaaaagcgaaaaattattttaagaaaatccattggcgtgttcaattagcagagaaacaatttttaattaaattacgtttaattggtctaaacattctttataataaaaagattcctataacaaaaagcagaaaaagtattattattttttgttaatttacgcaaaaatcaacgaatacgtgcccagccaaaacttggtaaaattggcaaattagtgacaaaaaggtgaatttttggtattttattttatctgaatcctgcaaaatgagtttatttaaaatttgtcacgctatttaaaaaaaaatgtaaatagattctttacagtatctgttcatcagtgagtgtcaatcgacggtaataatgatgattacggtggagaaagttgttggtgccggcggtagcggcactattgttggcgctgccagtgtagatggttcaccagcacgacgggtggataaacaggagctgaacagggcgtacaaaatgatgctgcaccaacgacgggacgccgtctcaggacagtctggcaatgaggcaatgctgcgcagcacatcgccagcaacaaaaggcggcacaaacagttcgatggggttgacattggcatcggaggatgagcaaaagcagcacaaagaagtgggtgaattgatgactggtcctaatggtgaaccaaattaactaatagtgtcaaggt

SEQ ID NO: 31492 - DNA, 1146 bp, Heterodera glycines
  misc_feature (61)..(61): n is a, c, g, or t
aaaaaattttgaagaggctctccggaacggattagcatcggggttacgagatagaaaatgntcctaaaaagagatagccatttttctgagaattaattcacaaatttccgcagctcttagggtaatggaaaaaattttgaagaggctctccggaacggattagcatcggggttacgagatagaaaattgtcctaaaaagagatagccatttttctgagaattaatcacaatttccgcagctcttagggtatggaaaaaatttgaagaggctctccggaacggattagcatcgggcttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacacatttccgcagctcttagggtaatgaaaaa

SEQ ID NO: 31493 - DNA, 1485 bp, Heterodera glycines
aatttcgacttttttgcaatttcatgttataacctctctttgccccccccctaatcgcgaagaaatatcttagaaatatcttctccccatgttaagctttcgaatgataccaagattttgatttggttaacaaaaaaaatgttatagccgaaaacttgggctggcgccaaaacgtcggcgccaaaacgatacggacgcgaataaaacatatatgaaaaatgcttctttttgaccaattaatagaataagaaatgagcaaaatgttaggcctcgggtgggaatcgaacccactcgtccaccaaattcgtgcgctcatctaccaatgagctaccgatggcacttccgccctttctttgtttcttatcaacccccgaatggcacagagtagtgataaaatcatttattaactaaatcagaaattcttattcataatacgaaagctcttaatgaccttgcatcccacaaaactcaaaaaaaaaatttgctcttttaaaaattcaaaaattcttattttttgatcaattaacaaattatgctgtccactaccaccactatctcggtcaatgcttcaccggcgcttctcttaaaagattcgtccgctttctccactgtttcgccgcttctctcaaatgcttcatccgttgtggtcgcgtccgcttttgtccgtctgttcggctccgtctcatacgctctgttgtcctcaatgtcaattttgctgaattggctgctaatcaccgttctatgctatgtgaggatttttacggctaatttacttccaattgaaaaatggaggcagaaagtgccatgcatttttgagagggatggaaccatttttctaagccgtttgtttgttgaattttaactgggttttaggagtaagcgttaggatgcttatataccagggatgggccgaggtttcgcttttcgcatttcgcctttcgcattattcgcattttttggcgtttcgcatttcgcatttcgctttttggcgcgaaaagcgacttttacacccctaagaattggattaaattcccataaaatttttcaaaattttacctataaattggctaattttcagtgaaaaactgtttataaatgatcaaaatttccaattttttccccgtcggcgcctatcggcaccgccgcgcccccaaaactcctatttttttcttagaaaatggccaaaatcacaaaatttggtaatttgatgaaaaactgttctcagcggcgcgccaaaactcttatttctcattagaaaaatgataaaaatcacaaaatttgatcattttttagtgaaaatctgtcaacaaattttaatcaaattttcaaaaattttcccggcggcgcctgccggcgccgcctgctggcgccgcctgctccctcttcccaaaaagtttttttggaaaaagcgcgcctcaaaaaagcgttttattgatttttaaatttggaataaaattttaaaaaatgatttttgctttatgattt

SEQ ID NO: 31494 - DNA, 993 bp, Heterodera glycines
  misc_feature (39)..(39): n is a, c, g, or t
tgtaatcgctgctcattaaatgcaaaaattatttcaatntatttttcaaaaaaacatcgatttacgacaattttaaaacaatttcataaattattttaaatttaattattttcaattttaaaaggaaaaaagaaaatgcaaaactaatgaaaaaggaatcgcttaaatccgccggagaaaaatctaaaaggaaatcatttgaccttgaacaagtaacccatttgccaccatcgaaagcatcgcattaattaactaattaattacggacggacggggttttaaatccaaacggacaaagggaagaaagaaatgaacttttacacgtcattccatccatcccccggtgattacagtaaagcatattcatatggtggcatttcttttaccattttttgtaccgtacattccccacaaaccaccgcggattaaaaaatgatttttaaatattttaaataaattattattatttaattgctttttccgctgaaaatggcggacaaagggccaccgcagcaaaatgagcagaacgacacaaaaaggtcaattcaaatgtgcgccattttaaacagactcaaaaaattcttctgctgcagcagacgacgactgcccaacgaacttttggccgaattgtgccattcggtggtccctcggcttggcatttgggacgacgcgggacagtcgcccccgcggcacaatgccaacattttgaccgcgtcggcggcactgtgcgttttcttacggcacaaattccggcagaggaaaggtccaaaaacacaagacgaattggatgatttactaccaaaattggaatttagcaattgaaattgaacagcgcgaaaagtgttgccaaatctgtgcccaattagcctggggcgcctacaaattggggccaatcggaaagatttgcatcggatgcaaagtaaaaatgggatttaacaaaaagatggctgaatgaattttgcaattagttaattaattgttgtgtcctctcaa

SEQ ID NO: 31495 - DNA, 2000 bp, Heterodera glycines
  misc_feature (60)..(61): n is a, c, g, or t
  misc_feature (69)..(69): n is a, c, g, or t
  misc_feature (1916)..(1916): n is a, c, g, or t
  misc_feature (1923)..(1923): n is a, c, g, or t
  misc_feature (1927)..(1927): n is a, c, g, or t
  misc_feature (1929)..(1930): n is a, c, g, or t
  misc_feature (1934)..(1934): n is a, c, g, or t
  misc_feature (1951)..(1951): n is a, c, g, or t
tccctttccaggccttaactgccccgtggttggtgccatactagtttctcgaaggcacanncctcaagnggcgacacaggggttcttagacggcaatttcgcccaatgcaatggcggcactgtcgctgcgcaaaaatgacgtgcgcaagctgccgatgtttctgcaccgtgccgaggtgcacatcccgtggacaagggccagcgacggcaccgtcaactcatttcacatgatccgtgccgaaatgccacccttttttgtgcatgcgctgaagaagcttcatctgctcaagaaatgagaaggatggcactgttgctgtttcactttttgctcaaatatttaatttttgaaattttatttttcattaaaaatattgttacgcttacaaaatgtatttctcaaatttttaaatttgccatcacttttctggcattcttacgccgtttggccacacaatttccatgagaaatcaaatttaagcgcacgttttgtgtgctgctgatcacgaattaattcggaatccatggcgacccatcattacgagcccctaaccgccgaactcgaacaaaaaaccgaaaatcccaattttttcaaatatttgagcatttgtctgaattcggattcgtaatgggtcgcaacagctgtcgaattcgtgaccaacaactgctctcaaaatcacctacaaaccgaaattttttatggaaatttgtggggcctagacggtataaaaacacccattttctttggcattttcccaatttttgctggacaaatgtcaatttgcgttgatttgcgtctgtcttctgcggatttgccggtttgtggtcggcatcggcgtgtgccgtcccgcactctgctgttcttctgctcatttttgaggcactgaacttttggactcgactccgttgggtgacacttttgcgccgacggttggccatcgtcgacggatctgtgagcagttttttcgatggcatttgtgtggatatcatttcggattttcgcacattttggaactctgctagaatttcggacacccttgaaaaaatttccgaaattttgaggcttaaaatttgatatgcaacgggacggatgtgatatgattaattacaattaatgtctttcccctcccctcacttttgggcctcatttgtgcgcctttcccttcgccgtcggcggccgacatcaaagaaagcgacggactttcacattgacacgcgctggtgataattgcgtttattcgccgtttaaaaatatttaaaaaatgtgcctctaactgttttttatttgcgcgtttaatgacttttggcttttttaattgcctaaaaacagggaagaggatggaagcgcaattccacttctctaaaatctcgggatcagatttcgaggctcagaaaaggaatttggagttgatatatctgggtcatcccccccaaactaatttttttaaattattaaaaagaaattttaaaaaacgatttttttaaaaatttattatgacgaatttgtaaaatttttccaaaatttttcaaaaaatcgccgaaaataaaaaccgggcttggcagccttctccgaatacgtaaaatatccctggccatgggtggcaccactggcaaacacacaggcaattattaaaaagtatttcctttaattacatttttcagggactcccgactctcggcactcgtacaaaagggtaagcaaacaaaacaaattttgccacaatttcccaatttccccctcatttacagttctgcatgtcgagaccggtccgttgttattcttgagcatcgcctatctttatgtacttacattatctatcttttcaccctttcttaagagctttggcgcctttcaacgcttggcggcgctgtgtccgcaatgggctttttcagtcggaaatttgtaataaattacattntttttantttngnnggtnggtcgggattctgcganttggctggactggtgccaaaatcccgacttttttcatttacatcatcca

SEQ ID NO: 31496 - DNA, 1763 bp, Heterodera glycines
  misc_feature (75)..(75): n is a, c, g, or t
gggggcagcattgcgaggcgtcactccgttgacgaacggagtgacctgatgggggggggggggagaggaaggtantaatgacaatggaacattccatcccttttttcatcttttttttctgtttctaaattttttccccttccccaatttttgttttttatatcatcaattttagaatgcctaaaattgatgatattgctaagtgtttgcatttgcgacataagcgcgccgcctttcaaagtgcggtcttattactaacagaaaaagcgagttttttaaatgtttttttctctattaatttaaaaaacttttcagccgtcaacttttctgccagaccaacgcgcggacgaaacacaacagcagcaacagttgacgcaacatcagctgcaacagttgatgaacgacatcgctgattggcttggactgtatgagcagctgcctcaagagacggaaaagacaaaaacggaaatgttcaacacattggtcaacagaaatggtcaacaggtgggcagatgactcgggaggggtggcaattaaatgcttggtgatgggtgggacatttgttcattaaccaaaaacaaaaaataatactaacccatagaattagccgcacaatttcgttttttcccttttattttcataaacatttctctcttattcacaggtcgatcagtcggaacagacaacctcgtcgctcattcactcgtccgttttgcgcgagctggcaaatgcaaagcggtgcgaagaaaatgaacgtgtaagtataaatttaacggatcgatcgggagggggggagggagtcaaaagatgtgaaaaatacaaattaaatgaacaaatttcctttttttatttattttttaaagctggtgcgcgttgtgattgacgaagacgagtcagcagatgatcaaccaccgacaacttgcagcgttgggacacagacaaagatgagttttgcgaataaataaaaataaaataattttaaaatagtagtgttcaggcactcctaaattaattttaaaaaatataaaagttgagtgctcaggcactcctaagcgaacacggacaaacagacagaaaacaattgctcgcttacgaaaagaagagatttgcaacgcaaattttttctttaaaagataaactttgtttttgtttttaattcaacaaatttgtcaaataaaaatggattaaaatgattgaattcaagttcataaaaaacatttacgggtataatgacggaccttttatttaactaatatttatcctatcaattcaattattctcttccccaaagggtggaacagttccgatccatatgaattggatagagtttctgataaactccgtaggtttgaacatctttgatcataccccacattgtcacaaggaaatttaattaaataaaattaaaaattaaattcaaatacaaatgaaaataaagtagaaaacaaggtttattgaattcatatagccataacgtttttgaaacttaatgaaattttctgagattttgttgcaaacttgtagagcatatttagtgctatcgaattatatgaataataaaaaattggttgcttttaagccaagttataaataatttatcataaaatcataatgatggttttttaaataacgacctagcaccctttgaaacttcaaatttaaataatgtaataaaaaatcattatatccaaataaaaacttcaattttctttattaaaacagcacaaaaaagtgagatcgtttaaaaaatgtatgttttttag

SEQ ID NO: 31497 - DNA, 2028 bp, Heterodera glycines
aaataattaataattaaaacggattttaaagtttaccgttcagtgattgctcgcctttttgtcgtgtaaaaggtcaattagaagcttcaaatgctcaaaagttactggtgcttcaatgctaatttcatgttgatgatcaacggcagaaattttgttcagctcactttcgctgaagaataatgtacggaagaacggagaatgaagtgccaaaagctgcaaattgaaaggatcaatgaaggaataggatgccaaaattaattgtcaaatgaatgaatggagtgccaagaattggccctataatatatccaaatttaatttttttttttttttaatcaaatttaaacaataaaaaacaaacatttttatcaacattaatatgttttggtgaacaagtttcattttccttcacaaataatacaccgaactgaggaggaggaagagaaaaactgaaaagcgaagaaaaaaacacaaaaaaggactgtgctatttaaacataaaaaattaaatttaataattaagttaattattaattttatttaacctaagtaaatagggttttattaacctatctgagaccaaacaagtatctggcattatatcgatgtttatcattatgggatcattataatgtgctccgcaaatattcatcacattctttaatatgaaatttttagcattaaaatagaagcacaaaaaacaccttttcaaataaattaagcgtaaaaaatacctcaaattcgacgtcgataaaattacccctttgaatttgattgaaattaactgctttaaacttatgtgtaactgcttgcgcttcaccaattttgatgtgcatttctgcgcttgccatacaactccaatttggcactcaatttttgttggaaattattttaaaaaattaacaattttaaatcgcagggattggcaaacgacataaaaggaaaacaaattttataaatcaaaaaacaaaaaaaaatagtgtacaaaaagtgatcataatatgtaaataaatatattaaaaaaaaatcccgaaatatgtaggaaacatgtacaaaatccaaactttgtacgaaaatatgaaatagaattttgtaaatggttttttaaaaattcttcataaaggatgaaattggcataaattgtcataaaaatgacctaaataggcagagaatcacatttagtattttatggagtacatttcaaaaaaaataaaataaataaaatatttttcactataaaatttcaaaaattctcaaaatgtacggataatgccgaaattttggatttttttcgactttcaaaaactttcgtaaaaaatccaaaaaatatgtaaaaaaaaaatgaatatgtaagaaaaaagtccaaaatatataacaaatatgaaaaaacctcgaaatatgtaaataagtccgatttttgttcgcaaacacaaaaaggaaagtgtagaacataaaaggtaactcgcccggtgggactcgaacccacgacctcagcaatccgtgccgtgctctaaccaactgagctacgggcgcctcttttagaggttctctcaggtcctttatcccactttctcccacactccgttccttctggcatcacattccgcctccctcggaagaccggtccctcgggctctccttggcccttcaccgacggacttggactctccttggtccagtggtcccggcagtgtggaggggatccacccaggagcgccaaatagtaaaacttctcgccgttcggtgctgttcgctgcttatttgccttagattaattagggcaggggcacgggaacagtctttaattaggacaggagagattggggacaatattattattagggactttgaccaattcgttcggcttctttccaattatgccgactcagtcaattcgcaataaatgcaattgactgcacaattaaaacacaaacaaaattattccacagcacacaaatatccgcaattaccacgaatcattattaaaacaaattactacaattaacgacttaaaaaaacgcaaatgaaaaag

SEQ ID NO: 31498 - DNA, 1362 bp, Heterodera glycines
tttgaatacggattcagtcagagaaattggaactcccattttatttaatttgaacatcaaaatttttgtgaattccaaaatcaaattcccccaacgaattcacaaattatcccaagtcgaaattgccaaaatgaattttatccagttcggaaaattcaaagtgaaagttttccaaatcgggcggaacacggaaactggaaagagcaaaaaacagttcggtatgctcaaagtttccgacaacaggacaaaattctttaccatcctccgcccgcaaaacaattgggcgagcatccacaaaatttccaaatgtgttgtgaaagtgagcacgacccgagcaagcagcatttgaagcgtcctgataaggcacaaaaggaatttgaagaaccaaaaattccttttcaaccaattccgttttcaaaaaaggaaacgccaaatcagcaacggacttttatggagatgtattccatttgtgagttggacggcaatcaacggattctcaatggttcgttctcaagaattgttgttgaaaaatcacaaaaagctcattttccctacaacgcaaagccaatcccgataaaagttaatgagtttgggaaccggctgttgttaggcaatcatatctcaagaaattttttaaatttcaatgccgaaaaaatgccttttgacccaatcaaattccatcctaataatttccaaatgaattcaagtcaagggctggcattaaaaatttttgtttcaaatgatagtcccatttcaaattttaatccgatgaaaacggagaaagtgggaaatatgccgaaaaatgaatttcatgataaaatccatcaattggaaaatgatttgaaggacgtgtccgccgaaagagatgagcttaaaattttgttggagtcaattttttctggaaaatttttgaagaggaaaggattcaaaaaattttcgaataaatttcagaagattttgaaatttcccaacaaaaaggagtatgcgaaatgtttggtggaaaaagccgaaactcacaaaaaaccaaattctttttatcatcagacagctctcaatcaaaatatttccaacaaaaacacatgtcaatcccaaaaactgggacactcacgtgttttcatcaattcaaagcttaaaaaggacaatttgcactcaaacattttgacgaaaaatctgcccaaaaaatctcccgaaattcccaaaaatttggacaaatcgaagtcagaacgcacatttgtcaattctaaatacaaatcgaatcaatcatgccaaactcggaataatggagttgaaaataatagttttgttaatcaaacgaaacctccaagcctcttttcaattacattttcgtcaacattttgtcga

SEQ ID NO: 31499 - DNA, 916 bp, Heterodera glycines
  misc_feature (53)..(53): n is a, c, g, or t
  misc_feature (66)..(66): n is a, c, g, or t
  misc_feature (74)..(75): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (109)..(110): n is a, c, g, or t
  misc_feature (114)..(114): n is a, c, g, or t
  misc_feature (128)..(128): n is a, c, g, or t
  misc_feature (134)..(134): n is a, c, g, or t
  misc_feature (139)..(139): n is a, c, g, or t
  misc_feature (157)..(157): n is a, c, g, or t
  misc_feature (168)..(168): n is a, c, g, or t
  misc_feature (170)..(170): n is a, c, g, or t
  misc_feature (180)..(180): n is a, c, g, or t
  misc_feature (185)..(185): n is a, c, g, or t
  misc_feature (188)..(188): n is a, c, g, or t
  misc_feature (190)..(190): n is a, c, g, or t
  misc_feature (193)..(193): n is a, c, g, or t
  misc_feature (198)..(198): n is a, c, g, or t
  misc_feature (202)..(202): n is a, c, g, or t
  misc_feature (204)..(205): n is a, c, g, or t
  misc_feature (211)..(212): n is a, c, g, or t
  misc_feature (215)..(215): n is a, c, g, or t
  misc_feature (222)..(222): n is a, c, g, or t
  misc_feature (237)..(237): n is a, c, g, or t
  misc_feature (249)..(250): n is a, c, g, or t
  misc_feature (255)..(255): n is a, c, g, or t
  misc_feature (260)..(260): n is a, c, g, or t
  misc_feature (284)..(284): n is a, c, g, or t
  misc_feature (294)..(295): n is a, c, g, or t
  misc_feature (304)..(304): n is a, c, g, or t
  misc_feature (307)..(307): n is a, c, g, or t
  misc_feature (312)..(313): n is a, c, g, or t
  misc_feature (324)..(324): n is a, c, g, or t
  misc_feature (331)..(331): n is a, c, g, or t
  misc_feature (336)..(337): n is a, c, g, or t
  misc_feature (339)..(339): n is a, c, g, or t
  misc_feature (350)..(350): n is a, c, g, or t
  misc_feature (352)..(352): n is a, c, g, or t
  misc_feature (354)..(354): n is a, c, g, or t
  misc_feature (361)..(361): n is a, c, g, or t
  misc_feature (364)..(364): n is a, c, g, or t
  misc_feature (370)..(370): n is a, c, g, or t
  misc_feature (377)..(377): n is a, c, g, or t
  misc_feature (383)..(383): n is a, c, g, or t
  misc_feature (385)..(385): n is a, c, g, or t
  misc_feature (387)..(387): n is a, c, g, or t
  misc_feature (392)..(392): n is a, c, g, or t
  misc_feature (395)..(395): n is a, c, g, or t
  misc_feature (397)..(398): n is a, c, g, or t
  misc_feature (407)..(407): n is a, c, g, or t
  misc_feature (422)..(422): n is a, c, g, or t
  misc_feature (425)..(425): n is a, c, g, or t
  misc_feature (428)..(428): n is a, c, g, or t
  misc_feature (432)..(432): n is a, c, g, or t
gaagggggtctatttggccataaacactcaattaatcccacactgggctttgntatttttcattanttttttcnnattctttaaaaatttgangntgntnaatgttttnntatnttttgttgaggtgnttttanaatgntttgttttattattatgnaaattaaattnanaaatttgtgnatttnagnanganagttntttngnntggtgnnagnagaattntttaaattaaaaagnattgtgaagtgnngaggntattngtgtataatttgtaatatttttgnagaagaatgnnaagttgtgnatnatttnntgaaaaggaanaattggngaaanngnaaagatttggngngngttgttnagnggattnttttgtnaggtgnantnatttnggnannatttgggtnggagaaggaaaaaangtngtnggtngaaacgtcgtcgggacaaaaagtcgttgtgccaaaaattccgaaaaatttactaacttgcaattagagatttttcaaagaaaaaattcttgaaaatttttgtggtaaattacttagatttgaaaaaaaattccaaaaaatcgctaaaattctctcaaaaaatttttttcttagaattttctttaaaaaaaatttttctttgaaaaatctcaagttagtaaatttttcggcactttttggaaatgacgacattttgtcccgacgacgtttcatcagcacagttgcatttttgggatggataattttgtctcttttaagatcgcttactacgaccacaccggactttacgtgacggtgaagggcgaacactcgttcaaagtgtacaaagggtcggtgctcatgtaccgcaaggaatacccaaaatggtcggcaattttcaaaaaatttcatccctacaagaaattccagctctaatgcactttatg

SEQ ID NO: 31500 - DNA, 1793 bp, Heterodera glycines
cgtcatttcgtcccgcgtcgtttcgtcccgcgtcgtttcgtcccgcgtcgtttcgtcccccaagccgaaattagtcgtttcgtccccaaattaaattctgtttttaaaaggcattaaatttcgagttattagtgcctattttggcagtttttagagactaaaatccggtccatagttaatgaattaataaaatactttattaattgggcaaataacataacataattgaaaaaacatagatcaaccaaattctaaggggcattcattgaatcttccgtattttcatagtccttcaattttcctgcgtatcctccgacctgcaggccaagagccgtgataacatcatgaatttcggcatcactgttgtatgtagcgtccgctaaaattcgcatgatgactgttagcgtttgtgtcgtttgtgcatgaagtttcgagccgatctaagcccagaaaaattcggaagaagcgagggaacagtcgaaaatttggtatgattcccgaccaaaagtcacggccaacaagttccaaaaaggagagaaagttatggtcgtctttcctggtcaaaatcgtcgttcgcctcacaaaaagttactttggtcacattttggaccatatttgatcacagaaattggtgattcatcggcaaatttggtaccaatagacaaaaaggagatcaccccaataaaagtgccgattgaacgattggttataaagtcccaaaaggcgtcccagacatttcgacactgcctaaagggaaaaatccgtttaaaaacgacctaaaattgttgtcgatgtacgcaggaattcgttcagaaatttgcgaagtgactggaaataagtgccgcgaaattgggggaaaaagcgaatcgcaattggggacaattgcttcatattgtttggggggaaattggaaaagcgactccttttcagagccaatggatgtcggaagtgtcagtgccggatttggatggacttcggagtgcagtggaggcggctcggggcacgagctgtgcgagaaaatcacgctgggaagcatcgacccggtcctggacatgtcgaatttgggatcggcggtagtcaaaacgccgcttcaagcccttctcagcatctttttgctccgatcgggcgtggcttcatcgctcacggcagcccaaactttggtccagacaattgttggagcagaaccgaagctggagttgtgtatgtacacagggaaaaggggggaccaaatcagcaccggcaaatacccaacggaggaggaccaacggcaggctttggagaagtgggtcggatcgtgctttgtggctcgacaggctttaaccgagtcgggatataagcccttgtcgatgcaaatgccagagggagtcaattcgctgcccgattctgagaaaaatggcacgaggtcttcaaagacagttcatgggcactcgaacgtgtgcgggccacgattgtgcataaagcgagccgctttttggcacatgaccgtgttctgctcggagactcgtcggcagaaatgctttccaaacacatcaacagctcctactgcattggcggagagagttcgatggcagatttaattcgccaatttcagccgatcgttctgtcaagccgcgtcaaggccctgctcattttggttggacgtgactccttggtgcagggcgaaaccgaaaaatcgatgatggcccaattcgaaatgatcgtccgcctgtgcaaacgcctttcctcacgtgcagatattttggtgcccttcaccgtacgtgcatgtcaaggccgcggagtgcgaggagctgatc

SEQ ID NO: 31501 - DNA, 1413 bp, Heterodera glycines
  misc_feature (1355)..(1355): n is a, c, g, or t
  misc_feature (1381)..(1381): n is a, c, g, or t
cgccggctaaccgaaaacataaacgcatgcatgtgtttttgccgtagtttcagaacggcggaaggtttcaaccgtttgtgttaccggttaaaccgaacacaaacggctttaaaattgcggatttttgttgtattttactttaccaaaataacttttcagaaccgagttctatattaatttctgaaaattagactttttccagaatttctggaataaggttttccaatttcaagataaaatttaaaataaatttcataaaattctccttatttttctctttttttaaagctttattgcgtaaaaattgttctacactgaagtgagttgtgacttttcaaatattagtcccaaatcctgaggccaaaaaattgaaaatattaaagattttttaaaaaaactaaaaattataagaaagaaaagcaaccatcttattcgtgctaagaacctaaattaacacaataaaaaattttcaaagcccatttaatccaatatccattctgtaaaattgttaatttcggtaattatgaattgtaaagtttttgaaaaattagtcgtccgaaccagaataagtccggaaattttaaagacaatttttttttaaatattataaaattctacgcatttttctacattctgtaaattccggaacgcgtcagaattattctggtgtgcttcagaataattctgataattccggaacaagtcagaattattctggtgtgcttaattctggtacacaccagaataattctgataaatccggaacgcgtcagaataattctggtacacaccagaatgattctggtaaatccggaacgcgtcagaataattctggtacacaccaaatatttctgacaattctggtacgcaccaaatacttctgctaattctggtacacaccaaatatttctgacaattctggtacgcaccaaatacttctgctaattctggtacgcaccagaactattctgataatatattctgttgtgatccagaatgatcagaattaatttgaaatgtgttagaaaagcagaataaaataattaaatggaaaattggtaaaaaaaataaaaaaaatttaaaataatttaaaaacagttaaattaattaaaataaatttaaataaataaaaacagacccaaataagtgggaaacaaataaaaataaattataaattctaaaatattaagcaattaaaaaataattaaaaaatcacggttacccccataaaaaagcatgggcaaaagcttgcacaatttggcagcaagcgaatatctaaccgatccgtttgacaccggtaccattcgaaagccctattgattctctacaaaatgggtccgtgtgaactaattggncgacagcagaaatttcagaaaaatcngcggttttttgaaaacacccctaaattcaaaa

SEQ ID NO: 31502 - DNA, 1458 bp, Heterodera glycines
ttttctgaaaattttgtgaataattacaaaaaatctttaaaattaaacttattctttacgcctaggacgctttgctgtttttgggcgattgattcgccagtgtgacgagttcattaactacctcggcgtgctcgccaaccttctggacgagttgcgcacgcagggagcaaattcggtgccgggctcgtcagctgttctgctcattccgttgaattgcgtcacgatgctccgaatgttcctcattgttttccgtgctacgcttagtttggtgatggagccgatgacatttgctatgctctccttcacctctgtgtatgtgtcttattcgtgttttggcatttttcaccagatcactatgtatttctttatcgtatttttttgtctttctttcttccatctcatgccattgtactatcacttttttggttaatttgtaatgtttttttgcttttgtgctaggtcaaacctaaattatcaatggagcgaaataaaaaaagtatcaatgataataatatttaaattattaatatttaaatataattattattttaattttatttacatattgagctggacacttggagctatcgctcaataccggttttaatttaattgacaaagtttaaactaagttagattaaattttctcacccgggatcgggaccaaaaaaacaatcgtaattttgtgagctttctttccgatatacctccagtccctttaaaaattttgcgacacataaccaggccttcgatcgaaaatttttttaaactagaacattgggctaaaaaatctgattttgcggtgaaaatcagaacatttgcgaactcgcttcaaatcagttctttttacagttagttgatcaaaaattatcaaaatattttatttttcgtctccctttatcgattttaacaatttagggcagggaattagcaattgtcaatttcagtgtcatcgggatcaaaaggcggcgttgatagtcgcgcagcagaaaaatttaaaattttcacacaaatttggtaagcaagaaattttcgtgttataaatttttggagccggagtttttacctaattcacaaaaaaatattaagatttattaagattgaaaataatttaacaaaaatacgacaaaaaacacctttggacgagacaagaatgcagctcgaacaaataaaaggagtcgtattgaaagattttgaatagtttattttttaaagattttatgacaaaaatttttattttggaaataacaaaaaaacgaaaattggaaaatcggaaagtttttttgcgcttaattcaaaagattaaatcaattatttcattgaaatcaataggggctggaaattttattatgaaaaatcgcaaaacatatacataaatatgtaaaaaaaaggcccatatattaaaaaaatgtacaaaactcctcatctatgaacagaataagtaaataaaatttcttt

SEQ ID NO: 31503 - DNA, 1822 bp, Heterodera glycines
gatgtccttgaaaatgagcattcgaaataaaacattcaaaaagttgcaattttttgaagttttatacaaaatttttatcactttatggcattattggtgcaaaatctgttactaaattgcaaaaaatccaaaaatttttctggctgcgcctatcagtaggatattcaatgaataaatgcacggtgcctgtcgcggaagcgataaaggattcgatgagattttgtcctctccgcacttttaatttgttcatcttaggccaatcgggcaccagaggtgagacgcgaactcgatctgcgaccggcgtcatggcaactcgtacaattttaaattgatatggccataactttttttttagtcggccaatttcataaaacttggaatcattcaaatgcttttcatgtttagaagcgaagcgattaagcatctcacaaaaaagttgcattttaaagaacattaaaaattcacaaaagcagactttttctcaatttataaattatatcttttttgtgagatgcttaatcgcttagcttctgcttaatcatcgcttctaaacatgaacattcgaatgacaccaagttttaagaaatttgccaactaaaaaagattatgaccacatcaacttaaatgagcgggaccgggacctgaacgcggacaactgagtacaactgagtatcgaagtcccggctttgaccgggaccgggactagtcccggttttttcccggtttttccagcaaaaaattcccggttttttaacccgaaaaggtcccggtcccgggtttgcccaaaattcccggtcccgctcaactctatttaatggagaacattttgattaaaaattatatataaaaaaatttaaaaatatttttgtgatcaaaaacaaatttaatttatttgttcctcattcctatcaaaatttagttttcagtatacaatttctgtttaataattaatcaaatgcaatttaattgcaattgaattttatatgcaagttaataatttcccttttataagtagttcaattattaatcaaaaatattctccattttttgtctcaatcatcaaagaataaaaaatagataaacatcactgatgatcatatttattaattttgcatcattaaatatgtccattataaatttgagatggaatttttgttcccaattcattccaatttttaattaaaaatttatttcgccgcatattaattttacaaataaaatgtattctgctcaatgttttatagtgcttttcgtcacaattgcgttgtcacgttagttactttgtagaaaaattcaaatgttaattttaattacttttttcaaaggttctcgtcctattcctaaatccgtctattgctagccgatgatgagacataatgaatttttgttctgaagtccaaaaaaaattgcttttgagttttagtccatgcttactatatccttactgatcgcaaaatgtgacttccatttttaccgacaacggatataaaatgataaactgaaaattgatcgtgtcatgttaaaattgatgaatcatttttaatttcaagaataaaataatatttatatttggagcaagactttttttcgcggtgtcaattatgacaatgttatatttgaataaattatatacagcttaaattttatgatatgttttaaagtacttggtagataggcatattaaaatgatgcactaataaaaattgcattaatttagtcgtctattttaattttaatgaacttcataaaacatttaatcccaaaatgaaccattacaaaaatgttgattaaacagaactattccaactttttaaaatatggt

SEQ ID NO: 31504 - DNA, 1628 bp, Heterodera glycines
ccccactggatgagggtcccccaatctcattccttaaagacaatctgaagagcatgtctacatccgtgacaagtccttctcctccgtgcagggatatttggctgaaacatcctcccaagacttagtggtggccatagacaggtgacagcaattattgtgatggggtttagccttttacctcgttttcgcaggatattccaagactcgagtaacctctccggcgacgcggttattgaatgtgtgcgagcattgtcccaagtcctgctcggagagttgtgcagtcctggtggaccgagcatgtacatgctgcagaagatcctcgagatttccttctacaatatgaaccgaattcgcatagagtaagtgagaagcgatgttgcggtttcttcaataattagaggatagccattctcagttggtcaatctattcggtgcttcctcggcgaactcctcagaatgcacggtcgcatttacacccagttcacagctctctgcgtcgttaggaaactaatcagacagctctttgacgatagatttccggaaatagtctgaacaatcgttactttcggctatcacaataaaatttgttgctcatcaaagggaagtggtcctaaattgatcatctgctcaaattgactaaaaatgtctatcttttatctcgagtccggtaaagtaaaaatcttcgggagcgcgagcgggagttcataattttccgggagcgggaatcccgtacaattcccgctcccgttaaaatcccgtccatttttaacgggagtcccggacgggagcgggagtaattcgaaaatttaattaatacccacaaaaaaatttttaatgcacaaatttgaaggacaatccttttataaaatacagaaaaattataatatgcagaaacgaaataaaaaactccattcttaccagtgtatttttactccggtgtttgggtgaaattaaaaagtttactttccatgcctcgcttctgagttgatcattccgcgtgccattcacgtccttgaaattttgtataatttttcttttacttcttaaatttatttttgattttctctcattgtttctccatttgtttagaaatattttgagtttctaaaattcagatttttccgttactcatttgtttttcattttttcggtcaaaaaagtttattacagcaagcatttatgggaacaaatctcattccaatgcttttcgtcattccaagtgtatcggagcatcataatataggacaatttttttagatattatcctttgttttaatatttaaatttttaaaatttgaattacgttggttttaccattaaaaacgcattttatgatggtctttttaatctcatgaattaatcaaaattttgtcagatcagcatattcattcattagaacaacgacagcatgtaaattgataataaaatgtggagaatttttcgtttgctcaagcttgctttttctgaaaatttagaaattaaataaaatttctttaataatttattggactatacgaatatacaaaataaatttacgaataaatgagcaaaatgaacgaatggacgaaaagtgaaaacgattcccaatgaatttgcttaatgttttccgctgattcatcagcaaaaat

SEQ ID NO: 31505 - DNA, 1331 bp, Heterodera glycines
  misc_feature (1324)..(1324): n is a, c, g, or t
ggagatttggtgaaacgttcttagcgggagaatggaggagaaagacaataggaagagagggggcaaagtaagaaaagtggaaatggatctttagaaatttgtttattttgtcacaaagcgaggaaaagtaaagaacaaatcaatgcataaacaccatttcacaatatatagattatttcctaaataacgaaagaacagttccaagcgccgtcgtcaaaagtgcgccgatggcgatactggcgatacgctcgaggcgacgaatccgccgatccatcctacgcatttgactcgctaatttgataagctcatcaatacgctcagcattgtttggcggctgtggcgggtcaattggcaaagcgatcggcggcgccacttgcggagcgattggcagaagtgcagccttcaaaatttcgatgtattaaataacattttaaaagcatgctttcaattcaatttccaaaaggtttttttttgattcctttatactttctgatgaattttttgtattaggggattaccgggccaattggcaaagcaatgggcggtgccattgaaggagcaatgggcggagcgattgccagcataaaaaagcttgataaaaaggttattccatatagatgtgaatataaaaatgaattttgtttagattttgttttacttcgggtctgggattcggaataagccaaaatgaatgtcagattcgtgatcaattatccgaaaagtcacaacaaaacaaaaaacaattatttgggcatgaatgaaaaaagaagaaacagagcaaacacataaactagagaaagagaaaaggtacaatgaagagacacgttcatgacccgaattgagaaatatggaatgaaccgggcaaaggcgcagaattgtggtccagggacgtatccaggatttgggcttggggggggggggtaccgatccgaaaagtcaattcttaggggtgtatttttaaaaatttttcgcccgattcttaggggtgtatttttgaaaaactttcgcccgattcttaggggtgtatttttgaaaaactttcgcccgattcttaggggtgtatttttgaaaaactttcgcccgaacgaccttttttttttgctcataccagcgacgctgggaaaataggggtgtatttgaaatgataaatttttggaatttaaaagaaaggaaatgaagaaattgaagacagagaaaatgtttctttgtaatttggcgttggaatttaaaattaatatgttgctttcgttatgataatttggcgttaatttaaatttggcattcctttttctttctggggcgctggttggtcttgttggggggnggggggg

SEQ ID NO: 31506 - DNA, 973 bp, Heterodera glycines
  misc_feature (70)..(70): n is a, c, g, or t
  misc_feature (110)..(110): n is a, c, g, or t
  misc_feature (135)..(135): n is a, c, g, or t
  misc_feature (141)..(141): n is a, c, g, or t
  misc_feature (164)..(164): n is a, c, g, or t
  misc_feature (179)..(179): n is a, c, g, or t
  misc_feature (187)..(187): n is a, c, g, or t
  misc_feature (193)..(193): n is a, c, g, or t
  misc_feature (197)..(197): n is a, c, g, or t
aggaaatcgatgatgccgaagagagtgataaaaaaaatcttacataggtataaataataataattttagnaaaattaattactttttattggtaaagaggggaaacaaanataaaaagttaaaaattggaaaaanaaaggnttggttggaataatttaatttgncaaatcatttttgancttctgtnaatggntggntcactgttaattactgtcaaattgtcaataatttcgtcccttccgaatttggcattgtgccaactcacatcgaaatgccacaccaccgcccactcgtccacgtgcgactgttcctcgggcggaatgcgttttcgacttgccgtccgattttggcgtccggcatcggcggtcgcgtcggccgcacattcaggcacaacgacaaaagcaatgataattgcctgtgaaatttgaaatttattatttataaaagaaagaaaatagtaatgaaatataaattaataatttaatgacaaaaaaataatttaaaaagtaataaaaaatgatctgaaaaacaattaaaataaaaatggcttaaaattactttttttagtataaactgaggaaatgtaaaaaataaataattaattaatacaataataataatcaaaggtattttgaaaaaggggaagaacttacagtgataataaaattgatgaagatcacccagcgaaggaatgtgaagtaactggacacgacagagccaaattggcctttgatttaaattaaattctcagttttaaatgaaattttcactttcaattcgttttatccgcgactcccaagggacctaaaatgaaaataaatcacaaaacactgaaaaagtggcacaattcccacaaaataaatgccaatgttgctcaaccaacggaggaaccagcgccaccgtttcaccaactccctcctgtacaaatgcgttttggacactttggactcgttctgctccaagtatttctggg

SEQ ID NO: 31507 - DNA, 1000 bp, Heterodera glycines
attaatttgttgtacattttagcacaaattcagtttcaaacatatttcggcaatttcattttattttttgtacaaattcaagacaattcgccaattcgttcctattttgtatatattcaaaataatttgtcgtttcgttcatttttcgtacaaatgctaaataattatattaatccggttgtttttctttattttcgcacaattttcagatataaattcgtcaattcattcttattttggtataaattcaaacacaattcgtaaattcggttcacatttttgcacaatcatacataatctatttatatttgtaatattccgaaacaattcgtcaactcgtttatatttataataattcagaaacaattcgtcacttcgccaatttgttttacatgttcgcacaaattcaaaacaattcattaattcgtttatatttgtaataattcagaaacaattcgtcaattcgtttatatttttgtactaattccaaaacaactaattattttttttctttctctctctcttctttcatactctcgtactaattcaaaaaaaatcgttattcgtacaaattcaagacaattcgccaatttgtttcaaattgtagtacattcgccaattcggtttacatgttaatacatattcaaaaataattctcaatttggttattattttcatacagtcaattcaaaacaattcgtcaattcgcttcatatttcgtacatatttaattgtataaattcaaaacaatttgttaattcgctttacagttttgtgcatattcaaaaataaatttgtttttatttttcgtataattcaaattcaaaacaattgggtcaattcgttttacactttcgtacatccgttaatttggtctttactttcgtatttattcaaaacaaattcgtcattttgttttacattttaacacaaagcacaaattcagagtcaaatatattccgtcaattcgggttatattttcgtatatattcaaacacct

SEQ ID NO: 31508 - DNA, 1310 bp, Heterodera glycines
tcagcagtggctggcagcagccagccatatccaacctcccacagttgtgaagaagaaaccaaaaaaaggcaattggaatctttcaacaacaaaaagggccccaaatctgccagcaaaacacttggcacttgcctttagaaatgccaacccaatgcttagcagcagcacatccaatcgcgatcatatgacgaagcaaatcgacgaagggaagactttgcccgcccccctccctcggctttgcctcccttcaaataccaagcgccgaagggaaatttggcaatttttcgtaaagccaacccaacccatccttcccaaccatcaaattgtataatactgtccaattttgtgctgccacattgccaacccaatggacataatccctttttactatgaaaacggccaattggaagctctttcctcggcccaccaatggcttaagcaaagcgaaatggcggggccaacctgctcaatttggtccactgggctgaacgaggcgattgcgcgcgaacggttcgcccgggacgcttctttaacagttccgcgaaacaattcgggacacgcccaattggcgttggaaatggccgtgccgccggggggcattttggtgccgcaccatttgtggcagcagcagagacagcgccaccaaatgcaacagcaacaacagcagcagcagcagaagcagcaaattcggcaaagtgtgaagagcaacatcgtcaccaaaatcaacaggcgtcgaaaggcggcgatcattgcgcgatgtgccggaggcggcactgaagccgatctcattttgatgtccgcactttctacagcgaatgccaatggcggcagcaccattgggccaccacagccacaggcacagccgacgattggtgccgtgccctcgggcaattgtaccaaccagttcccaaaaccgacaaagcaacgaactccgacgacagcgaagaaaacaattacagcggtaaaagagccatcgcagaacccacgcggagcaacgacggacatttcggagtcggacgatgagtcggacgtggaggtattcgaagtggacgagaaggaattcgggaacgacgatttgttcgagaaactgaacagactggaggagcgcaaggtaaaattggtggtggacgaattgagggcgaatagcaaaagccaatgccaatttcatcaatctttgcttaagcatcacgacgacgacccaaaagtggcacaatggcgccaaaattttgaaaaagcgatcactgaacgctaccgaaacaaatgccgaagacggaacatgctgtgccgacggatgttggagttcaatttgc

SEQ ID NO: 31509 - DNA, 1109 bp, Heterodera glycines
tttctcactttttcttgcagtttagggcccgtaacttttttttctaaaacccgaatcaaaaagtgcccgctgtgagggcactccgcagaagtgtcctctataatccggtattttttattttttgatcagaccaaatcccggacctgtacagacacggagactcagttaattttttttccccacttcagtaccaggcgaataactcattaggctttgacctgagcgcagggtggccagcagacttattgtagagctttaaaagcccgatttttccaaattttaaaatttcgaaaattttcaaaatttttcgagctaggcctaaaaaacggttttcgggtttttgaattttaggattttttaacaaattttcccagaaaaacgaagaccacttccaaaacatagtttttcgagctctatcgattagtaatttttttggaaaattttcgatttttttcaagaaatagaaaaaatttttggcctcagcgggacatttgagtcctgggcccataactcgtcaggggttgattttagcgaaaaattgacttaggacatttttgtagagcattttaaatgctatcgaatggtgtactacatgtttggaaaatttcaaaaattttcgagctaggccccctagaaattttcggaatttttttttgggttgaaaatgtgggtgtaaaatttttttctggggtattttggggtgctgagcacgaatatgatgtttgtttttcgtttcatgatttttggaattttttaaaaattcgaaaatatttttatttttttggtccttggaaatttgggttaaaatttgaaaattcatatctggcctagggtttgaccaattttgattaaataaagcattaaaaatggagaaaatcaggagaattttatgggttttatttggctttttgtacataaatatgaaaaaagttattctagaaattctgtaaaaattcggattttcagaaaaaatttataactcgcttctgaaaaatattcaggaaaagtaaaatgctacaaaatccgcatttttagctctattttataaatttatttcacatttttatcacttttttgaaaaaggtataaaaataaaagtgattttggga

SEQ ID NO: 31510 - DNA, 1348 bp, Heterodera glycines
  misc_feature (46)..(46): n is a, c, g, or t
  misc_feature (51)..(51): n is a, c, g, or t
attgcctgcaataaaaatgctaattttctaaattcgcgtgtgccancctgnagcacctcccattaaacaccatcttttttgaggcagacaatcaatgaaactcacaacctcgggtgtaaattagaggggctgttagtggaatagaaatgttaaattttttgcctatcaaatattcgcaataaatgcccatctatttaaaaaatattctattctattaaaatgttctgtattttgctatatattaagaatagccgtacatctaaaggagtcagtaattgaacaaatttcaagaaaggttcaggcagtcgccgtaaaaattgtctatataaaaacaatggcgatacgcatttctgcactaggtcctttttcaaaattgatgtgcttttattgaaaaacatgtttaacgggccacaaattaatagacaaattcaggcacattcttaaaaaattctgcttttaattagttcatttaatagattatgcttttgctttgtttttttaaattctacaccgcgattatctgataggacaatgatatcaataaattttcttctgaagaagcgaagagttagcccaaacgttttccttcctttctatttaatgatctatcatttcagatataacagtcaaaatttaatcggccggctaaaaatgaattcggtaggattttatgaaaatagtttgaaaaaattgaaaatttctttcaaagatttaatggaagctagtagaaggatacctttttgagtaatattccagatgttgccaattgtttaatggcaccccatacctcaaaaaagcattattctttggctaaaaaatatcattagaaaatagcgggcgtagatactgaaaaaactgttcttataattttaattttacaattagaaacgccaaaggttacaattatagtaaatgccaaataggttgtaagaataggctcatttgctacaatttagaacagaatgtaatcggcaagaaagggtttttaaactaatttcaatgaaagaacttcataacaaataaattaatgacttttctaaatgaattgcctgcaataaaaatgctaattttctaaattcgcatgtgccaaccttgagcaccttccattaaacaccatcttttttgaggcagacaatcaatgaaactcacaaccttcggttgtaattagtagggctgttagtggaatagaaatgttaaattttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaag

SEQ ID NO: 31511 - DNA, 1588 bp, Heterodera glycines
tcagactgaccatccgttttgacaactcacggcacctttgacaggtcaaggtggacctgattgccacgatcaggcacttgttttttttgaattttcctataaaaaaattctaagatttttttcatggaaaatactgttgagaaatttttatttttcgggggggggggaacgacctgctccgcgtctaatgcttttaaatgattttgagaaattttcaaaaaaatatttcttccatttttcttgaaaatatacaattccaagcattcgtcataaagtcgtttccctttacagttacatcaatttgtgtaacggacgcattcagcaaggtgaaaaaagcttatcacaaggattgaaggcgcctttgaaattttgataatttttcctcataaaacgaaagcaaaattaaaaccattattttatttccattgaatgccaaaagttcctttttcattatcaaagcagacaattcggtgccattcaaaaaaaatccaaattggaatattctgtttttcttcttacagtaaaccgcttcgggttgggtacggtaatgatcgctctgctcgatctgttcgtgctgtccatgtgccttggctcgctgtttctctgcgtgcgctcgttggtcaaaggacatttgttgaaaaatgtttgaaaaataaaatataatttaaattattattgttattatttccaaaagactacacgtgaatacttcgatcgggcatttggcattcggttgagcatccaagacaagtgggagttcttcaacatgtggtacggcattgttgtcgtggtaaggcgtgccgtaacaaaacatacaatgatgaagtccaacatttaaaatgggatcccacgcataaataaaccccgcacggcgggaatcgagaatttgactcgagattgggtctaaaacaagggatttataacgtacctaatagtggttctgaaaccaaaaattctcttaaccacgactctcgagcatcgcttattcgtaggccgtcggtctctatggcgtttttagccttttgctctatgacacccgaagtttttcaccgcactaatttcagggaaacagtcattggaaaacggggaaggtacggcgcgacggtgctgcgacaagcgccgcccaaaattcttttttgcaaatttattagttaacgaaccgccagtataaaattttttacctaactttttaaggagggactggtgctattttgttccgccacccctttttgcacataatatgtacacatgcttttgatcggacaaaacaaaaaagttccgctgatatttctgcctaatttttgaatacacaaacagaacgacctgttgctcatcaccagcaccgtctgcaaggtgttcatccaattccgtgactttgactcgtcggcactgttcacactcaccggtgtactgctcggtctcggcgtgttcctggtgttctttggcctactccgctacttcactttcttctcccagtacaatgtctgttctattatttccataatttgctaattacaacgtgattaccccaactctcaatggacttcttatgtcaaggtcatcattctgacattgcgcaaatcgtttc

SEQ ID NO: 31512 - DNA, 1080 bp, Heterodera glycines
caacagaattaaaaatattggcaattagtgattagccgatgccgtaaagcaaacctttttatgccaaaaaagattaaaatggtcttttaaattcaattgaaaatttaaaagtcatttgttaaagtcagctattctgatttttcaaaaaaagttcagcatccattagacaacgaaggccgaactccgtttatgtgggcagtgatcgcgcagaatcagacggtggtccagcgaatggtacacaatttatttacagtacatatttatgtttgagctaccatttctcgggttacactaacccatttgatatgtatttgatcagttgttggacaaaatcatgggctgcgcggggaaattggtcagcagcagagacattttcaaaaggtatttttggagggatttaaaacaaaaatttaaaaatatcaaaagcataaatcatttttcatggctcagaactccgctgcatttggccgcattggtggggaatttggagctgtgcaaaatgcttgtcaacgagggccatttgaatgctaatgtactgaccaattatgtaattagggagtgcaaattaggccttttcatttttaaaattggaattttgccaaaacattttgtgtcgaatggacacaaatttatttttgtctttctgtacggccatagttttgaggatggggacatgcacggggccacgccagaacacatggccgccgggcaaggcaacaggtcggcacttcactttggcattttgggggcgagcgccggagggcgacggcatcgttttaataattttatttgaatttaaaaaatgttattcgcttaagtgaggtggtcctttggttcggttacattcgcgggggccacgtcaaaccgccggtggatttaattgacaggcgccgaaaaataaaaaaataataataatgattttattgtttttctcaggacaccctttcattacgcgtgtctcggtggacaagcgaacacagttgaagcgatggtataacacatttggagatgaccaattcattggtcaaatactttcttcatttattaatggccggcactttttctgatcactaattttgc

SEQ ID NO: 31513 - DNA, 2105 bp, Heterodera glycines
  misc_feature (2081)..(2081): n is a, c, g, or t
caaaaatcctgggtcacccccctttggtcacgaacccccctaccagttttatttttataaaaattcttaaaaaagtgatacatatgccaaataaaatttatataatagagcaaaaaattgcggatttttgtagtattttactcttctctaatgacttttcagaaccgagatataaatttttttctgaaaattcgaatttttccagaatttctggaataacttttttcatatttatgctagaaaatccaaataaaacccataaaattctcctgatttttctccatttttaatgctttatttaatcaaaattggtcaaaccttaggccagatatgaattttcaaattttaacccaaaatcctgagggccaaaaaaattaaaaatattttcgaatttttaaaaaattccaaaaattctgaaacgtaaaacaaacatcatattcgtgctcagcacctcaaaataccccagaaaaaaaattttcacctccattttggcccacaaaaaaatttttgaaaatttctagggggcctagctcgaaaaattttgaaaattttcgaacatgtagtacaccattcgatagcatttaaaaagctctacaattttgccctaaggggttttttcgataaaaccaacccctaacgagttatggagccgggactcaaatgtcccgctgaggccaaaatttttttctatttccgggaaaaaatcgaaaattttccgaaaaaaataccagtcgatagagctcgaaaaactatgttttggaagtggtcttcgtttctctgggaaaaatcgttaaaaaatcctaaaattcaaaaacccgaaaaccgatttttaggcctaactcgaaaaattttgaaaattttcgaaattttaaaatgtcaaaaaatcgagctttcaaagctctacaataagttcgctgaccaccccccgctcagatcaaaccctggcgcggtattcacctggtactgaagtgtactttttgagcacgcttcagttgccattttttgcaggccaggggtttgctcaaaaaaaattttaaaaaatacctccttgtagaggacccttaggcggagtgccctttcagcgggcactttttgattcgagttttacaaaaaaagttaggggccgtcaaacgcacgaaaaaatgagaaatcagtccctggtactcagttggcgctcggatcaaaaaacctatagttttcccgaattctcctcaaaaagttgtaagacccttccactactttcagacccgtcccattagccgttaagctcaaattagtttttgaaacgaaactcaaaacctatataacgtatatataactagcgtgtggcgcagcagttgctcggtgtagacagtatacttgtgagagatgaaaagaatatgcattacatgagcgcttcgcgcaaaggacttcgttgctagtgcatgctcagcttcaaaattcaaaattttaataggcttatgttttttcaaaattttaaaggcgacatttgcagctacgcggcctcagacgggcgcttttgcgtccgtttcttaattttgtttgcttggacgggcgcttcgcacccgatttaaattttgttggggccaaacgggcccttcacgcccgttttttaatttgttggaaattttcggcagcttcgtggccttaggacgggcgcttcgcgcccgttttttaattttgtggtaatcattcggccgcttcgcggcctcaggatgggcgcttcgcgcccgttttttaattttgttgataacattcggccgcttcgcgcccgttttttaattttgtggggccagacgggctcttcgcggcctcaggacggcgcttcgcgcccgttttttgattttgttgataacattcggccgcttcgcggcctcaggacggatgcttcgcgcccgttttttaatttttggggggaattcggccgcttcgcggcctcaggacgggcgcttcgcgcccgttttttaagtttttgggggacattcggccgcttcgcggcctcaggacgggcggcttcgcgcccgttttttaggggtacaacagtgattcattaaattaaaatgaaaatttttttaacaaantttaattaagaaaatacatgaaat

SEQ ID NO: 31514 - DNA, 1247 bp, Heterodera glycines
tgatggagccgccctttcttttaccttacgcctttgcttgacaaaattccatacgatactttaaattctgcaatacccaaataatgacatttctaattattcgacttgtttccaatatttataaggatgtattgctatacgtttattacacacatattcgctaatcggatataatcgaaaaacattacacacaaataaagcgagtatcagaggcacttacaaaagccaaggaaatgtgtacaacaacgaagggaggggggaataacgggagagaggaagaagaacactcattcatttggaaccaaaaagagtaacttggtttgggttatcgcgacacacagtccagagaacacagagaaaaccttaaatcatgagaagtgaaactcgctcctttggtctacaatctttcaattcgtaatttatcatgagatagatgagaggaactttgtatgctttcggtatttccctccatttagcgaaaatccatcggaatcgcggataattaacgaaattagtttgatttcatagaccaaaggttcaaaaataaattagcaaaacaagaaaaatggattagtcttctctgctaaacaatcggttttagttataacagtaaatttcaatattattctgttaaaaaatgatgaacccggtttcaacctgttatcctaaaaccgaaagtggtaaatgcttaaatacagctcattttcacccgatgttcgatttgtatagtaaagtgttgattaatgaccaaaaaagtaggacgaagcgaagcgcacggtccaaaaaaggaatttgacttgcagaagaaaagaaatggtccaaaacgcccactggccgacgatgcgccaccaattgaacacaatccgagtcccttcgtcgccgggggtaaactcgccgtttttgtagtaattgtctttaagagttgggtcaaatcactcacaattaataggaagcacaaaacaaaaacatttcggtcgttggcttacccaaaagtttgtccttctcagcatacaaattgtacagccaatcgcgaagagcaacatcattgcggaaaggcacttgctcagcgtcgaacattcggtagtgcactgcgatatcacctgaagagaggcccaatgggacggagtaataaacgaaacaacattgaacatctccccgtctcccccccccccctccccctttgttccccaaacccaaacagatattctagtcatgaatattggactgtccccgaaggtcacaaccat

SEQ ID NO: 31515 - DNA, 1237 bp, Heterodera glycines
tttttagttacaaaaattgatcccaccaactcgttttttacgaatttatcagcaacaatcaaatataatgccactgaaataacaaaggccaacattgggtcacataatcgcatcaataaccaatcaatcaattcatttccgctgttctgatcagtgatcatcactcggcccgggcgaaccgtcgagaagactgaaaagaaaaaacaaaaataagcatttggatttttaaaattgttaatcacccatcgccgaatccgtcgtctccgataaaaatgttaatttggttccatcggtcgcccaattccttattcatttgctgctgtctcttatcatcgggcacaattggacaacgaatgatggaaaaaccacttaaatctgcttcttcatcttctttggacagtgccaatttttctccggtgaattcgttggtcaattcaaatggcacaacggcagaaagtgaagaggacggcggaattaaaacagaaatgccaaaagaaacaggagaagaagcagaggaaaatgactaaaaaacaaatatttagaaaaacgaattaaattagacaaatcaccgctttgatttgttccacggttgccgaccattgttcttccatggttgaattcatatagcatatgagctccttcggaaaattatcgtgacgaggcgtgaacagccatttggccaccgcttggccatccgtcgcattggcactgtcgtcgggcggaaattcgagggaaatgccgttgcttaaattgaaaaagcgaagtgatggacagtcgttgagcattgacggggccaattggcgcattcgacgaaaagcgatgatgtccaaactcagctgataaatggtatccttgaacatcggccaaatggtgcgaacaacgaactccgaaacgcgaacatttccagtggtaatggacaacattgttgtacatgaagcgaaaaagcggtcaaaacggccaagaaaactgatcacattttggttgatgaatctgaaaattagaagtgtgtgattgaagatcacaaatcatttccaaattcaattaaatttttacccgatcgaaatgcttttgaatccgatgactttgttcggcaacggattttgagggattggcaattcttttccatcggaattgacaattttcattttgcccaatttccatttgcgcgttttaaaatgttcgtcgacgtaatagtcaaaatggcggctaatcatagcaattccaaggccaagtgaaa

SEQ ID NO: 31516 - DNA, 921 bp, Heterodera glycines
ttgaaaaaaaaaaaaataattaggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggagcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagtctaaactttttggcctgtttaaaaaggaattaaaaatttttaaaaattttattcatctccctttcccctgaaaaagcatcagagtgcctaaactaacatgtaaatactttttggtgcgtttcagaaccctttctgaaaaaatatttataaattaattatgcaaaaaacaaataaataatgaactctcttccttaataattttcctgcaccgaaggtactcactcggccgcttcgcggcctcgtggtgggccttcg

SEQ ID NO: 31517 - DNA, 1586 bp, Heterodera glycines
  misc_feature (818)..(819): n is a, c, g, or t
cagtccccccgaaccgatgcgcccagatttatggggcattgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcattttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttnntcggggcagtccccctgaaccgatgcgcccagatttatggggagaccgaatccttccggaatagcttccctatagcctgtactttaattctgcggtggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgatttcataaatatttttttcagaaagtgctctaaagcgcaccaaattttatttacaacttaattttagcactctgatgctttagtatcaaaaaggaagatggagaaaaaatgttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggg

SEQ ID NO: 31518 - DNA, 488 bp, Heterodera glycines
aataatcagcaataaagtaagtaatcaaatcattttaggtaattgcctgaacagtgagattttatatattttagcttcgattagactttgtcatttcgaatgatatcaaaaagatagggtttgttcgagcatgaacaaagttattgtataaaaacccggaattgtcaattgattggactcataaaagtggattggactcataaaaaccactagagcccaaaaaacttggtctgacgccaaaagtcggcgccaaaagacccaaattcttgtaagctatttttgttttccttaattttcagtgttgacaaatgatgaggccagaacaaaacgtgaaatgcacttggacaaaatcatcgactggaaggaaattgttgacatttattatcaggtggaggatgaagcatgaaggggctaattaaggcagtgagattaggaaattctggcgaaaggtgccaatagggagagacaccaattatcaaataattact

SEQ ID NO: 31519 - DNA, 1339 bp, Heterodera glycines
  misc_feature (27)..(27): n is a, c, g, or t
  misc_feature (35)..(35): n is a, c, g, or t
gtccttcagacgactaatgattgcgtnttgttctntaattgtattttctttatccatacagagagaccgctgttgctgaataacacaaaatgttgaaccaattaaataagcatcattaatgaaaaagtttttgcgatattacctccaattcatttgcgatgtactccgtttgagttttaaacttctgctcaacctcggcaatcatttttttgttattttcctcggaagtaatttgtcgtagctcgacaagcgtagagaatttatcacggaaataattgtcgacagattgagccaactcggaactttgaagacaatcgacgatttttcccaattctttgacgtttagacgaacagaagaaagttcctagtgcaatttctaacaattaagagaagagcattaattaatttattacctccgaaaattccttgagactcttttgggtgtttgtcatttttgaacaaaattctccgcttagatgactttcaaccttcgatttttcatatcgctaaataatgggattaaaataaataaataaaaccaaaaacaaagggagtttttcaatggaaaatcccaaatgctttgagtttctgagactcatcgtcagcaattaccttttcttcctcttctttccgagtgaattgagaatattcctgctcacgacgcattgttttgggtctaacaattttggatgaatttggctggagaaacttaataaatgaaaaagccaataaaaatgagggaaaaatgaaattgcctgtttcacatttacaaaacgacccccgcaagttgagcccaaactgccgaaagtgtcgtcgggggtgctgaactgatttgaaccaagggactcgatcgggtccatcgcgatggaatgcgaattggagggaattgcaatcggagcactctgttgacgaggggacagcgaactccgattcatttgctaaagcaaaagtgacaactcaaacccatgtcacagaacacaaatcaccgtgaaatatagtcaaataattcttaccaatttgttttcctctcgaatttcaatattttctgttttgggccttgaaattgtgtcaaaatgcactcccaatggtccaagttcccgtggcgattggagttccaatgtacttatcgaacttgtcgacgttgagaattcacagcccctttggtccattgtcataaaattaggccctccactcggcgatggcgaaaagcccatgctttcctcgctgaaaagtccagtccaaatttgagtagctcgtttctcccagccagttctctcccgtctcagtgacagaattattttttaattagttttcaaaattcattttatagattttttaa

SEQ ID NO: 31520 - DNA, 1017 bp, Heterodera glycines
ttctaaaaaggatgtaaaaatattttcttgcgtaatattttttacattatgttgtgaagaatttgaggctgcttctgatgcgattgaaaatttttcagctttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctg

SEQ ID NO: 31521 - DNA, 1731 bp, Heterodera glycines
  misc_feature (70)..(70): n is a, c, g, or t
  misc_feature (85)..(85): n is a, c, g, or t
tttcaggcatgcgattttgtattgtgcttgccatgaccattgagttggcactcaaagtcgtggcccatgnccttttcttcacccncaaatgcggtggtgcgcgatgttgcgggcgtaatgacactatttatctatgcgagtcatttttgtttctgatttggatgccgaaccatgtcgagcaaaactcattggcacaactgctgatgatattcagggcaatggtcagtggtgaagcttaaaagtaatcgattgactgattgattattgttgctaattgattgtcggatgcaaacaaagggaaaagcgacgcttttccttttccgacaaattgcgattaatttgatttggagagaaggctgaatcaccgaatgggggtcatggcatttcgtacaattggcagttcgtacaatggagtttcgtacaatcgggtggtttcgtacaatgggactttcgtacaatgttccaattgcggatttcgtacaaaaaatatatataaagtcgattttttctttaaaaactcatttaacgacttgtttttattgccacttttgtgaatgtttgaaaaattaacacaataaattgtatttcctttcctaaaagcaagtatttaagttatgaaataattgtcgaaaactttcgttgaccaagttcagttaagtgagcaaatcctccgaaaaagccccgaatgaattattattgtttgcgttattaatattgttattttggatactcattagctcattacttatttataatttgcttatttttgtcattttgatgaaaagtatgtgtcgctgtcactatcacttattttttaaaatttaatattgtacgaaacgtcaaattaaaacgttgtacgaactgccattgtacgaactgctattgaccccacagaatgacacagcaccactcactcgctcatttgctgtttgttcagcgtcctcttcgcatttacactttggtgccgcacattcgccgcgtggtcgtcgaattgtgcaagggatttcgcgaaattctgttggtcaccattctgctggtgctgttcatgttcatgttcgccagcttcggacttcaaattgtcggcggcaaattggccgcttgtaacgatgtcaccataacaaataaagtcaaaatgggaaagaaagaaaagcaaatttaaaaaatataatttattcacttcaattaaatgatgtaaaaataaaacaattcagaaaaattgtacgggattattcgagcaacaattattcgtcacgcgaatggaagtttatggaaaggcaagggcaaaaggagtgcaaattttattttaaaatggaaatatttattaatttaaaaagattaaatttatttattaaaaaatgattaagaatgatgagcagatgcatccgaaaatgcttgttccgcgagtgtggtaagctcaataattcgttgccattgtgccgattccaatgcctttgtctcttttcgcgtgcttttgactgtttttttcaattcgaaaggaccaacccgcgcaatttcaatttcgaccatattggcaattcgatgttggcactgttcgaaacattgtcttacaaagggtggaatgtcatccgcgacattttgtgggccagacaagtgagtctttggcaattcattcatcagtgaagctatgaacaaataaccaaccaaattaggggccgtgggcggtcttcttcatccacgtttacgtgttcatcggctgcatgatcggcctga

SEQ ID NO: 31522 - DNA, 1039 bp, Heterodera glycines
gaccatctagaaatttacaatatacatacaggagataaaactagcaaagactaggcacaaatacaattaattaatatatgtaaatgaccggccgaatcaaaggttggtaatcgagcaaagaattttattttgagtctacatatttaaattaataataaattagattatttattttatgaaatattaaaagtttttgttaaaaaaaataattgttatcactgacgaaatcacttctgaccaaatcacatgttaccatatgaataaattgaagtatgaacaattttcatgcatttcaacaatcttacatttttgtgtgaccataaacaaccaaaaaaaattttatacatcaattttttatttgaaaaagttgattttttaaaaatttgttgatgattgaaaacatttagaaattttgaagaatgttatgttagcccttatacaaaacaaattttcctgtagaaaggggcaggcccgttaagtgtcagaattccgaataaatttttacgattttttaagttttttcaatattattagagtggtggttccaattttcaaaatgccagcaatttctttgtcagttaaagaagcattaccattcttcatttcataataatcattaattttgctcattttttcttcattgaatatcgaattccatctaaaataaaaaagaatggataaaaaatctaaatttaaatttacttttgctaatttcaataccaaattcctttttccattttcttaatgtatctttgccaattcccaactctttcgcaaattgattctgttttccatttttaaacattcttttaaactcgtcaatttgtttaataaattccctttttttcttttcataataattttggtcattttttatttttattcctaattcttttttcatttataaatttttgtctgtttaattccctattttttgctaattttttgttctattttaatccaattttctcgcgaatatttcccattttcttaattctttcttttattacgtggaatttgtggacaattgcgcattttt

SEQ ID NO: 31523 - DNA, 1017 bp, Heterodera glycines
  misc_feature (902)..(903): n is a, c, g, or t
cgcaaacttggtaccaacattttccttctctagtctccgctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacattttccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctgnnggattgaccgcaaacttggtaccaacattttccttctctagtctggctctaccaaacactcacacgatatttgaaatgctaacgaaaaaaattcttgccaaaaaatggctatct

SEQ ID NO: 31524 - DNA, 1203 bp, Heterodera glycines
acacaaaaatacaaacccccgaaaatgggaattttttttttattcgcggatgtacaaaaaaattaaaccccattattcttcccaaaaccctctccgaaaaaggacagtggaatgcctaaaattttttttcagacaagacacaaaaattcaaccccagagataggggattttgtttttttttcggagatgtacaaaaaaagttagaccctattatactgcacaaaccgctccgataaaggacagtggaatgcctaaaactatttttcaggcaagacacaaaaattcaaaaccactgaaattggaatttgttttttattcgctgatgtacaaaaaaagttagacccaattatactgcacaaagaccgctccgataaaggacagtggaatgcctaaaactatttttcggcaagacacaaaaattcaaaaccactgaaattggaatttgttttttattcgctgatgtacaaaaaaagttagaccaattatactgcacaaagaccgctccgataaaggacagtggaatgcctaaaactatttttcggcaagacacaaaaattcaaaaccactgaaattggaatttgttttttattcgctgatgtacaaaaaaagttagacccaattatactgcacaaagaccgctccgataaaggacagtggaatgcctaaaactatttttcaggcaagacacaaaaattcaaaaccactgatattggaatttgttttttattcgctgatgtacaaaaaaagttagacccaattatactgcacaagaccgctccgataaaggacagtggaatgcctaaaactatttttcaggcaagacacaaaaattcaaaaccactgaaattggaatttgttttttattcgctgatgtacaaaaaaagttacacccaatgatactgcacaaagaccgctccgataaaggacagtggaatgcctaaaactatttttcggcacatcacaaaaattcaaagccactgaaattggaatttgttttttactcgctgatgtaccaaaaaagttagacccaattatactgcacaaagaacgctgggataaaggacactggaatgcctaaaactatttttaatcaagacacaaaaattcaaaaccacggaagggggcgcgggggggggggggttgtacccctaaaactcggctcgtctgcctaattcatcattaaattttgagaaatcgtggaaa

SEQ ID NO: 31525 - DNA, 946 bp, Heterodera glycines
ttttagaaaatcaaagcaacaaggctttctctcactaggaaagtgctgtgtgtccgaggcaacaattcccacccccccccctcccgccatgtcgcccgtccattttttaataaaaattttccaagtttcgaaatccttccgtcctccccccctcacccggcgccacttactcaagtgtgtccaactcgtgcctggccaatgccatgccggccaacagattgaagcagtccgttttgaacaccgccttggccatcagttcgctcattcggtcccacttcttctcgcacgcgtccaacaacagctcaacagtggccacaatgtgcaaattttcgcccaattcgcgcgcgcacatttcgcgcaacaccggcacagttatgtgaccgtcgtcgccgtcgcggcatttgtcatttccggcaaatttctgtgtggggggaggagaaaacggtgaaaatggagaataaaatggacggaccaaagcgagcattttgaccccgtccagcaacagtttgcggttgagttggccctcttcgatgagcgagttgagcaagtccagcccctgcttgggcttatttgtctgaagcaaataaagtattttaagggtttctttcccccgcctcgttgtcccttttactttgtacaattcgaccaattgcaaatgcgtgtcccgcacaattcgctcttgcaaatggtgcgattccgttggcgtcaattccttcccaaatcggccaatttctctttttggctctccattctcttgctgctgctgtgccgtatgttccctgctcctctcctccgctttattgtgcatttcctttgtcccctccggcgtcctccaaaacgaatttgccgtcctgcagcgcaaccacccgcttgtaccgctccatcttgtgcttgcgcataaaatgctgccctgtaaagttgggaaaatgggaaaatttgggggggg

SEQ ID NO: 31526 - DNA, 1442 bp, Heterodera glycines
  misc_feature (57)..(57): n is a, c, g, or t
  misc_feature (93)..(93): n is a, c, g, or t
tctgtccagctgattaaactcattcaatggcatcaatttcgaattttcttgctcaantttatgggaatgaaatcaataaataattgatgtttntaaaattggttttccgatgcattccttataaatgaatttggtgacaaataatttgaaaatggattttttgttgatcattaattactaatgatttttgctgatttgtttaattgctggcggtgtcttcttctttttctttttgctgggcttccaactttttgttctcattttcatttttcattttggcatattttgttgcttcatattgtgtctggtgactacgtaaatgctcccaaagatggaaggttgaacttttattttgaattttaatttctttaccacaataattgcatgtatttgaatgttcattctgcataaaatgttcccaaatttcgcttttcttaggctaaatttgtttttttatactatataaatattaaagataaatggaaatattttaattattatctaaaattaatccaaaatattaaacagaaagtttgttaaaattttcataaaaaataatgaatattttaataaaataagcatttgatttttcgaatttttaaaattaaattacgaacccttcgtatcttttttttaattatttgagatgtttcactcttgtgaatcgcatttagagatttcagttggtcatttggtcttttcaatttgttgtttttgtcatcctcttttttgcctttccattcattgtcatcaattgctaaatcaattagcattttaataaaagatatattttaaaataaatttttaatactcatcggttttcaatatattaaaaattgttaattttatatatttttttgattttgtgtcaaattatcaaaatgttttaattagttattttcaatcacactttcatgagttttatcattctccgtttgatcagtatattttaaatgatttccaacaaattcgactccatcaattgtgggcaaatcagtgatcggtgaaaattggtcccaaaattcgtcaccaagataaacatcaccaatgatatgatcgtcatttttatgatcaatgccagcttctttttgtattgtttcttgcctattttcttcatcattaccgtacacaaagcacaaaatgacaattagtatactgtaacgcaaaaatgggtaggccatttcctgtaactgtaagaaaaaaaaaatcaaaaattcttatttaaaaaaaaataattcttttatattttacaatacgtatgtttctatcgtagaataagccaatgtgaagagcaaagatggagaaaaaaaaattgtaaattttaatgtataacttttttatgagtataataaaatattgaaaacttaaaaatatattgccatttttgaatagattgatcaaattattggttatttatgatgcgcttgacatatattttttta

SEQ ID NO: 31527 - DNA, 1793 bp, Heterodera glycines
  misc_feature (159)..(159): n is a, c, g, or t
gccgtgtcggctctgcacaaacggccggtcgccagcgaacacagagcgcacagcactgtgccggacccggaactgccctcaatccgccgtccatttggcctccattggacggtcacattgttctcgtcgaagaaattatggccggcgacggacaccaancgttatggcgcacataggcatcgaaaaagccattccatgcatcatcgtcatgatcagtgagcaaattgaagaggccgtaccggttcgttaacggttgtcttggcaacagccatgcaggcaaagccttgaaacatttttatcaaatgggaaaaaatttcaaaaaatttcttgggttttaaaaaatttatgaccagaaaattacaaagttggtttctaaatatttttggccgtagatttttttaaaacccaacgaaattttttgaaattttgcaggctaatagaggattcttagggctatcgaataatgcaaaaaatgtttaatttggatgcttcttgaaaaagttattgttcactaaacttgcaaaaaattttatggtcgtgtttttttatggtcgtgtgaactgcaatagagccaaagcttgacgtcttaacgtttttgttttcgctaattatgctatattactcgtgtgcggaagcggtgccgggtgcgtggccacatgcactccaagacattggccaggccgattagggtattgaccaaagatcgtcccctggtgatcttccttgcgccgaatgtggtcggtcacccggaccaggttaggacgtgcaaattgacagtttgggcgacttaacaaaaaagagtggccataagataataaaatttatgcattctttacttgcagcggtaaagaagggggacattggcattggcattcataatgattaaaaattttatgtaactgtaatagacgtttaaattagggattcaatagctttgatgtaactataaaagaattcgatcgtttttattaggtattaagttttgttgctgatcagaattggccgcgtattgaggatgcgcacattttagcataatgtgcagctttaaattcaaaacaaattcctcagggatgcagaaaacggcgatgacgttgaaatgagaaaaccattttttcggctctaaacagatttttggcatttacgcaacttaaaacctattttttatgcttagctccttgagtcgaatcaattgataagtcatttgtgtaattttttgcgtttgactaacatacttttttggggaaccgctcaactcgccgcagtttacaaaaaaagcagataattcatgtaattatttgaatttccctgaaaattcaacgacgcatggaaattggagcaggcgttgctgctttgacaacccaaaaataacataaaaatgaatttatttctacttttaacacaaaactgaattagtttgtttttttaactttcttaatctcactggtacctgggaactgaaccacttactgcattagttagtacctccgggggttctatttttcaactccccgaaagaggggttctaattcagtaagtaaagtatgttttttttcttctatatcggttatatttgtataattatgtcgaaaattttggtgcgaaacaatcttaaaaaaggtgcagcgagttggactgcgcggagtttactcaatggcgagaaaattgcggtgagttgtcccggtgtacagatgcaatcggtttgactttgttcttggatttaaatgtactccattttcaatacttttataagttcaaagcgcaaaatttgctgatttatgctgattttttcttta

SEQ ID NO: 31528 - DNA, 1080 bp, Heterodera glycines
tttattttttttttggtcatggaaagatatatggatttcggtaaatatcttcccacaaactcacaaaatgaatgagagagtgaaaatggttagaatttttttaaaaggcccccccaaaagtgagaaaattgcaaattatggggggcttttccccctttttttagcagaaaaattggggtttgccccccagaccggttttttctgggctggtttcccccaaataaggtaaaacttcttgaaatttcattttttttgggggtttcctgaatttttccccctcatttttcaggtttttttcccctggtaaacccctgcaaatatttggtgcccccccctttccctgtttccgatgttatgcaaattgtttggcgttggctgcaacttcattcggatcaaaccttttatttgttcgtcatacaaaaaagggggtggtttgaccttagagcagcaggccccccccccccccccgaaaatttcaaggaaaatttttttttgaaaaaaataatgaatttgcaatttttaaaattatttgttcatatttttagggtggtcaatgagaagtcgtgggtgaccatttcgatgacagttggccaggtttggttttgttttcgtttttcaaattttcgacaccaaaaatttgcatttgaacaaattaataacattttttcagctctacgatcaggagaaggatgaggacggctttttgtacatagtaagtttcttttggccaattaataaaaaactatttcatacaatttggtgaaaaaaaaaaatttttttttttattgggaaggggaagggaatccgtttatacctccccaaattcgggatgttttaccaactaatactcatcttggcctccgcgtttttcggcactgataattaatttggatgaattatctatcggcaattaatgaattcaattgtttcaggtctatgcaagtcagcacgcctttggatgatgccgcggcacagaaaacagcgatgaatggcacggggggcggaggagaatggattgataaaagtgtaaatacctaaatacaaaaccaccaaaagacgctgtgtctctctcacaatcag

SEQ ID NO: 31529 - DNA, 1067 bp, Heterodera glycines
tgagtgttagtagagccagactagagaagcaaaatgttggtatcaagttggcggtcacatccccaggagagaaaagagatagacattttttgggcaagaatttttttcgttagcatttcaaatatcgtgtgagtgtttggtagagccagactagagaaggagaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttgggcaagaatttttttcgttagcatttcaaatatcgtgtgagtgtttggtagagccagactagagaaggagaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagagacactttttctgggagaaattttttcgctagcatatcacatatctcgtgagagtgtgtgagagacacactatagaaa

SEQ ID NO: 31530 - DNA, 1010 bp, Heterodera glycines
tgcataaatttttattgtaaatagtcacaaaaaaactccccctttactcccaatatctaccagttatcatacaaaaaggcaatagttaagctttgagatataaaaaaatcgtctagaataattatctaaataatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcagaaattatttttacatcctttttagaaatgctgcataaattattattgtaaatagtcacaaacaaactttttttcactcccaatatctaccagt

SEQ ID NO: 31531 - DNA, 1213 bp, Heterodera glycines
ctgcaatgtccgaacatattccatcaatttgtcagccgataaatgacccaattctgaaaaataaaatgcaaagtattccatcggttggtgatgaccattgaccagcttcacatcctcgggatccaactcagttctgaaacgtgaagcatttcgttccttttcctcttttgttttcgtcgactaaaatcaacgaaatgcaaaaggatcttttaagaatcggcccaccaaatactcgctgtgcaaattccacgcccctggcaaaggttctttgaaggcaattggagaatttgtgtccagtctttcttgacaaataaattctggaacgttttgttgctgtcgcaagtcattttgtcggtccatcttagaggaatgatttaaaaaattatatgtttgtcatataaataaaagaaaggaaaatgcaatagagggggggggggggatgaaagaaatggatggaaaaagagtgagagagggggaaaatgaaataaaaggtgggagcaggaaggaagagtacgagagagagagagagagagagaaaagagagagagagagagagaaaagagagagagagagagagaaaagagagagagagagagagaaaagagagagagagagagaaaagagagagagagagagagaaaagagagagagagagagagaaaagagagagagagagagagaaaagagagagagagagagagaaaagagagagagagaaaagagagagagagagagagaaaagagagagagagagagtattgtatggggagagagcgaaacggtgagggaaagattttcaaaagtaattttttccttaatttttaagctggaaaatttcaaagcatcatacgaccgtcgtctagtttatcaggaaattctgattactgatgcattttctcgtcacgccgcgtcaattcaaactttattttgagtttttcgttccctttcaaaggtacggtaaggaatcatcgcttcatcttcaaatgaaaatgattgttttgacctgaatatgagctgattccgattattttgccgttattaaaaattaataacttttaatagatcaaataaaatttatttgcttaattatgtaagtcacatttttaattatttcctaattaaatcaaatttaaaataggtgcatttaattccaacatattaaggtttttcccttgaagagtttttttaagagttgttgttagcttggacagtg

SEQ ID NO: 31532 - DNA, 1418 bp, Heterodera glycines
ctttaattttggttcaattaaaataagataaaataaattatatttttaaaattaatttttaagcatttcccatccaaatagggcaatctaattagcatcgttggaagctctggagaggaaggaagaaaaggcattgaatcgaaatggaatttatgggatatacatatagtgagatgatcggaaattggggataaatggcactttgctaaatgattgggactgggcgataaattggttaatttgaataatcgattgatcggaatagggaggaaatctttaactgatcagcagggattgaaattttcattatttcacttcttcttctcccattgtttcacattccacttgatgatccttagacaaaaagacttttttttacttttgtctaatttttgggattttatgactttttagtcgattttttaaagtggtttttcgtgatttaaaatcacaccctttttaatcaaaaattactctcgtcgtctaccctccctccctttttgtgtactaattcgtggttccgaattttttggcattttgaaattaaattgtaaaaattcgaaacaaaaaactcggtaaagatttttttcacctcacaatgtttataagtaccaccgtgaggcgggacagttccaaaatttgtaccacattttactgcggaatgcccaagtaccttaactggacaatttcttgtcaacgaccacactcgcctttggcgtcttatggaacagaaaagggtgaatatcagatggggtgcgtcccttcctaaaaagttctcttttcgcctacccctcccattcttgtgcactatttcttttcataattggtccaaatttttttgctttttttgaaatttaattgtaaaaatatatacgaaattctttcttttcgatttaaaattgtgcttctcaatgtctttaagtcccaccgtgaggcgggacagttccaaatttctaatttgaaagcttttttttaaaaaaaaaagatggtgcattaaagttgtcaaattattttttcaagggaaaatcccttttaattgcgtatttggcgttattatttctgaaaaacgtaaacttatttgcactgtaagccggaaattgggtaaacccaactcatctaaattctaaaccaaactcatccatgccaaactcatccatgcccaatatctatatacccaactcatccatgcataaaaatgccacggaccagaccgcacaatgcaaaaaattgtacgatcaagaccgcataagaaaggccacgactaagaccggacttgggtttggatgagttgggcgtgactccccaaaattgactcatcacttgtgtttaagaatgtatcgaatccgtccatattttcccgattttccggtgcaacctgaacacattctttaccgcttatcttgtcaccatgccattcc

SEQ ID NO: 31533 - DNA, 2173 bp, Heterodera glycines
  misc_feature (903)..(903): n is a, c, g, or t
  misc_feature (945)..(945): n is a, c, g, or t
catttggcctagtgttttttaaagtcaaaaacccatgtctttataatacgcggaatagtcgaaatccatttttgaatttggtcagcaaagaatttttaagaatgaacgtggaaatgaatagagccgcattaccccgcttaagtttgctcctccttttgccgtgccattgcgattggctcctccctcagcacggctgtgattggctccaccttcagcccgccacggacagcaaacaataatgtgaatgattgatgggggaaatttgaatatgattttgtctttctgtgccatccctcccccatcatcgccactgttgggagtgggcaaaagaaatttttttctcaatttcgttggatgattgatagggaaatttgaatatgcctttgcatttcggtgcgcttctcccctgccaggcaccactctgttattgcccactgcgatgggagggcaaaaatggactgaaagaaaatgaaatttcttcgcgagtttagttttgattgacagttcagtgtcataaaaaaagaaaatttgaaggaccaaacggaattgtcataaaaaattcaaatgcgaaggacgaaagaattgcgattgcaaaaaaaacaaaaatagtaacgatggacaaaaaatttttgtgcgtttgtgcacaatttaaatgagaagaaaaaacttgtgcgtttgtgctcaaattatgttgggcaaaaaatgataactgaacaaaaaactttgtgcgattgtgagcaattatgattgggcaaaaacatagcaaaaaacttgtgggtgcgtattttgtggaagaaatatgatgaaaaaccagaataaatagagatgatggtcgactatcagtcaaaatgggcagattattaaccaaatgagcattagtttttgtgtaaaaaaacatgtttnttgtgagcattttggtttcggtttgccgtttgtggggctatntaagacggtagaaagttattgtgatcgtcattcgagcaaatggacgtaactcttcccgtcagcaactcagttggtgaatggatcggtgaggaacggggggatggcagtgttgtgctctatgcgccgtggacggacgtgtggcatgtgcagcaacaacaacaacaacatcaacaacaccaacaacaacaacagcaaaacgaggtgcagcagcagcaacaacagcttgtccggcgaacaggcacggggtggacgcggtttccagcatggaacgaaccgctcgttgccaacgattggcgagagaaggaggaaaatctgatccaaaggaagcgactacagcgtgaaaacccggtgtattgggcgcgaatattggaggaggaaaagcgagccggtgaggagcgccgcttaagggatttgcggttggagcacacatgggatggctacaaggaaggccacttcgagcgtcggcacaatgacggctcgttttttgaggccagaaaatttcttggttcaaatcgacagaatgacttttttcattttcagtttgttgctggggtcgggaagacagtggttggaagttctggaggagggctttggtgaatgatgttggcatgggattgaaagtgttaagattaactatgattggggatggtatttgacattaatcgctgataaataaatttttcgttgagttggaacaatggggaagaggaggggagggttggaataagttggtaaatgttttttcacagaattttgggaacacattaaaatataataaatgctcacgaataatattggtccgcatagtgcatcgactaacattatgccagcgtcaatccccctcccgtgccggcaacataagccacacaaaatagccaccaatccatccccatcccctgccggatgttggcaactaaagccatgcacccggcctatcaatccacagtggtggcaacttaagccaccaatccctcagcccctgcccggtgttggcagttaaagccatacacccggcctatccatctgcgggtgggaagcaacgtaagcctcccaatccctcctcagcccctgcccggtgttggcagttaaaaccatacacccggcctatccatccgcgggtgggaagcaacgtaagcctcccaatccctcctcagcccctgcccggtgttggcagttaaagccatacacccggcctatccatccgcgggtgggaagcaacgtaagcctc

SEQ ID NO: 31534 - DNA, 1633 bp, Heterodera glycines
tttcaagtgtccgtttggggtactcaaacatttatgcggagcaaacatccaacgccgaattaaagtacagactatagagaagctattcccgaaggattcggtctccccataaatctgggcgcatcggttcaggggggactgccgagaaaacaaaaaaatcgattttttcaagtgtccgtttggggtactcaaacaattatggggagcaaaaatccaacgcagaattaaagtacaggctatagggaagctattcggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccatctatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatctttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcattagcaaaaaatatgagtgatcgaattttcactaaaaaagttaagcctacattttt

SEQ ID NO: 31535 - DNA, 1506 bp, Heterodera glycines
  misc_feature (103)..(103): n is a, c, g, or t
  misc_feature (1055)..(1055): n is a, c, g, or t
  misc_feature (1057)..(1059): n is a, c, g, or t
  misc_feature (1079)..(1079): n is a, c, g, or t
ggcggagaggccgagtgagtaccttcggtgcaggaaaattattaaatttaaaaattttttaattgctttttaaatatgccaaaaaatgtaggcttaacttttntagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccacgaaccgatgcgcccagatttatggggagaccgaatccttcgggaataccttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccacaaaaaagggagtaccccaaacggacaccatcttaaaaggacngnnntggggcagaaaaataaatgncagaaagagcgcgaaagcgcaccaaacaaaattgacaacttaattttagcactctgatgctttaatatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgtgggaggggggggggggg

SEQ ID NO: 31536 - DNA, 1117 bp, Heterodera glycines
  misc_feature (485)..(485): n is a, c, g, or t
  misc_feature (578)..(578): n is a, c, g, or t
cacttcttccagctgatcaattgacaaaatgctcacaaaaactgctgtgccggcttcgtcttcacgtaaattttgtacaaagtgttcgtgtggaacttcagcgtgaactgtgacgagtcgaatcgtcctccgtcctgtttgtacgaaatgctctcgtggttcgtcgcgttgcttatcacaattgtcaacagaaagtgattgtcctccaaatcaatggacgactgtcgtcggcaggccgaaattgagaactttcgctggaaactctgctggtgaagcggctccatgccaaacaaaacggtaccgggggcactgaacgaattttctttgacgagagaattttgacggagcggcatttggcaaaagaaatgggataaaactgaaaacaaaaagagaaatgagcaatttatagaatgaataaattattataggaaacggacggggagggcaaatggaagagaaaatgggaaaccgataaaaaacggggngggggggatcaaatgtaaaggaaaagtggggaaaagtgaagggataggatgggaaaatgaagaagggggagagatgaatcaaaaataaagggnggggggggtcaaatgtacggggaaatggaaaacgggagcgatggaataggaaaaataagtaaaaaggggggggatcaaaagatagggggggggagagcaattgacagaagtaggggaaagggatggaacagcaaccgaatgaatgcttaagataggccaaacgacggaacggatgaacggatgaatgggcaaagcattattgggggagaaagagggaggggggggatggcgtggggggcggcgaccgatgggcgacgcggcgaaatacgaagcggcaaagtgatcagaagcaacggaaggaagcaaagcacacggacaacaaccaactttaaaagtcaacaaatgattaatcaaatgaaggaaattcaaccacccaaaattatggaatattggccagttcaattcatttggctcttaaaggcgccttcttccattgtcaattggtcattcgatcgctcagccgcggggattgctcaattttttccgttccattccttaaaataattttttgcctttattaaaattggcttactttttgt

SEQ ID NO: 31537 - DNA, 1465 bp, Heterodera glycines
  misc_feature (51)..(51): n is a, c, g, or t
  misc_feature (61)..(61): n is a, c, g, or t
attcaaatcatcatcgccaaagaaaaactcattaattgccgcatttgtatnttggcaatgnagtttgcggggtctggcaagccaaaatgcacagagcttaagttaaagcagctgtgcagccgccaatcaatgtcggctagggcttcaagctctgctgcttggcgttgtgccgatgtggtaatgccttgaggaaagtacatttggtctttgtacttgttccacaattcgacggcattactgggctggccataaacgaggatgctcatgaagagccacctcatttgatcaggccatcgtgacaacgctgcctcagcgagtgttttatcccagattttgtcatcctcaagaagaccgtgccttattgcagcatcagtgaaagaggtacaaggctgaccatttaccattttaagatggtcagggtcaccgggaaagtggcgcataagtgaatatagcgcaaatctttccggatccttgggtggaacagggacaattcgaccaattggaggccttttgatgggcttccttttgtaaagaacccatttgtccttatcccatcggaattgttccggcactttttcgaaaagcatgtccttgaacttaggatcatgccgccattcattttgccattgtttccaataggctgagcattgtgtttccggcagtgtgccttgctggatttgctgagctttgctcaccagctggaaagccctatatacaatggactgttgatttggcaaatgaatcatcaatttgacaacgtggtgcgaaagccgaacatatggtgttgagttaacaacggcatatgcctccgtagcaccacggaagttcattttggcatattgagccggctcatcgataccgattttgttgccggactcttctttgcactcgacataacaatgtccaagacctttgaatgggtactttagtgcatattttatatttgccttgttaccatacgcaaatagcacattgtgatgtacccggtagcgtagtaaaacataagggttgtacggcacgacctgtgagttgtcgtatattaagccgtttacctcaatattggcaccaccatcctggggtgcaggccggtaatacaacgcaggcctgtcgggccgcaaaatcgtacattttgagtaaggggctgggaagccctttttgcagcgcccgtaatattggtcacgagtaccacaccaactttcgctgcacctgtgcagctgcaaatgcatcaattcgcgcacttggcggtgcatttccgcgatgggagtgtcatcacctttttctggcaaaagtggaatgtgagcccaaatgtattgctgaataacatctggaactgcatccaggtcagtctgggccacaatgtgtgcatgcgggcctccacggccttggaactccatggactctcctgatccaaggattgttccaaagaactttttttcgtaaagttcttcgcggaattcagcaattt

SEQ ID NO: 31538 - DNA, 1188 bp, Heterodera glycines
tcaaatgcaaatgccatttcgatggtccgcttttgcccgttgcgctcctttttcgcattttcgacggcgttgacagtcctttcgaacttttttcgctgcgacttaccaacaaaaattgtgctgactttgtccgctcaaaaatcagcgtaatttgccaacattgatccaaatgattggcattattcattcattcctcttcagcgtgtctctgagatggaccttcgccgcgtctcttttgaccaattgtcttcgctgtccgtcaattcgtccggcacttccgcccaatcggagaccacagtgattttgcaaggggagcaatggtgagggcactcgttcattaagcgtggtatattaaaattaatgaaaatcggctgttaggcatgtgcaccccagcggatacaaagtgttgtgccgaatgagaccggccaacgacggagagacggacaacgaaacagacaaaaacaaagcgaacgatgagtcatcggcctccaatccgtcggaggacacttccaccggcatggaaatggtgccacaaaattggcacattttatagggttttgcgtccttttcagttatgcctcgaagtgcttgtcgatgaggaatggaccagccgcgagatttccatcctttgttcgttggtcaacgaattccgacaatccgtccaacggattagcgtcgacgcacccatttttgaattggtgcgtaacagcgaatttttggcacatttttttggcatttgccatttccggaaatttctctggttgtgagtgtttcaattcgtgctaacttattttcagattgtcgccaattttgcctccatcgatttgaaccggtggtttgcctaccaatgctttgtcaaagcggtggacgacggtcaaatgggcgcctcacttaacaaaatggccgctcaacttcgtcaccatgacgaggcactcactgaattggcattttgcaacggattaacctcaattacagaatgaccaaatggaatttgtgccgcgcacaagcgaattgtattggccgaacgcgaaaaccattctgatcagaaccaccgaacgcgagtcggtccatttggcacggtgagagtgcctttgggaaatggccgagtgggctgggccatcacatacatatacaaggggtgtctcgagacaccccttgtatatggatgggccatcacatacattcttt

SEQ ID NO: 31539 - DNA, 956 bp, Heterodera glycines
tccattccgatgagcgtgtagcgttcacaattgcccgcacggatgtcacagaggaaagtctgaaaacataaatttaaaatgaattggtggcaacaaaaaacagcgacagcacttttgggtcggcaaagtgccacagaattggtgaagtgaaatgagttgccaaaagatggtcaaagtgagcacaatttggaacagctttaagtagacgattttctccatgatgccaccacgtgtgacgacttcttccgtttgctgtgatcgatgaaggagcagaaagatgctttgacacaattgccaaatagaaaacaatggtgaaaatactgatggacgcaatgaatgagagcattttcttcaaatcgtttcctttatataggcggacgaaggacgattcatttttggccaaaacgcaaaattcaaggagtataaataggcaaaaatttgcagtctgttggacatttttgccggtttagtgacgatttaccccccccccccccccctccctaatttttgtttattatacaaaatggacagacaatatgcttcataaatctggacttccctcttaagcgctttcctaaaaagatagccaagtgatttcagggtatgcacacagataaaatgaaaactccatattttcccgaagaaattataaaaagcgtctgactcttgacttctaaggcccaaatcaacgcatttatttgttttacggtcattaccgtaccatagtgttcgggtttaaagaattatttaataaaattttgctatacagtaataacaatgaccaggtttcagttgaaaacctattttttcaaggacaaccaacgttattcatttaaggacaatggtcaaaagcgactaatttagcctatttttacggtatcaccgtgcccgtgttcaagcaaagcgttgataaggcacaacagcagaagaatggcgaaaaatggacgggaaaagcg

SEQ ID NO: 31540 - DNA, 1412 bp, Heterodera glycines
cccctaaaacatgtttttatgactttaaaattaacaaattcataaaataaataattttgagtaaaattgaattttgactcaaacttttcattaaaaagcgttcaaatgtgcgtcaaaaaaacaattaattacattttaataatgtgcacagaaaacttgaaaatttctaaataaaacaactctttataaacgcgatacaattgtctccgaccacaaaataattgtagtgaaaaaaatggaatgaaagatgatgagacgaacaaaaaaaaaataaataattgagcagacaaaagtcacataaatatcattttaataataatcaaatcaaatccataggacgatgatcagaaaaaatgccattccggtaataaataatccatcaaatccaaaaaaaatcccgtcacaataatgtcttgccaatcactcatttttttgttgccttttcatcggtgcctttctcctcatgagttttgtgcgattttacagccaccggtttgcgatagccggggcggtagatttcgcgctcggggcgttcctggaaatatgccacaattaaggcggtaattgccaataattagggttgggtaattgccatgattaggggatgggttccataaataatgtaattgccataattaggggatgagtaattgacataattcaggaattggtaatttccaaaataatggggtaaagtgatttccgtaattaggggacgggtaattgccataatcagggggattgggtaattgccatgattaggggatgggtaattgccgtaattaggggttgtgtttgcataattatgggtaactgcgatatttaagggttgggtaattgccataattttttggtgtgcatcagcaccttgttattgcgcttggaatttttgatgatcatcacttcgccactctttggtgccgtcgtcgttgccgccgccatcgacgcagacaattttttgtctaaaataataaacaaatgcaaattttgcatggaaataaaataaataaattctttatagaaatgaaaatttaatttgccaaaatttatgtgctgcgtgagaaaacaatttttttttttgtaagcgccgtcggggaaaagttaaaaattttttaatgacattgcaccccccccctccctgcagggacattcctaggttcggcttggagagggtaccgcacccgggcgaccgagctattttttttttgaattttaagtcatgttttgcggcgcatttttttcaaaaaaaaaaacataatttggtcgatttttggagaaatttagcgaatttttacgggacctcccctcgacacttagtgagtctgtcccatgtgccgagaaatttctcgactctccaaatcgcttcattaaactaatagccaccaccaccaccaatgggccactcaccgctg

SEQ ID NO: 31541 - DNA, 1352 bp, Heterodera glycines
  misc_feature (1269)..(1269): n is a, c, g, or t
aggggtataaacccaactcgtgctgccccgactcgtactgcttttcgactaaaaatcgttataagcttttttaaaagttagccaaattaaacattcttagtattatttaattgctcttaaggttctctatctacatgcaaaattgaagaaaattttattgtttttcaaaaaagttatgatctatcgtaaaaaaattatttttcgtccataatttttacaaataattttgcatggaaatagagaaccttatgggctgctgttggtcaagtacgagttgggtttgtccaaacaaagcccccagttcgagtgggtgggcttaaaaaataaaacccctcttgaattagagccccctgaatacccacccgcccgcccccttcgaggttggttgaaaaatagagcatccggtggcacgaatacagtaaattaaaaaaaaaacatttttttaacgtttaaaatttaaattattgtcacttttttctcaccactttctttggcacagtgttcaagtcggtggctgacaccatcagcagatgctccgccattgtctctctgtccaacggtttggtgctgctgatccatcccgtgttcggatcaatgtggaacaaattggcattgtgccaatggcctccttcaatggcataaaccactgctggtggtgccgtaaattcatccgttgttgttaggtcgtcaagcaatgttcgaattcgtaacagttgagggatggcctcattctccggcactgacacattgccacaacttgtgggctcaatttttggccccccaccgaccgatcggcgtggcacaaccgtgacaaaggcatgatcaatggcacccgccgatggcacatgttcggtggttttgtttgatgaggaagagttgttgttgcatcgcttgaccaacactaaaatgcaacaaatttattctttaaagaagaaatttcaagaaattttttctttgaaaatttcaatgattttttggaaaatttttaaaaatttagtaattaattcatctaatttttaatttaatttttatatcccaaaattattgttgtaccagttaaagttaaattgtgactcatgttaaacagtgcgtcaacttcatttgctgttccaacaaattcgagagtgccgttctcctcatcaattttgaacccttccaacgatggcaaaatagcaaaattaacacaaagcgaaatgtctgaaattaaaaaacaaaataatttatttaataggtatttaaatgggttcttaacccttttgtcatgccgtngaaatttttttttctaatttttttttttcgtaggataattcgtccagtcaatttaatcaataacaatgccaatttctttgcat

SEQ ID NO: 31542 - DNA, 991 bp, Heterodera glycines
tcccagggtattatttgtaaaatctttttttccccaatagacttttccaaccccctttttcgcaccgggaatgttattttttattgattctgacccggtttgagtagataagactagaaaaaatgaaaaatttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcccaataaacttttccaaccccctttttcccaccgggaatggtatttttattgaattctgaaacggtttgaggaaattaaactaaaaaaaattgaaaattttgaaatcatgtttcccactcccttctcccaagggtattattttgtaaaggctttttttccccaataaacttttcaaaccccatttttcccaccgtgaatgttatttttattgaattctgaaccgttttgagtagattagactaaaaaaaattgaaaattttgaaatcatgtttcccactcccttctcccaggggcattattttgtaaagaatttttttcc

SEQ ID NO: 31543 - DNA, 1023 bp, Heterodera glycines
aaaaccgtgtttagaccgcagtaactcgctcagagtgaagattaagggacgcaaaagagacgattaaaagcgattcgaaattctatcgactgatataataacgatgcagtcgcggcgttgacaactgagatggaaccaaaagttccataatatcttttccataaggctggaaaggcagaatttgaatggccagtctatatttacactgagcacccgttgaagcgggtgatgcgaagccatagcaaactgtatttttaaattctggcagcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggcagcaattctaccaaaaacgtgtttagaccgcagtaactcggctcagagtgaagattaagggacgcaaaagagacgatttaaaaacgattcgaaaattctatcgactgatataataacgatgcagtcgcggcgttgacaactgagatggaaccaaaagttccataatatcttttccataaggctggaaaggcagaatt

SEQ ID NO: 31544 - DNA, 1197 bp, Heterodera glycines
aatcgattcctctcggcatgtaacccccgtatccgaaagaattttttgatgaaaaagaaattgaaaaaagttattgggtcatcaaaacctaaaaaatgacataaaaaaaaaacaatttaagtgagccaaaaaaaacgcttttgaggactcataacttaggtaaatttcattttcataaaaaagtgcaaaattttttatttttttattaggttttcaatgatataaagaaaattttcaaaaatttttttcgaaataaagttgttttatgggttttctgggtcgaagaattcgattcttatatctatttcggcccatttcgaacccctgacccggactcgaacaaaaattcgaaaattcaattttcgaaaaattctaaatatgcagcaaaaccggttcaaatgcacgaaatactttatcttgccttctgaatcgatttttctgagagattaagcacaacaattgagatcgatcatttctcaaatacaattaattattcattttcgtacacttaatcagacgacatttttgttgctttgatccgcttcttcttctccttctttttcttccgctggtggcgacaatggcctaaaattaattaaatattttatttttcggcaaaatcaaatgctattgctgctgctcacccaatggatttatcgaaactccacagatcaaatctgacattgttcaaattggcactcggattttcgcggttttcccacttaactggcgccgtcgccgtctccccaattgggcaccgttgcaacagccaattatacaggcaattatagcctaattctttgctaagtttcagtgtcagcttttcattcgtcacttcgttcatcaattcaaatggcgcaattggcattgtttccacacgaaaataaagttgaatttggtaactgacagaagtggtggcacgacggaatgcctaaacacaaaaattggtaaaacaaaaacaaattgacgaaaattctggcgagacgacctctttgaagttgttgacccattcgaaatttggtggactcacataagcacggaaacgtaattgctttggttgtccatttttgctcggcgtgtgcaaccatttggacaacgcttggccggcagttgcatttggcccatcgtcagaaattccatcggggcacagtccataggaagtgattgaatacaattgaacaagatcagtgagaagtg

SEQ ID NO: 31545 - DNA, 943 bp, Heterodera glycines
ctgcgcatataggaaaaatgggctcaagaacagcattccttctacgttaaatgcacatatataaccagggttcgcagatctgaggctttagcctcattttgtggttttttgataggtcaatgaggctaaattttcaaaatgaggctttgaggctttttgtggttttttgagaaattttgagtctttttgaggcttttggggaaaatcctcagaatcttttaaattttgataaattggcataatgtttggcaatttaaagttaacaaatcgcattgaaaattacaaaatttttcccggcggcgctatcggcaccgccggccccccgtgcgccccaaaagttttttgggaaaagcgccgcaaaaaaatcaacttcggtttttcatgcttagaatttcacaaaatgtttatttcgaacaaaaaattgctcaaattgatcatggacaatcgaaaatataacatttgaacattttaaacgtgttttgaataaatttgtgaaaatgaggctttttgacccaaaatgaggcttttttgcttgccaaatgaggcttttgaaaattttcatctgcgaaccctgtatataatcctacatataaccgccggtttctgaaatttcgaaatggcgggggagggagtgacagctgctggcaaagaacataactagcaaaatgattgctgttttataacaacttttataatactcaaaaatcaaatataaataaatacagaaaaacaaatcaaaatacctatgtaaaaatctctgttatttctggtcatttatcacattgttagcattttgccctttggcattggcaatttaggaaagaaaagcgggcgaaaagatgctgaccatcagaaaagtttgagtgaaaatggccggcgaaagaaatgcgggggaaaacacggcaccgcccagaacttgccgcgacagtatatcggcggacaa

SEQ ID NO: 31546 - DNA, 1016 bp, Heterodera glycines
aaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatggtcggttggaaaatggctccataactaagaatagatattctcagaaaaatggctatctctttttcctacagccttcaacatgaggttttccccgaaaacgcattactatatacggttgagccctacaaatgggtcggtggaaaatggctccataactaagaatagatattctcagaaaaatggctatctctttttcctacagccttcaacatgaggttttccccgaaacgcattactata

SEQ ID NO: 31547 - DNA, 1375 bp, Heterodera glycines
cgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggagtagcttccctatagcctgtactttaattctgcgttggatttttgctccccataaatgtttgagtaccccaaatggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggacttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaatttttgttgaaatatttgtcgtgctctgacggcggggggggggggg

SEQ ID NO: 31548 - DNA, 1799 bp, Heterodera glycines
  misc_feature (995)..(995): n is a, c, g, or t
tcttatttctaagaaatgttctgatttggggtagtgtcttcctttcatttaaaagaggaaatttctgaaaaatttggctaattcctaacaaaattcattaaaaattcttaacattttcccccagcggcgcctatcggcaccgccggccccccaaaactcctatttttcttaaaaattagcccaaaatcgcaaattttggtcattttttggacagaacttgttaacaaattgcattaaatttttaaaaaatttccctcggcggcgcctatcggcaccgccgaactctcttccctcacccatacccaaaaatttttcggaaaaatgcgtcgaaaaaattgttaaaaatctgtttttttgattctaaatgcactgaaatttaccaattgcttatgtttcgacaaaattgttaaaatcatataattgattttcggaaatgtataaatttctcatttctaagccgaaattgctcagaaaatagttggcggtgagtaatgcttgattttgttgaataaaaaagcgattcaaagttttggaagcgtgttttaaaaaatgtccttatttttgaccctaaaatcttattttttaattgatgagtataataattatattaaattagtgaatagaataatcaatcactgagttttttttttggttaattaatctaaattcactgcaaatttcgcacacgatatagtatgaaatacgaaaatgggcaacaaaaagttgcataacttttgccgcaccctgcacaaaaatgaacaaaaataccaaaaatatattaaatttcaaatggacgattttcaactttgccaaaaaccaataattagtggtgtataaaaaatctcggtcttgaacaaatctttgaaaactgtaggtccccgcccgaaataaactcatcgtcgaatttcgctctgattttcagactccgagaagaactgacaaatgaatcggattccgaatgatgagggattatgaggccttctacataatcagcncaactctgattgtgagaattcaaaaagatatagtagttttttaaacttcatgaaacttcgtttttttagccaaaatatgatttttaaaagagagacttgcatgcaattaacctatttttccacaatttatttttttaattagaatcataaatttttttcctaatttgtaagctgacttcaactcattttttactaccagtggtgctggtcgagacagaaaatttcccgaaactgaccgaatcccaaaaatctgagacttttgtctaattgatactcgggtacgagtttctcgagcatcactagaaatatcttgtagtttcttttctcttaaaaaaggtccagagatctcttccgacttaccaataaaatcccaaatcagctttttgatcctggccggatcggtgttttacgaaatccctgccgccgtcaaaccccaattaaaccattttccctctgttaggtctgtggcgctttcatgcagttgtgctgggacttggtcatctttctccactttcttctggcagcaaatcgtctgctgatctttatgaaggcctcttttaagccctccattttgaacaaagagccaaagtcggagcaaattcttttcaatgtaagtcaaaatgattagctaatttaagcaattaagaaaataagtatgtatataaaacatttaacgtgaaaattaagtcactgacgaaaatattcactgtcgaattcgatcactgacgaaaaaaatggaaaacagtgaaataaataaaaatcgtttactggcgaaaataatcactgacgaaaatcattgacgaa

SEQ ID NO: 31549 - DNA, 1070 bp, Heterodera glycines
  misc_feature (14)..(14): n is a, c, g, or t
  misc_feature (21)..(21): n is a, c, g, or t
  misc_feature (30)..(30): n is a, c, g, or t
  misc_feature (78)..(78): n is a, c, g, or t
aaaaatgattagcnaacgtcnggaattttntgaattaattaacgattatacaattgaaatggccaaaccgataagatntaatgacaacactttacgagtaatatattgcaaaaaggacgagtacattaaggagcataaatgctccaatatcatgatttcgatatggtaggataataaaaaaatgggaaataaattgttttttaggaccaccgcccaggcgcggcttaaactttattcatatatggaacaaataaataattcagaaaattgcaaattaatttacacagacacaggtaataaaaaaataataacttttttatttcaatttttagacagtgtgttttttattcatcaaaaagaaatgtgtccgattaaggaagggagttttttagggtaatcatgagcaaaaaaaattttttttaatataattttagtgaaatgtcaaaagaatatgcggattcaaaaattttagaagttgtttgtgcaggtaaggaataaaaaataaataaaaataaatagcagttttaggacctaaacaatatgctttgaaattacaaaaagaaaatggagagatttggtataaaacaaaaattagaggaatgacgcaaaataagaacaacaaaattgattacaaagagttcaaggacatggttttgaattataaggaagaaaagaaaattcggtttacacactcaaacaaattcgggtaggtttttataatttttagaaaaaaataattaattttatttagaccgacgagggaaagttacgtgattagccgtaatgttacaaaggattataaaccaattcaaaagaaggggttagtttgactgtcttcattaccgaaataatattttaatttaggattattttggacgatgagaatttaactgttttgccttttggttgttggtgatttttttttgaataaatatttttaaacattgtattttatttatttttggtttttttgcctataatattttattttaaaataaaaatgtataaaaagaaaattaaatgaataataaaaaaaagaaaacatgggataaacaaaagaagtcaagggg

SEQ ID NO: 31550 - DNA, 987 bp, Heterodera glycines
  misc_feature (148)..(148): n is a, c, g, or t
taaaaaaaaaatttaaaagcgttccgtcataaggagcagagtggtgaatatgtaatttgaattgtgtttgatgggtgtcaaggtcgcattttattttgaatctccgattgatcgaagaaatgtttgcatttaaatttctttgttcatntaaaagcgacagaaagggattaaaaaattagagaattattttaaaaaattttaagccatttttttttacaatttagagaagaattacatcataaataatttttttaactttttttttcatttaaattaaagaaagtaaaatttttttttacaatataaacctaatactttaaaatgaatttgattaatacaaataatagcattttaaagaaattcaaaaaataaaaattttaatctaattaactgaaattttctctgtttttttttgtataattaaagaaattttattaaaacaaatgaataatattagatgataagaaaacgagttctgccgacgagaaaattactctaaaagcagccataaattaattaatatattatcggttaaaaacaaattttccatctgtttgttgagaaattgaatgattccgaattttttaacaaaaattgtagggaattattacaaccaaattgaataattaaaattatttcaaaatgaaaaatataaaaaagaataatttcatatggcacttggctatatgaattcaaaattgattagtgaaagcttaattttgttatctaataaaaatattaaaaaaaaaattaaattttttgttcatttatttatcatctgttcgtgataattgcaaacttaaacactagcaagtttattaatttttaaattcttatatgtttaaattttattaatagaaaaactaaataccaattaaaaaattcagatagaaaagcttttattcaaaactatttgccatttaattttagtgaaaaaattattataaatccttaggcaatttcggaataatactcacaattccttct

SEQ ID NO: 31551 - DNA, 1572 bp, Heterodera glycines
aaaaaagccaaatgaatcctcccgcgaataaaatggtatcattaatatgaaattattttttttgatttttaatttagttttatttggccttcaaagatgtccatcccagctggtcactaattggatgcgcactgatttacggactcatcgctacacttggaatcattttgaattcttctgtcattcttgtgacttttttaacaaagtatgtgtgattaatgaaatccttggcaataaatgaaattttaattagatcattccgtaacaccgttaattaccttttggcactttgttccctttttgaattggttcatcaaactggccattttctgtttgtgtacaccgcattttctggacagaatttcattgagcttcgtctggcagcaaaaatccttttgattcctacgtttggaattggtaattttttttaaatcagcataagtttcaaatattatttgaaaatataattcaggcggaattactccaacgatgcttttcactggcattgaccgactgatcggaattgctttttctgaattgtgaaagataaatttagctcatttttaattatagtaatttttagtcacgataagttgaaaacgcgattgtatctggcaatgattactgtcatttctgtgtcgtttgggtgccttttcgctgttttgaattgccaacaagcaaatgaggacgatgatctaatggtcactggctcctatactgatgctttaaaggttattaatgaaaattctttcttaattctgatgcttttcataaatatttttgtcgaatattttaaatgcgctttttcagggcatgcctcggtttggaccaataattctttctattacttcaatgggttttatcatttatctctttcttggcattacaatacgtgtaaaagcatcaggtaaaacatattaaatatgatacactcagcactttttacttttctttctgtgcttttaaaattgattaaaaattccaaaaaatttataatcgcagtaaaaaagcaataggtaaaaatagttttgccatattttaccctttcattctatgaaaaagcgttaaaagtttttgccaattaatatttccattttctttcgttcaatcattggctgtaattagctaatttattctttttttaggtttgtcgtccgctgattcgttcaatcgtcgcacttttcgtgcccttttttgcattatcactgtgaatatcggcggttattttatcacaacaattgcttacttcctattagctccctcaattacttctccagtcactgagtttttctgcgctctaatggccgcaattcctatgaacattggcgcagtgtcaaacggacccattttatattttacgaggtgtcattttaattgaaaatgttttaataataatttttaatttttagtacggagtatcgacaagcatttcaaaaggaatttccatttgtgttcaaacaaactcccaaccaaaatcaagtcgtacctcggcaaaatgggccacctattcgtgtaatctcacaatcaagaataattgacagttgtcaaccataaatgaaatttttcaacgat

SEQ ID NO: 31552 - DNA, 1427 bp, Heterodera glycines
ttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtaatttaattctgcgttggatttttgctccccataattgtttgagtaccccaaacggacacttgaaaaaatcgatttttttgttttcggggcagtccccccgaaccgatgcgcccagatttatggggacacagtaagccttcgggaatagcttccctatagcctgtactttaat

SEQ ID NO: 31553 - DNA, 1312 bp, Heterodera glycines
ggagaagggagtgggaaacatgatttcaaaattttcaattttttctagtctaatctactcaaaacggttcagaatcagataaaaataacattcacggtgcgaaaaatggggtttgaaaagtttattggggaaaaaaagtctacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaaaatacccctgggagaagggagtgggaaaatgatttcaaaatttcaatttttctagcctaactactcaaaaggatcaaatttaataaaataacatttacggtggcaaaaatggggtatgaaaagttattggggaaaaaaaaatttacaaaataaaccccggggagaaggaaggggaaacatgtttcaaaatttcaatttttttaatcttatttactccaaacggttccaaatttaaaaaaataaactttcccggggggaaaaaagggggtttgaaaagtttttttgggaaaaaaaaaatttaaaaaaaaataccccggggaaaagggaagggggaaaaattgatttcaaaatttttttattttttttt

SEQ ID NO: 31554 - DNA, 1353 bp, Heterodera glycines
gtttgagagtcagttttgtcgaaggattttaccgaactgacaaattttgtgatttgtttcacaatttcctttcccgatgctgagatttgaagtgaagagggatttgcttttcccgttttcaaaaaaaattccgtcttgttcgtctgcttcttgattcgttttccgggtttttgttcacccctttttgtcgacagtccgttgaaatttgagggatttgtgtcccgtttttcagtcacttctatcgctcgtctgttcgtgggttttactttacccttttacaaaaattagctgttcacagttggttgattcggctcttctcttgctggaaatttgttttcccttttttccgatttgtccacacttgtcgagggatttacttttccctattttcagttcgaggccacgtccaattgtttttgtccactgctgattcaccggtgccaggagcgccaagtcgtaaaaaacaaatatggttgttgttgttgcacacaacaaaagacaacagcccaaagcaaacacaaaacaatacagcccaatgccgaagatacaattatcgtttaattccaaattaaatagtcgacgacaatcaatagaactgacgaaagcataaaaaaactaaccactaactaactcaaaatcacaaacaaaaatgacacaaaatcaaataacaaaacgccaaacatattttaaatcacaattatatcacagaattcaaaaaaccgggtagttccaacattgttggccttaatttttttgaaacatggtgaaattttttgaaattttgcaggctgatagaggacacttaaggctatcgaatgatgccaagaatattgaattaaatgtttctaagaaaagttacaaagtctcaaaatgtgccgcactaaaatgaccccaccacccttctttgtattctttttttctttttataaaaaaaaattatctcttctttcgggcaaattattttcacaacgcttttcccttccatgaatttggcacaatgccaaaaaattgttggcacaatgattgcccaaatttctggcacagcgccaaacacattgattttggcattttttaaatacataaagcatgacactgctcgtcatcgtcgttggcgccgcgctggtgatggagagcctagccttggccgcagcaaatcggtgcgccaacttagcagagcgccgtcacatcgccgtttgcaagaaacattggtggaaacgaaatctgtggaaaacatgagcaccaaaataagaaaaaggtcctgtgcaattgcattttgtcgcccgcccggtgggcatcgaacccacggcatttccataccgcgtggggaatgctctgaccgattgagctaccggc

SEQ ID NO: 31555 - DNA, 976 bp, Heterodera glycines
  misc_feature (637)..(637): n is a, c, g, or t
  misc_feature (695)..(695): n is a, c, g, or t
tgacgatttgaagtttagctaaatttgatggactacccgtttaaattctaattttcgcaaatttagaaataacataaatttccattaaatatttaattaataaacattaattgttttgtggctttttggagactgacaagagtttgagatttttgggtgatccctttaaaaattggcttttttgattggtattttgtcattcagttgagctcagtcgcaatgtgtcgtgtcgacgtcttttggatgtaatggccccgagcatcaaaagccttgagggctatttacaacaatttgtaactcaacaatatttgcaacgatgttcctctcttgaattcatccaagtgtgggatgcgtttgaccacaacaatttggaaaggaacgcggatgggaagccgatgaatgacaaagaaggaaggccactttaccgcactttgattgattgggttacatgtgagggccaagcaggagcagcagcaaacaatttgcgacttcttgaatttttgtgtgtcgtcactttgccaccggaacttgaaacggttggacagcaaatgggcattttgcaattttaattactgcaactaatgagttaatgggccaaattttattcgaaaattgaatttattttaatattaataanggaagtcggttcattgtccttcagtgtcgaatgaagaatagacacttacaaaacacangggacggttttggattttaaatttaatttagcctattaattatttcgagaatttctattaattttttaaaaatttccgggttcgaaattttttgggaccgcagaatgccatccctgatacagacaacatatagacatcataatgaaaatagagggatttaggaatttgaaaattctacaaaaccagtgacgtacgccattggccatgacgataaaccgttcatagggattgaaagagaaacactgcaccaatgaagcgtccgctacatcatgatatcactt

SEQ ID NO: 31556 - DNA, 1639 bp, Heterodera glycines
  misc_feature (116)..(116): n is a, c, g, or t
  misc_feature (121)..(121): n is a, c, g, or t
aaaaataatttctattttttagcctctgtgttgagaagaaacccggcaccgacaaagcagaatattacatgcaaaagctcgagtgggaaataattatcaagatttaactacgcganatttntaaggaaaaaataaaatttttgactgaaatttttttgaaatttccgtgttcgttggtacccacccctctcttagacctctcccatccaaattttctcactaaatttttccaaaattcgcaaaaaatttgtcgaaaattatgtgttaatcagctgattttctttctgtattagatacaaataccgagtggtgctggaagtgaagcacaactgcggcgccgacggagagcaaaaaacggtgcgtttttttgtcaattggcattattaatttattttaattgacttatttttgtacaattaataaataagtgttcggagggtaaatccgcttcatgttttcttcagcattacatttggttgccggaaattgatgtctttgataaggaaacggtggtgggccgcgtgatgcaagtaaaaattgaatatattttttaaatttttattaatttttattaaaaaattggagaaccggaggggtctggctgtgccgacatttttttggaaaaatttagccaaaatttttgggaaatttgagtgcgtgagatcttggagggttaacaacaaggagaatcgaaattttcaatattgatgccgaaaaatcggcacttttacgcttttgcactttgctatttttcagatccgccaactccatttggatttcgccgacatggaagatactgttgatttgacattgatactgtccggaagcgactccgacaaaagcggccaattcgttaatgccacattgatcccctacaaacacgaacccatggtgccaccaccatcggtagggtgccattcaacaaaaacaattaaaaggtttagaccaaataaataagctaacttttagggttatggtatacttaaattttttattgtatataaatttttattaattatagcccatcggcctctaataattttatattgtactgtaacatggacggaacggttttgattgtagaatatattaaaaatattaaaaagacaattactttttatttctaataacaaaaaagtggaaaaataggaaaaaagctaagtgggcggcgggggttaattgagaaggcacaactacggtaacacttggagtaacaaaatggcaactgcatcttaatttaaatttttcttcatcagccaaatccgccaatcgcaacaaatgtggaccatttgggagccaattgcacacaaattgtcttttccgaattgatgccgcaattttttttgaacgtctccaatgatgcgtttgcaattgcgtgccaaaagttcgcggccccaatctatactggcaaaaatttttcggcagatgattattatgccaacacttgcgcgcaagtgccaacttcgctgaactgcaacaagtcagaaagggcattgaaaaattaggcttatgtattctgtattttctctgatacagcccccggtggctccgtttttttaaattgacaaccctctcggggggggggggggggggcattaaagagggggctcataaaacagtaactctgacaaatcaaaat

SEQ ID NO: 31557 - DNA, 967 bp, Heterodera glycines
tggatttttgctccccatattggttgagtaccccaaacggacactgaaaaaatcgattttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaaattttgttgaaatatttgtc

SEQ ID NO: 31558 - DNA, 993 bp, Heterodera glycines
tttatacatcccattatgaagcgctaaaattatcagagtgccgaaaatcgcatgggatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaccaattttagcgcttccaattccttctacaatcgcctttatacatcccattatgagcgctaaaattatcagagtgccgaaaatcgcatgtgatctaagccttaaaaaaatggtctaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgccctttatacatccccattatgagcgctaaaaattatcagagtgccgaaaaatcgcatgtggatctaagcctagaaaaaa

SEQ ID NO: 31559 - DNA, 975 bp, Heterodera glycines
cataataagataataaaaaatcatttaaatgattattaacatttttcttgcgtaaatttgtataaaagctaaacaaatcgaaataatattatttgtgatatcatattttaacggtttttcttaaaattacaagaataaatatattttatttaaatagcaataataatttctaataatatttattcattaaaacattgcagaatatttacagttcagttacaagatataaaaatatccaggttgactcgagaaattaaataaaattaatatatctacatctgaatcaactgccctttaagttataatacttttaaatatttttaaaataattttttttaaaactattgtataatgtgtactttataataaaatgagaattaaattaagaaaaaaatccatattttcagattaaaagaatctaaaataagtcttaaaattgcctaggatatatttgaaatttaatttatataaaaatatattactttatcagaatattcaaacttcgaaaaccgtttttagcgtaccaatataaaattctagtttaaattattaacaacaaaaacaaataataaaaaaagacaacattaagctcacaattttcctgaaataatttaccaattgtctaataatttaagaaaaatcttatttcaaaggtatttcataagcttgttatgataattaaaacatagcaaatagctaatttactataggggaattacagggcaggtgcctgggaattcactccaaattatttatattatttccttttccttttctctttcctttaacttttaagcgaagcgacgagcgagtgtaccgagtcaatacggaccgggtcagtttagtacgggccgttttagtactagcgcatatttttccactataactatgttaggtgttatccaaatacgactatctagatatcattcgaaagtgcttgggatgctctattaccctgtagaattacataaaatt

SEQ ID NO: 31560 - DNA, 1782 bp, Heterodera glycines
  misc_feature (1777)..(1777): n is a, c, g, or t
aatgcgttttcaaatttcgttcacatagggcaccgatgttcgagcagtacaattttgtcatccgtcaaggggcgaggacaaaatttcggcatatttcccatataaaaatgagtcatccaaaaatgctaaatatgattttttctttttttaaaaaatcatataaaatagtgatagataaactcgtttgaaaaattttttaccgcattttcttgatgcattaataaaaataccattacaaattttaaaaagtgaattaataataataaaattttaaaaaataattacgaaaattttaagcaaactaatttctaaaattaaaaaaagttttagtaaaagtatcaaaaaatgtattactaaaacatgaaaaaaactaatttttaaaaataatcactaaaatttaactaaagtaattattaaatttaagtaaaattaattgctaattaaaaaaatatttcaattacgaaattaaatttataattaaaaaaagtaaaatattaaaattcgctcttaccacatatattcactgggctaatccgctcccattctttcaacaaatcatttttgcatttttcttttaatttttcttttttctttaattttatttcctctttttttggggtttccatttcattttcttcttttttaattaattcattttttaaagaattcttttttgctgacaaattaattataattaactgattattatttgttttcttagcattgtgatcagcattttcttcagaaactttcttgtttattatcattgaattttttttattattttttataataacactttctaaaagtaaaatatttagagcttgacctgggcctggatccaggcctggattttttctggatccagatccaggtccatgccattttcggcaacctggatttttgtccagaaaacccaggcccatgtcaaatgaaaaaaccaggtataaatcgatgcttttttcaaaatgtcgagctctcgaattttatttttaagaaaattaaaaaatatacctttagctttttcttcaaaattttcgtcataatttttcgtatgattttcaatttgtttattatttttttctaaaaaatctttgttataaaatttaatgtcaagcttcttgaacaaaattttgacatggtccaatgtcaaaaattgcaaaatattttttctctgttctcggtttgttgataaaactgaaaattttgatttattatgtgtatgtttttaaataattttatattttgttatcgtcaggaacgaattttatgttttaaattatttgttgcgaatagattatcacatgaaaagctcacaaatagcatttttacctgttttgcttttcaatcatagcgattttttagctcataaaaaatattttgggttttggcagtttttggcactacttggcgattaaaattttttttttttgaaagttcctttttagctttcaaattcatgcaaaatgctaataaatgttcaaaatttttctgtcgcctcctatcatcatcacctgtgacacgttgaaattaaattaacgcctaaaggcatttatgattttgattttcaattatgctaccgaaactgataaaataattgaatttttgggaaattcaaatatttttaagcagttttgtttcaatttttggcatatattggcatatattttgctcttttttttaattttttttggtacatattttgggggattttgctacataatatgtacatatttggcagttttttagcgacatataaatccgttcccagattatncacaa

SEQ ID NO: 31561 - DNA, 1268 bp, Heterodera glycines
  misc_feature (1208)..(1208): n is a, c, g, or t
gaagaatgtgtacttaagcatcaatttaattaaattttaacatgtttataattttaaaaaaatttttaaaaaatcataggaaaaattagatgtttgatttttgcacttttttttttgtgaagcgcccaaatttgcactttttgtgatgtgacaaaggaccgaataaaagtacatttgttgttctgatgacttttaaaatacgaaaggaattcaaataatgtttatttgatataaaattaaattaaatagaaaattgaaatcttaaattcttctcctatttcgtcaaaaagctgcgtcatttttggtcgtcgagcccatctttgtaatccccgtccccggcggggatggagagcggggaacaaacggggacggggattctcaccgtcaatttttgttaaattcaacgaaatggacatggccaatttagaagcaaaaaaaatcatcgcacgtgaaatgagacgtgttgaagaatgcatggagttgcttcccaattcccagctccgtgccaaagcattggtcacttttgatcaacggcactcgctgagttaccaaatgccaatgggaataagaaagcaatagaagaatgaatgaataataattattttccgttttgtgtggattttcaaatgaggtgggaaattgtagttgcaccgcctgttccaaatcgaattcacaacattacaatcgttgaaactttcaggaaaattcaactaacatgttattgaccctgactaatttttgcatcgaaaaataaggcggcgagaaagccataaaacaaggtgtggcgagttggccccggcgagttgagcacagcgagttggccgctgcgagttggacgtgaattgactatggcgagttggacggttcccaaattccttggattcccccccccccgtccccgtccgtccggctgcgacgattttatctctgtctctttccctctctccctctctcttttccgcgttgcctctctgttcgcttcctcttcttgtagttcatctgctgatcactgatcaccgctcgttccctctcagttcgatcaatccccccaaatttactggttctcttccctctccttatttgtgttatcccttcgcttttgtacctctcttagccccactttccgatggtttcactgacgttcagcagtgtaaagtgccgcctttctttacagcgagaaaacgtcgaaatgaccaaatgcttaaggnggggggggaagagtgatccaaatattcggcaggtgtcgatgttcttccaatggtttgagt

SEQ ID NO: 31562 - DNA, 1586 bp, Heterodera glycines
  misc_feature (10)..(10): n is a, c, g, or t
  misc_feature (43)..(43): n is a, c, g, or t
  misc_feature (88)..(88): n is a, c, g, or t
  misc_feature (104)..(104): n is a, c, g, or t
tttcatgtcngaaaaagatgcaaaatcatctcgaggcactttntaccaggagacgtaaaaaaacttgatccgctgaattttctgaatntaaaattttgagtttntaattaagatatttatcaatggacctgatccgaaagaactattaatttgatcaatttcctcttcggaattataatcaaaatcggaatcgctcaattgcccttcaattttaacgtatttggcattttgatcaaacaccaattcttctataaagtccaattcttcattgtttttgaggcatcgttcaatttcagaagcaaaatttttggcaatagcaatttcaggatcatttaatgaggtttcttcattatattttttaaaatatttttggagtagaaaaagaatatttttggggttaacgtacattttgaaaaaatgaatgaaaatgttattggacgggaatacgggaaacttggccacctccctttgtgagacccctttttgttgactaactcacagaccactaagacgaaaaatccaacttaattgtacttagagcccaaaattgaatcgccgtgttaaataaagattttgaaggtgtgtccatccaaattggacgatcttgatatcaattcgaaggcttaagatagaagaatctttttctaattgtaagcaactgctaattgtaagcatttaaataaaaagttaacaataagcttcgaaattttgttttttgaatacgttactagataacccttcttttgctcattattcgtaatttttacctaatatttttaatcccatcaatattcttcactttttatttcgattttaataaaaatgatttaaatacacggaaaaattctggaaaccataaatcaaatttttagaaacggacaaatgaggcctttgtcaattaattcaaaatcttaaaattccagtccaacaacaacaaattattgggttgatgaaaaagttctgaccctttaagcacttcttcgcaaaaaaaacaaatgttcaatcaatgatgtactcaccattttgatcaatgatcctcccccatcgttcgggcaagatttcaatcccctttttataaaactgatcatttttcgatccaataaagtcatccaatgcattttcgacctcgttttgatctgcaaattctttccctctcaagaagtgctccatagatcgaaacagatagtagtcacacgggctgatgtctgggctgtatggtggatgaggaagaaccgcccatcgaagttgctcaattttttgttgcgttgagaacgcaacatctaggcgtgcgttgtcatggaggagtacgccgccgcggaattttgcagaaaatggaggacgacgaatttggtcatgaacccgctgcagttgttgctggtagatgtcggcgttgatggtttgcccagccggaacaagttcatagcggaccaaccctgatgaacaccaccagacgcacagcaataccttcggtgctgttgaagacgcctgggggtcggctcgcccaattcgtttggcttcagccattgtttttgtgccgttttgttgttgagataaacccacttctcatcacacgtgatcagctggga

SEQ ID NO: 31563 - DNA, 1063 bp, Heterodera glycines
cagcggaaaatccagtgtggtttgggttgggaagcgcaaaagttcggatcgtggaccccacccaatcaggtaattgcagaagttttgtttcaacaaaaaaaaaaaattaattttttcactaattgctagggttcgagcagggcgtggcctacggcggcgtagaaaacgcagaatttttggaagccgggaaaaatacaatttgttagtgaatttgaacgactaatttcgcatggtaaattcaggcgatacattttatggaattcttgaactttttaacgttaacttgccaattagaaattttttgaatcgtaatggaaaaaaataggatttataaattagggaaaataaagaaataatccaataatgggttttcaatgagaatgggtgtcaaaatattgagtttttagattaaattcgttaattaaattaaacaattatcagcaggatattgtcaatgaggaattcggaaaattaagagaaatgaaagaagaaaacaaagacaatgaaaaggtcattggagaagaggagttgatgaatcaggcacggcctatttcacatttcacagcaattcttcggtttaatgacttgattaattaaaacaaaaacaaaaaaataggaattgatgccaaaagcgagtgcggcacacgattttttactaagttttaattgaaactgaatttttgcagtccatctcgcaaaaaaaaaaaacaaagtcaccaaatggaagacttgacatgaattggaataggccgcaagataggggactttaataaaaaaaaaaaattagttaaaaatattaagtacttaataaattaaaaataagcacaccaaatggaaatttccaacccaacaatggccatagaattttctgtgcttttcatcgcacatctttttggtgataatatctattttaacgagcaacaaatgcgaggaaatgtcccattatccttttattcgacggatttgtttatacatttacatatgtacagaagaacaataaaaaaaagcaaaaaaaaaaaaaagatttttggttacaatttttgtatatttcatttaatttttt

SEQ ID NO: 31564 - DNA, 1002 bp, Heterodera glycines
ataaaatgcaaaaattggtttaatttgacaaaataaatttgaattttaaaaaagcacacttagatttttgatgtgaaactgaagaaaattaaatgtctatttccttttttatttcttagagtttgggtttaatttcaacattttgacattttaaaaagccttttttaaatttaaccaacaaatgagaaagggtcattttttttattacaaaacccattaaaaaaatctgcgcacaaattcaagaaatcccccgcggtgcctaccgttggggtagcctcaccagaaaccagcaggctattaaaattttgaaaaagtgagacaaccaaaagtgagtcgagagactgagactcaaaaaaccggtcgaactcgtgagcatttcttggcaatttttgtcgagactgggaggctaagcacctcttccgtgcgctccaagtccgcccacactgtcaaatcgtccgcgcttgggcccagcggacacaacggcacgctgcatgccgcacgccgtgcgctcacttccgcactgatggcaccggtagacgcttccactgtcgttgcggaggcgggcagcatttcggccgtttgagcaagcagttcgacatggagtacggcttgcgcaagttcggcataatccagcggcaatttgaggggctaataatcggaactgcacatttaaaatgctggagggtcaataatcagttcaggcatggccaagaaggtgttaaggacgttcgttacccaaaaaaccatcgaaacaaaaaaattttcctataaatagcaaccagatttatttctttatatcattcgatagccctaagtttttctataagcctgcaaattttcaaaaaatttgttaaattcccaaaaagttatgaccgaaaaattcaaaaaacctatttttttttttgagttcttctgaccataacttttttgaaagtcaatggaactttatgaaattttgcaggctaatagagaatatttagggctctcgaatgatatcaagaa

SEQ ID NO: 31565 - DNA, 982 bp, Heterodera glycines
aatgattgactgaaaaagtgatgacgcattaaaatcttccagtaaatgataattctttccttattccttaatattgttttaacttaagcccattaaaccaggtgcacattttgaagtaacctataaacacatgttattattttttggccgttttcattttaaatatttacctaaaatatgatattttattgtttaaatcaattataaaatatttttaatatgggtctgggatgagggtctgtgtttgtcagggttgaaaccttctgagtcggcaaattacccctaaaataacgaagttaggtctctactttcctaataataaaaaattaactactctttatttcaaattttatttaatttaacaatttgtcatgcttttttgtcactttaaaagatgtcagacagaaaggacagtgtgacaggagggaaacgaatagagcaggaacttgctgaggacggccgtcctgtttacatcgtcgtattgaccattttcttaaaagggtttttctttttgtatgacttgctcgtctttattccgttcaaattatttgctgatcctgaactgaaaaaggagcgctctcgtgaacaaaaggtttttgaacccatgtaaaaataaaaacaattggaattcaggccgttccgattgatgggaatccggcttcaccatggcgacacgtcgacaccattggcactgctctgtacaccgaactttttgaggactgtccgacgctcggcaaaatttgggacaaagcggcagagtgcgcaattggcctttatttaaaaattcttttctgtttaaattaaggttgcaccgtgggcacaattgcatgggaacgcgcgacattcttgaggtcatccaagaacgacagtcggacgggaaaaccttccagaaattggcacttggcaaatatagctggatggattacgaacatgttgatgaagtgatcgaggaagtcgcttctggactcgacaatttgggcat

SEQ ID NO: 31566 - DNA, 1514 bp, Heterodera glycines
ggaaaaaaacaaattttaaaatttaccactttactcgcttttccgccaatgtgccaattccgtcaatttgttcccaaagtgtgcctccatagcgctccaagttttctcggctatccttcgcggggaaaacggcacagacgaaattgtttgatggtgaatttgaccgagcagcctggctgaatgagatggtaatcttcgtacaactctggccatggtcgccgctcagcttcatgtagatttcgccgccaaaggtgatcagattgtctttggcagacaaaagacgcgcctccaaagctgccccaacatcagtgcacacaaatccaacacccacattggtctcaattggtgcgtattgcaatggcccacagatacggcgtttgatgtcaagcacctaacaataatcaatggaatttttaaataatataaaaaatgctaaaatatgtttttacttttttgagtggcggaaacacatcaagttttgcattgatcagacgaatagtgccttttagtcgtctgtaagccttctgtgtaccgacaagcccgaggatcagaagagcatcctctgggtcgactgaatcgttttgtcttggcagttgttgcttcttcttttttggcgtgtaatgagcaaatttgtgccgaacttcccgactgatcccttcgagggacgcccggctggcggaacgtgatctgtcgcggcttattacatccgcaatttgatctgccaatttgcgacgtgaggtgcgctgcaaatgatcgacattcatctttggtcgtcctgttggagttgctaaaattaagaaagagaaaattatttgaaaaagataaaaaggggattttagtttcactcacttttgctggtggtcggtgtctccatcggtggtgccatcttttcctccaactgccgccgaagcgcagtgatcattgcgtctctgttgcggacctgctgtcgaagaaagctgatcacttgttcctgctccttcaactgtttgtccaattggtcggtttgtgtcgcggcgtcctcataagccaaatccacgtccgttgccttgtccaccgttgtcaaatccgtgtttgttgcactgtcggtagttgtgaagtccatgttcgttgctttgtcggcagttttttgatggacacgcacatggcgcctgatcggagttgctgacaatggccttgggcttgaacgcgggccttagtttaatttttgcttctaaaatagtgacttttttgacttacgaaggtccaaagttgacgttgatggtccactttcggcggcttgggtcgatgtcccctctccatctgctgttgtctcggcttcggtctgctttagacctaaaaaatgcagtgtttttaaaataaaattaattttggtcagttttcgtcactttttggcgtcgagccgcctttttgagcccgatcctggcgccattccttccgctttcgtcttgcttctgcactagaatttcccatatccttgaattttccagtttttttacgtgtaagaagcgattttt

SEQ ID NO: 31567 - DNA, 1037 bp, Heterodera glycines
aattacgtgacccaaggacgaattccgaacaatgaaaactccgttgatcagcctcatgaccctgaagaattaccagcagaaaaagaaggagttcaatttgatagtggaaatcgtatgatagtgacagaagaaaaagaaaaaagacaaacgaaaggcaaacaaaagaatggcattaaaatttgaaaaaaggattctttttattatttataaaatctgcaaaatgtgaaccgaattgggacaaaaactaattaacaaatcaaaacatggtttttttaaataatagtggcgaaaatttggaaaatctgtttttaaaagcgatgtaataacaaaatatttaattttaattacgaaaatgaattaaatttcatccctttttgaataaaaagcaaacagacttttttcttacagtattcacattgattattttttatacagttcattaaaaaagtatgagtccgtattctcgactgtagtttctgttaaacatattcatacaataattaaactcatgatgagaaaaattagaactttttctatcgctgaatcaagattttctgtctaatttcgtttatttgctaacctacagggtgcggcaaaaattctgtaacttttttcgctattttcgtatttcataggtacctgtgcgaatcttttaatgaatttaggttaagcaattaaaattatgcctaaaagtccaagaaaaaatgattattgaactgcttgtggacaattttcggaaacgtttggattcatgtacttccgcccatgtggccactttgaacatttgatgtaaatttctcataactatgttcctattgaatgaaattgccaagttatttggggctgagtcgttattatcaattgcggtttaattttctcttttttcctgtaataagtacgctttttagctcccaaattagcagctaatacactcaaaatgggatgggacaacaactttcacaacattaattaaaagtagaggcggccttaaaattaagaagttcgctgagagcacactcattttcgctctgagagct

SEQ ID NO: 31568 - DNA, 1293 bp, Heterodera glycines
aaaaaaatttgtaaaaacaaaaactatttccaactattttggtgttttcccaaaattttttaacaaaaatgcaataaaaacaagaaatatacacataagaatcggtcccaaaaatttcagaaaaatacacccccttaaaatcgatccaaaatttttcaaaaatgcacataataaatcaaaaatgatttgatttaagactttttaataaaattttataattttacacctctaaaagtttattaatcaatatttcaaccacttttgattatcacatgtctaaatttctcttgtcaaacgtcagctcatattaagccccctcgagtttcaagtgaaatcttttaaacacctcattcacatatatttttctatgtttttctggataatagtctgatgctatgacatctttttcaaaaaaaaatgaaaaagtagtcataccatctgaattttgtgcataaaatttaaaattttttagtttatcattaaaatttgcacgcgccgtggagtcggtgccttgaatgcccgaaatggtgagggcgtgactccgcttatctgtgccgtccagcgtcattgtttgtttctgtgtttcgattcttttaactttttcaatagccctttcatgtacaatgttgttgctagcccacggcgcggatcccagcggatgtgacaagtcggggaattcaccactgacttatgttttggaggttagttaggcgggggagcactaaaaattggcagtgccgtacaatttgatttgttttcggttgttataacttttttgaaattaaaggtaatatagtatggatggtacctcccattttgaaatctagggttttcagggtcggggaatccggactaaatatccaattcgaccgaactcggactcgctcaataatacaattttcgagaaaattttcaatacgcaacaaaaaaacaatttttttcgaaaaaatgtgggggttccatccgtactattaccatggtcaaaattaagtcgaaaaaagtaaatatgtgttcaagaatcattttgtgttatctttaatgattcaattttgtgttggtaaaaaaagaaaaaatattttgctaaaacgaccaaaaaaaaaacttaattttattacaaccgaggttatattttaataaccatttagaaccaaagaagccaaacgaaaattctgaagcttttggtgtgttttggcggacaaatcagtgtatcacaaaaaaaggacaagaaggcgttagtttctttttttgattttgtcagttttattttgtgttttagttacgaaaaaatgttgg

SEQ ID NO: 31569 - DNA, 895 bp, Heterodera glycines
atcatcctcggagcattgaatagtcaaatagccgggaccgcggacaggtcccttcaaaatgaatccgtcaattgatacatgccatacgcgtaccctccttcatcctcatcctcatccccttcttctctccccccttcttcatcccccttttcatcctctcccccttcaccctgttcacgcttcatcctcttcaccgtccctacctccccccttcatcctccctccctcccctccgcctcttacttcccctccatctcttcccttctcgccttctcattcatcctcctcttctcctcgcccccccccctccgtctctcaccccattcgctgattctccgccgctttcgtgcacacaaacattgttcttcgagaaaatcacttcgccgtttttgccgagaaaacaattcgaccctcctttttgatgaaaggcttttgccgttcagtttattttgaataatttctgtacctccccgaagctgcgcaatcgctccgtgtgcttttttcaaaaagtcattgaatcggtttgccatacgctaataatttgcgcttccaatttcacaacaaatgggaatgctttccaattattgattggttttggttggcattggaaggaaaagcaatggcaaaaggagagaaaggggaaaagcggcggagggaaacggccaaagggagagacagcggagagaacggcgcgggggggggggcggggggcaaagggcaaaggtcagagacaaagtgccgccttcgattctttggcattggcacttccttttctctgctttatttcagttttgcttttaattatccccttcttccgaaatgttttgtttttcaatggcattaatctgtgtgggggattttgttcgctttttcgattttatacgtcgacttttat

SEQ ID NO: 31570 - DNA, 757 bp, Heterodera glycines
gtgaggaagttgttttcgtttatttattatattggtcaatcatttttggttaggaattggccgattacatgcttgatgcttctacaaaatacccccacctcctcgtccatttccacggcattctttcgcgttttcgactcgagcgaatttccggcaaactctttgaacgggtgcctttttctttccctttttacctcctttcataatcatttctttagcttttcgacctttctcttgacagtttggcaacttctcccgttttgctcgacattttggagcagcgttccattgacccgaccggttttggagtgtttgacgatgtcgttagtcagaatttgaaggcgcttttcctggtgcttaaagaattcaggaaatactctgctaattatctgtctcatttatgaaagtttctcgactttggtcgtcacagaactgacattcgtgcttgggcctttttgcatacgaatttatgctatttgagagataatgccgaactgatgaaggcactgctcctgcctttgtggttgaaccgcagaaagtgagttcgcatcgtattgcaaattatcaaaaaatggtacttcctgttttgaagccacaccccattttaaaaaatgcaacaaagagcgttcaatattaatagctgtgcgatcagccactgcaacatgaaaatttcttggctttctctgcatatcagggttgacccgggtcacccgaaacccgacatttttctcgtcccgaaacccgacccgatgatttt

SEQ ID NO: 31571 - DNA, 865 bp, Heterodera glycines
aaatgccaaaattgacggatttaattgaattcccccgcctccgtttttcagctcttccgtttcgccttcatccttctgtgcttctactttggcatgggcttcatggaacggttggctgtcgcgatgatcgccgcatgcgtccgctgggcttggccaccggtgcacttcatgctcggctcgtcacggggaacgctgttctatttgacggactggttcgcatggatggaagactttttgtcaagttgggtgtgcgacatggccaacaggtgcggttttacggtgtgggggcacacggtcgataccgtaccaacactactaattccccacaccccattttcagatactgtcatcaatacggtgtgatgtgcgacagtcagtgttcctttgtcagccgaacgcagcgcgcagcttccttcaccggacgtcgcttctgaaggatgatacgcgagatgaaatgaattttgataacgatttttgatggcgacattgatgtgtatgtattgtatattctgtctattatggttctgctgtttgagtacgtccgtgtatattgtatatgtactgtattgtattttgtatccgtagggcatattcaattccaattttaacgcctaattttgtatacccatgttgtgttgcgtttgttcataaactttgtaaaattatatgtactcaattttatcagtgggctataaactattttttaggcgttttttgttattttttcatgactacattttccaagttttggactacaacttttttcattgttgaccaaatctaacaatcttggtatcattcgaaagcccttcacaagccctattagccttacaaaaaccaaaaaaattttaacttgaaaaaaagt

SEQ ID NO: 31572 - DNA, 1042 bp, Heterodera glycines
ttaacaaatttaatttaaaaaatacatgaaattctatcaattaaaaaaataattcatttaaacttataaaatttattcattaaaaaaaaattaatttaaatataattttttatttattaacccaaaaaatattttaaatgaataaaaattaaaaacacgaaaaaaatggtagaaaaataatgtacaccgcccggcttcgaacttcgcccccccccccctcaaaatgatgcctcagaatccccaatcacacagggattctgaggccttaacgatgtgtaaaataaattttataaaatagagcaaaaaattgcggatttttatattattttacttttccaaaatatcttttcagaaccgagttatgaattttttactgaaaattcgaatttttccagaacttctggaataactttttttagtttcatgatagaaaatctaaataaaacccataaaattctcctgattttttgctatttttaaagctttgttgtatgaaaattgacttaccctgaggttagttatgaattttcaaaatttaccccaaaatcccgagggtcaaaaaaaatgaaaaaaatttcgaatttttaaaaaattctaaaaattatgaaacgaaaaacaaaggtcatattcgtaatcagcatttcaaaataccacagaaaaaaatttttcacccccattttcaacccaaaaaaaattttcaaaaatttctagggggcctagctcgaaaatttttgaaaattttcgaacatgtagtacaccattcgatagcattttaaaagctctacaattttgctctaaggcaatttttggctagaaccaacccccgacgagttatgggcccgggactcaaatgtcccgcttaggccaaaaaatttttctatttcctggaaaaaatcgaaaattttctaaaaacatcactaatcgatagagctcgaaaaacgatgttttggaagtggtcttcgttttccctggaaaaatcgttaaaaaatcataaaattcaaaaaccgaaaaacgaattttaggcctaactcgaaaaattttg

SEQ ID NO: 31573 - DNA, 925 bp, Heterodera glycines
attcattttgctcaaatattgaaggtggcaaataagttcatctggtttattttacaaatgctttaattcgacgtccaaatgagcgcaccgaagaggtccattcaaataactcgtcagatttttcttcaactgtttggaagttgtttaaaatataaactcagaaatagaattatttttcaggaatgtatctgtgatattcaaccaattgcgtcggttggaatgtttttgaacggttacacgactcccctcttcggagtgtttgtcgaactgcacgactggagagacacccggccaattatgtgttgttcaggtgggaagaaagcactgtttaaacggacttacagcatgagaatcatttcaaactgaaagaaaatcaattctttaataagtagacctgctcatggatatattttttattttagaaaaggtcagttggccacttgctggtacattcttctgtccggatcggtgttcatgtgggtattcgttctttatgttcttatcccaattgctattgactttaattttctaaaacccaaaaatatacactgtacaacgggatttattttttaacgaattgaaaattccataaaaattaagatttcacataaatttggtagtttttgaaaaattggacagttttagacaagttattaattaatcactattttttaataagttttgattagcagaggcaacataaaataatccctgaaattttcaggaacaagcaaatctacttgcccattggatggtatgtctgttttggattaattgatattatcttcatttatttgtcaatgctcaaaattagtcttctttttttgcaaacttccgccccgttttcaccaattatttttttgaaaagttcaaaatggctacaaattcgtgctatttagcctctgtgttgaaaaattttgaaaaa

SEQ ID NO: 31574 - DNA, 1098 bp, Heterodera glycines
  misc_feature (967)..(967): n is a, c, g, or t
ttgctaaggtggggggggggggggaggggggtcaatctacagtatacccttaactctcattcaatggtatcaattatataaattttgtgaattttttttttttgctaaggtgggggggggggagggaggacaaactacagtatacccttaactctcattcaatggtatcaattatacatattttccgacttacaattagttctggtggttcccctgtaagggaatttaatacccaaatgatttctccgattttcgagcaagtgcagccagacaaatgagcacagaatttgggtcttgcccttcgaataaatcaacggtttggaacagttcacctggtgataaaggaaagtagaaacttataaaaagctggaaagaattcttatatgatttctgatttattgaattatattaatttgatggtttagttaaacatcttacttttgttcacatatttttcagcaaaacccaaaaagaatgaaatgttttccatctgtttgaatggaaaattactggtgtttattttctttatcgaattgggcgacagcgcatttgcgagccttaaaaattaagttatccatttttcatctcgccttagttgttttagattatgctcatcttacttgcataaaacagtcccatctttgagggtagacaaaaattcttccacttcgccactgacagtaaaagattcaccagtgacttgagaaatccatccaaatatttgtttcgataattccaagtcaaatttgctgtgaattttttgttgggcctcagccgctaaaccagacttagtggcacgctcagtcattaattttcaatctatgttgtggaagctaaacctgaaaaggtactaaaaacaacaaatttgacagttagggtttcaaaggccggactcggcatccagtcccggtccattttcaagttccggcccggtcacggccatttgggccatgactaacgggactanatttgactagtacaagtgtaactacccaaatttgaaaaattaataattattttggcgaaatgacatcttaaaaaatggctcagaatcaaaaaattggtctttttttggacaaagcagataacaaatctaac

SEQ ID NO: 31575 - DNA, 1193 bp, Heterodera glycines
ctgttcaggggcctctccaaaccattttttattttttcttttattcttttctcggcatggagttataacaatttttcacaccagttttgcatttaacagacccattctaaaaattttaattagtatagtagtccaagcctattattattttttttgactagtctctgaatgggttatcccagttttagtatcctttttgaaaaacaacaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggtacttgcatccgatgcagctgttcacgggctctctaaacctatttttattttttttctatctcttctctgaatggagttataacaatttttcacaacagttttgcatttaacagacacattctaaaatttctaattagtatggtagtccaagcctattattattttttttgacttgtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaacctatttttattttttttttctatctcttctctgaatggagttataacaatttttcacaacagttttgcatttaacagacacattctaaaaattctaattagtatggtagtccaagcctattattattttttttgacttgtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacgagcgacggcggcacttgcatccgatgcagctgttcacgggggcggaaaacctatttttatttttttttctatctcttctctga

SEQ ID NO: 31576 - DNA, 1019 bp, Heterodera glycines
aaaaaaaaataaaaaatagtttaggagagcccatgaacagctgcatcggatgcaagtaccgccgttgctgtacccctaacagttggtgagcaatgacggaaaattgcttaaaaaagaaaccaaacaaactcatcaattgtttgctcccgttgacaaaccgaagggtacattggggcaatggatgttgggctaccgtatcagttattaaaatttttgtttttcaaaaaggatactaaaactgggataaccccattcagagacaagtcaaaaaaaataataataggcttggactaccatactaattagaaattttagaatgtgtctgttaaatgcaaaactgttgtgaaaaattgttataactccattcagagaagagatagaaaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacatttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagact

SEQ ID NO: 31577 - DNA, 1220 bp, Heterodera glycines
  misc_feature (1161)..(1161): n is a, c, g, or t
  misc_feature (1179)..(1179): n is a, c, g, or t
cccagataaatttttcttcaaatctccagaccaagaatctcgagcagccttaggttccactatccgaactgttatttttattaccatcgatttgccaaaacagtagccaacattgcagaggtacgggtcccggttaagcacggcctcgcggagtttttcaagaagctggttgatctgttttttccgttcctcaatcgctgtcagcggtatgttcttcagcttaatgctctcctcgataagtctcgtaaattcaatgcctatgaaaagggagggggtggggaaggttcggtggttccaataggcccgacggaaatattttgggtttatttttaaaattaataaagaattggccaattttttttaggacttaccgctatttgaattaaggaggttccaaataaaatttggcaggtagaagagaatcgcttgcaaaagcagcatagcgggcacccaccaaatggggaaaaaattgattaggtaattatttaaaataaattaattttgaaaaaaataattagaataaaaactaaatgaatacaataattaaataaaacagttggataaattaataattcaaaccagaaaaagattcatttgacattataaatttagtacaattttttctaaaaaaaaacttaaaataaaacataaattgctaacaattttcccggtcggtgtgaatttttttgatgacttcgaaaataattaaggtaactgttgtaaatgagttaagctaattaagttacagcaataagaaagtgtataaaacaaaaataccgcgtggtaataataagtgatcggctgatgcgcatttcgcgcccaattgtcccatggaatgtcctcttctggtgccaaataatgttgcttttgcatttggcagtaattcagcgcatattgtctctcatcttcatttaaatcgtgcgatatctgaaatgggacggtcacaattatgaatacaaataaactttttaattataaaataaaatatttaaaaataacgaatgaaattatagtactaggcaacgcattggctcatttccgagatagccgaaactgaaaagaaagaaaattagcgtggatttgacaaaattaattaaataattttaattggataatttatttatgaatttaatttctaatatgtattatatgtatttttanaaataattcatcaattanattttatttgctttttaataattactattatgctttactat

SEQ ID NO: 31578 - DNA, 791 bp, Heterodera glycines
ttttgtttcataaatattcttttcagaaagccatgcgctcccgtccgatctggcaagttaagcaacgattgccgcctagccaaaaggttcggttccgtgatgaaacgaaccagctctgcttaccccgcggcccccggcgcggtcccccgaaggaatggatttaattaaattctctccttcggggatttttttccattaggtcgtccgctagcgttcgattgctgtagtcaatttttcaaaatttttgttgaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacaaaatgctctgaaacgcaccaaattttatttacatgctagtttaggcactctgatgctttttctatcaaaaagggaggggaataaatttttaattgctttttaactttgggaaaaagtttaggcttaactttttagtgaaagcttgatcactcatatttttttagtctaatctactcagaac

SEQ ID NO: 31579 - DNA, 1192 bp, Heterodera glycines
  misc_feature (74)..(74): n is a, c, g, or t
gaccaaagaccaaaagaaggaggaagtatcaaaaaaggcggaaaagcgaagaaattagagaaaaacattaccancagaaggaagaacacggtaagtgagacgagaatattgatgcacaaattgatctgacaaatgaggggaggatgagtgtgattggccagaacagaaaagcggggaacggcggaacactttcaaagggaaccgggaatagaaaacccgggatttcccagtcagtcccggttctaagttaccctaatgaacgatgggcgggggggaataaagggggagtggttaataatgatgagtgatgactttgttgtgcgattggctgggaaggtaaaagacaaaagatgtcagaatggcaatgccaacgcaagggatcatcagattgacagtgtagaacaactgtaaagcagcacaacgccaaatgttaagttacaacaaaagcacaatttacttttttccggcgaattttcaaaaagtaagtgatgtcgatcactctgaaaaggggggacaaacaaagcaaagtttgaaaggcaacgccttctgttcacagtctgctgatttaatggcatttgcaatcagcagacttttgatctccaatgacagtctttgccaattaagctgatcctaatgcctttttgaaactcacgggtagtcacagcatgggtaacgcttctcgtgacgccttccggtgaccttttggttaagaatggaaagcaacaaatcatatcacatagtaagtaagctaatagcgaagcatacagaaagcaattcgaactccacagactcctgatactcgctgatgtccacgcccaattccacgttccaaacggtgccgttctcctggctgacgtgttccaccacgtcggtgtccaactgcaacatttgcccgtgacagtttcaacaaaaagggcaaatgaaaaaacccacgtggaccatgtcaagttcaaatccgccgtaggtccatgagcctaaaaattgcgaatggactttgagccgaggggcggggaaagtgaacgaaccgaatttcatgtaacattcctgctcatcgtaaggaaaccatttgatgtcaatggcacacatcgaattgtacaccacctgaagaacaccaccggtcggtggacaaagaaacggaggaccgaaccggcggttcccaaaaaacgctgccattcgcataaacatccgcctt

SEQ ID NO: 31580 - DNA, 1594 bp, Heterodera glycines
  misc_feature (89)..(89): n is a, c, g, or t
aaagcaatagccgtggtgagtcgatccaaaaaaaaaaaactcagtgtgggcgatcaaaaaaaaaggtccggttcttgatccattcactntgagctataaatatcttttgaattaatgctttctattactctgaacattgaatttaaaaatataaaataaataaaatgaatacattttcaatcgttttattaaattttatttattagatagaaatcagcataaatttttttacatattacaattttagaaaaatttatttacaataggaaataaactaaataaaatgtttttttctgtattgaattttatctttcctattttttaccaattaaatatttatgaaaaagttcaagtcaattaaactaataaggtgaaaatatcgcagttataaatgattatattgacttctcaatgtaattacatcagctttctgttaggggtatgagaattaaattttatattttttatttgaattttattttaagttttttcttaacttccttttaaatttctttattttcgaatatcatctgtttattcgcctcaaccaattttaattaaaacaaacattattttatcatttatattttaaattttttagattttttgattaatataattaaaattgaattcattttgattttaaatttaattaatgtgacaattttataatacgtaaattttcttcattgctacttgcggtgctaggtcgacccaaaaaaaaactcagtttgggcgatcaaaaaaaaactcagtgattaataaaattaactaattttgttttaccctttaattgcgcataaataaaagatattgaaattttttttttaatttttaaaaaattaaaaaaggattatatttaataagttgtattgctaaatttttaaattaatattttcttgtaaaattgaaaggtgaaattatttttctaaaacactaatttaaaaaaaaatacatttatgaaccataaaatcatttaaaaaataaatgaacattttgaaatttctaccaaaatatttaaggcaaatgataatagtaatttacatcatggaaattattagatacattttttttaaacaattgcaatacaagatttatggccttttcgataatttactaatcaaaaaatattttaatataatatctcagtaaaccgatttgaaaaaataataggtgtataagaattattcagcatctcgagggctcgccttaatatcgaaaaaataaaaaagtaataaagttttaaaattatgtgcgactttaacataaacactaaaaagtaggttttattacccaagttttctcaaagaaccccgcacgtgggagatatttttataaaaacaaggtcattaagctatgcaataatatatacgtaaaaataaaaaactaacagactatagaattgaataataaaatgcaaaaaaatatccttattagagtgaaatatattttcatcatcataagaaaaaatgaataaaattacgtatgcaaatttcaaaataacaaaagacttcatgcttaaaaagtttgaaaaaattgtatttaatataataagaaacctaaattaaagtaatgattaattatttattcttat

SEQ ID NO: 31581 - DNA, 1537 bp, Heterodera glycines
ccaaatttaaaaaaatctccaaactatttaacccaaaaaatttttttatctgccaaaatccataatatttgttaatgcgaagttttataacagcaaataaatgtcctaatttattatttttaatgaattttaactcaaataaataatttttctcagagatgctttcttaccaatgtataaaaattatgtgttttctgccaaaatacgaaacacgaaaaaatcaacaaccatgtcttatagctttattaaatttgacaaaatttgctacatcataatttagcttaaacataatcaaattaaatcattcttgttattgagtgatatctttacatgtcctccattgtattataattttttataatctagcaaaaatttacaaaaagttataaccaaaaaattcagaaaaattttgactcactaattttgtcgctaacttttttaaaattcaataaaattttctgaaatttcacagaataataaaaaaatctttgggctatttttcgatcaaggtcggtgtgaatttaagtttgaaaattttatgcatttaaacgaccttacattttttgaggaccatttaaatatgacactattaatttgtttataactttttaaagaaagaaccaattttaattttgtttagaaattttaacaacagcaagccgagaaaagagtgttgccgagcaaatgagacgaaatgattgagcaataagtgggccttcggtttctgagataggaagtcgcgcatccgttgttcttgggccagaaaaccacggaactcctcaatttggcgttcaaatgcgtccaagtcatttggcgaaagtggttgatcctaaatttataaatttgggagtgatttgctcaaaatttgtacttttgtgaaattttgggatttggcctgaatgcataagagcttggcaaattgtctttggccatgagagatgttccatttccgatgcacgtttgaggacttagccaatttgcggcgtgaggtgcgctgcaaatgatcaacatttttctttggtcgtcctgttcaaatcgccgattggtgtgacatatgtcgacggcagcgaaaagccaaattccaaaatttcctcgtccatctcgggcgtcggcactggtcctggagttggtggcggcgactccatcgcttcttcggccggtgcagcagatgttgacggccctgcttcgtcctgctttggcgtttcggcattggggttcggctgtggatcgtctgaaatttgaaaaatggaatttttgtgttaaaaattggtgaaaaactcacttttgttggctcatcgggcttttgtctcctttgcattttggttcgtctctcctaccgcttgttctcacgcgtatggcgtgcatttttgtctctcgcttccgtaataaagttcttttagccattaaatctttaaaaagaataataatttaacttttttatcttataactttttaaaacaacatttaagcgatgataataaagatagaaatcgatgcagatttttttctcaatcgatacgcaaaatttggtgcagat

SEQ ID NO: 31582 - DNA, 937 bp, Heterodera glycines
caattatggtggaaattatataacaagtttaatacatgcacaagaaaatagtttcaataattgtaattcatctgggggaagaaacttgttcaaaaaataagttgttcagccgtttcgggtgataatttggaacggcgataatcaaaaacatcacgggcgactttgaatgtttgttcacttgggacactggtggcaggtgctgaaagatatttttccgcaaattttgcaaggattgaaaatcgaggagcaattttcttccattcatctaacggattcgcttctgggttcgcaatttccagcgcgagaaattccttattttctttttcaatgtcatcgtcttgcgatgtttggaagccttaaattcgttattaaaataatggttgatgacccaaaatcaccctgttctgttgtgtttgcgcctgtaatgtgtttcagacgttcaaaaaatgacattcgtcgtttagctggcggattttcgggttggggcgaaatgacaggacgaacaaattcattttgtagttcgtctaagtcattttcaacttgacattctttcacttcatttttgatccagacattgactcgagcgcgaaaagttgcggaattttccatcagcactttgtccttgaatcgcacatccaaaaaagtggctagcgcatattccctaagacataacattaatttaaattaattaaattttttttacttcaaattcgctagaccaaaaaagcgcctttcaactgcatagtaaagtgttgtcctgattgtctccacagtcctgttgacaattttcatttcgtacaactcatcatgtagtgcccgtgcttgagggaggacaaatgaaattggctcggcagtgaacctttttgttgcttcttcagcacattttaacaccccaaccagttcttcaatttgctcccactcatcattcttcaataaa

SEQ ID NO: 31583 - DNA, 1529 bp, Heterodera glycines
  misc_feature (189)..(189): n is a, c, g, or t
ttcactgaacgatttgatgaatttaaagaattatatggccaaggcaaacagaaagaatttgtgaaagaattgggcatttctgaaaaaacatttattaaatggaaaaaaagatttgatgccaaattaccacaaaagtaagggaataaaggaataattaaatttttaattagtttaatcatttttattatntaagcacctaataaatattccaatgaggaccaattagaaaagatgaagcattattttgaaataaaagaagccaacccaaaagtgactgacgaaataattgccaaggaattgagaattggaattacaacactgatcagatggaaaaagaaatgcttatccatttgatcagtgattttactttgatcagagtgattttgaagcataaaattcgttgctaataattgtaattaaatggtttaatccattttttcatatctcatttttccatctcccttattattagcccatttgtgcgctctggcaaaatttgttggcacacactaatgacacacaatgacttctttctcaatccatcattcatattttattattctctctctacaaaattaatctttatgcgtttgttcggtctctcattttcacgttatccctcctctttggccaattttgtctctgcttctttctcaattaataatgcattttctctgcactccgtttttttctctaccctctctctttccctcctctctctctctttctctccatttatctccctctctctcaatctatctcttatgcttttttttcttatcttttggatatgcttttttctctctcttctttaatgtcattttctcctcaatttctctgcttgtttttctcttctctattcaagcaaattgtctcttccattctctgtctttctctctctctctcccttttcgcttctctgtccccactgtttcctttcaattttttttctgttttctctgcttccttccattctacacatactcacacaaataacactttatgtctctgctctcccctctctgcctctctcccctcatttctctcgggcaaaatgcccatcattccctccgctccccccagctcccacattgaatgaaacctcaatttctccctcttcctcctcctcctcctcctttcactgttttgccccattcccacccccgagggatttcttcccctctcgtcctcatatcccttcaagggctctttgaccttgtgcccctcccccggggtccctcttccgtccgtcgtccgtccgtccgcggcctccgtttcctcccattgattgccaattcggttgagggcattcaattgggcttggctgagtgtggtggtgggcttgtgtgggatatgtgcctgctgggccaccacaggcttttggttctcctcctcctcgtcgttgtccgtccgtccgtccttcaaatccttggccaccaaatgccctcgggcttccttccgtcccgtctttggttttctttacttggctattcacccccccccctctcctcgccggacatttatccccc

SEQ ID NO: 31584 - DNA, 1351 bp, Heterodera glycines
  misc_feature (1285)..(1285): n is a, c, g, or t
  misc_feature (1311)..(1311): n is a, c, g, or t
tgacatcaatggccaatgtcactttgtcctcttttttgtcatacaatcctttgctcgagtccaacaattccttaattttccataattgggtcaattaagggaaagtttaattgtcactcacagcaaaagaaatgatagcgacacaatgcaacatgttcttattgtcaaaaataaggtcaacgaattcgtccaacactccgttctttagagagacaattcgaaagtttgccgaacatttgcaactccaagtttctgctcaatatcaattaattaattgttgttaatatatatattaattattagtaattttgcaccttcttttggagcatcgcaccaaagagaaatgcccaaccatttctcatttttgtcagtgcttccaattttcgtttttatttgtgccaatattttccatggcaatcatttgatgtgcacagtttcgcttttacgttgactcccaattatttcacgcgcaaattccgacactttttcaatttccataaagagtgtgcctttcgaattgctttgatccaaattgaatttgtccacttttggttcatcaacagttgtgagatcgatggtcaatttcactttgtcttcttccctgtcgtaaaaaccattgttaaggtccatcaattccttaatttaaatcatctaatttaatttttgtttatgcgtggtcaattggttatgttttagaaattaatttattttgttatgatttctttacaccaggcaaataaataaatgaacttcaatattggctggtccacgaatgtcaaattaaaatatttgtttgaattggcacttaccgcaaacgaaacgaaattagggaatcccaaattatttgattttttgtcaaaaacatgatcacaaaatgtcccaatcgaattctccgtcccatttttttgcgagataattcgaaaagtggcagaatgaacgaagcagcgccaattcgaatcttaatgattattacttatcgtagttaattagcatttaataacagttaatttgcacctttttcagtagaatatatttttaaaatagtaattaaaattggaccttcttttgcatcgtaccataagtaaaatcccaaatatttcttctcatcagtgtctttcgtaatttctgcttcaatttcccatggcaatccatttatgtacactttttcgctgtaccgactgctcccaacctcctctcgtgcaaattctgacactttttcaatgtccatcaaaagtgtgcccttttttcgatcggaaatccgtccattagtcgaaaatggcattgngaaaagtccgtcggaaatcccatgancatttggaagggaattgaactgataaacgctgatcacttc

SEQ ID NO: 31585 - DNA, 1467 bp, Heterodera glycines
  misc_feature (1449)..(1449): n is a, c, g, or t
ttttttcctcatccatacccaaaaatttttcggaaaaatgcgccaaaaaaaatgttaaaaatatgttttttattttaaatgcactgaatttaccaattgcttaaacccgggatgtcaattgattggactcataaagtgcattagagcccaaaaagcatattgagcatggaaaatcgaaaattaagcagtttctttttaggccttattaaaacagttgcatttcccgcttgtgtcacataaatcgcttgccaatttgataagatgagcgaatttgtgagcattgtgtgtggacaccctcgacgattgttgctcattggtgtcggagttggcgtttctgtgttcgctatccaagcattttggaggtgaaaatggaaggcacaactcatggaaaatatggcattcgcctctcatatttgtttaggtatttcttcgctgaacgaagcggcaagaaattgccacggttgcgcaatgaaaaatggaaactttcggaacgttgtgaaatcggtgagcgtaaaacggaaacaatgccaataattgccttttacaaatcactaataacgggattggatcattcagctcgaattattttctccctccactttatttgtttataataaaatccctaatacaacattttagggtttcttttttgcggggaattctccaaaattgaaaaaaatccctgaaactcgtcaaagttattaaccttttttcagatatcagttctttgaacgccgccattgacagtttggagcttttgttggccgagttggagccgaacaaattccaatccgaatttggacgcggaaaatacgacctaatcgcatcaatcatcgcccgactgcgcggagtgtacagcgatttgcagaaatatgtcaacgaagactttctcaaaagggtgtgccaaattaacatttttgaatttctttaggagatatgccattaaatgaatcactcatctttgcataataaaaaaatcataaatttctctgccaaatttcctgtttttttttttgcaggtgtccaccgaggacatcgcacggtcggtgtggcacgcgaaaagcattatgggctgtcgaactggcggggccggcactttgtcagtgctgtcggacaactctttcatttcggcttatgacgaattcgtatgaatttgtttttcatgcttttgtgcttctacttaacatccactaaaaggaacgctataaacaatcaacagcaaaagggcgaacttaataataaaaaaggggggatttaccaaaaagggaaaaaagaattaatctgcgactgttcgttgggcagacgaacaaacgattggaataagacgcatgggaatggatacacttctgctgtttacaattagcatttcatgtaaagcaatgcctttgctgaattatagcgaattgttgcgccatttttgcgtataattttacatgcggactgccaganggaaaagtttttaatttt

SEQ ID NO: 31586 - DNA, 1507 bp, Heterodera glycines
  misc_feature (1484)..(1484): n is a, c, g, or t
atagttgggcgtcaccaaagacggcgctgcgccttcaaccaaatcgatgggcggagggtcaggcattgtgccgtcgccaccgctttacaccagcgaacagtgcgctacgggtgccgaaagcggaaagggcacgacgacggaacagcggacggcatgcgtgttggccacgctgcgctacctgcaacgtgccggtgaatacggagcagttcaaaaaaaaaataaagttttttgataaataggcaaaagaccctgaagaagaggaaaggggaacagtttatttccgttcccaattagaaaaatgcgggcttttcaaaaaccgctaactcaccgattagacagtgtaaaaaaaaaatttttttttactcccaaccgaaattttctaaaaaaattttttttttaaaaaacataaaaaagaaatgcagattttccattagatatttttaaaaaatttaaatactagggattttttaattaaatatctcattttaatggcaattattttattactattttttttgcgtccaattttagaacacttctcaataaatgtttgtagtgttcatttttttaatgaataaattgtttccggtgcttttccccgaatttctgcccctccctcagcaatttaattttctaaacaaaaaaaaaaagatgaaagtgcagctgcgctgccctgttggctcaccgtttggacagtcgccgatttggacagcgctgacgggcgcaaattggtggcaaatgcgctgaagggcatgaagaagagcaacgcgatgcgcctggctgtgctgcacaatggcaaaggtgtgtgacggaagggaagggcaaagcgggagcagttcgttaaatttagaaaaatcggtaataaaaaatttctgaaattttattataaaaaaacccaatatttttttaaattttctacagtaaattttaaaaaatcggggtgtgtggggacgacatggggacgggaaagacagacataattaaaatttttaactattttttttggtttttaaaacaataaatcttttttgcgttaatttcacttctctactagcgattgtcctgggatttagggtttttggcgcttgttcggtcaccccttggattttttaaaattttccccctcagttgactcctcctccaactctgtgtccgtgctcatcgacgcgctgctccacggtctttcatccaccgcggccaaacagtcgctgaacaaactgttcgccgccgaccagcaacaactgattgacgaagtgcacagaaatgggcccgagtcggtgctggacaaaattggtggacatgtgagtgttgaaagtaatcgaaaattctctatcaaaaaatatcataaaataaaataattcatcgtctgtcgggcgggtccgaaccaatgaatgacaaatggtcattaaaatgtaatagggaaaatcgcattaaattaacgtatttttgcttgtctttccattaaagtggatttttctgaccanattttgaggtcgctgctaaaaat

SEQ ID NO: 31587 - DNA, 2269 bp, Heterodera glycines
atggatatttatttaatatataaaaataagtcaatactaattctactattgaataaaattacattcacttattaaaaagctcaaaaattacaagttacaaaaccatacaattgaagagtcattcaaagtaaaaccattaatctttttcttatgtaacgatatttaaaaagtaacaaaataagaaataaataaacttaccaaaatatagtttattgaaacaaataatattattatgggagacaagccaaaaattgccatattggagtaaacgtttgaaggtcgagtaaagcatacaatgaaagattttaagaaaataatttaaatttatgcatttaaagcaaaaataattatatagaataaaaggaaaaactaaaatgattataaaataagacatagcaaaaaagagataaacataatttcattcatttactttgtcaattcagtaactttttccaaacacaaaaacaaaaaatcattcaatgggtaataaaggcaataaatagacttcaacgaatgggaactgatttaaataatcaagaaaaaaactgatgataaaaatattaaagcaacgatgaagtaataaaataatctaaaaattacatgtaaaaataatttttatttgaattaataaaattaaaattaaaaggaaattaaaaaagagcgttaatttaacaaaaaaaaatgtcgtataaagagctaaaaatgaatgtacatataaatttgaaaagcattcttataacaaacacaattttgaaaaatttaaaataattataaaatcacatttattttcatttatgaacaaaagcgtgaatgatatgaaaaaagagaaagttacaaaaaagaatttatctgccaaaataaaattttgactacttagttattgaaatgaaattaacattagaaattttaaggaagtccattcaacttaatttcggctagagcagttcgcaagtttttatttattttttgaatatacctattatttatatatatatcataaataaatttacttacggaaaataaagtaaaaaattgaaagtttcagttatccacaaaagaatgaaaaaacaaaattattcataatttatataaaaaagaaaaatttaaatgcatattaaattaaacatacaaatttcatttattcgttttgtcaattgattgattataattttttatatatgatcaataaactaaaaataaaaacaaatataattttataaaaaatatttaaattaaatataaaaaaggtcctaagctcagtatataaatttgcaaataaaaaatttcaaaattgaacattattgaaattaactaaattattaattattatcattattaaagataaatttttaaaaatacaaaaaaaaaaattgaataaataaataatgctaatgtgactataccgtattgaaaaagccaaactatagaattttgttttttatttttgcacatgatatccgtcttgtaataatattaaaaaactactaaacaaaatgtcatatatcattcattcgtttattctacataggaaatacatatttctgttttaaactcatcaaggattaattttcgaattttaaagtttaatctttttgctttgtaattggttttatcttgccagtgccccaaaaattgtttttaagaggcaaactcggatattaatgccattttgcggttattaaacgctatgactaacattaattgtcaataaaattggtatttaaaaaataataattttttttcactagatattaattttattttcataccaatttatttcattattatttttttaatatttttaataatttttttcactagatattaattttattttcatgccaatttatttcattattttttaaaaaatttttttttggtgttatttaaaaatttttttagtttgtataaagaactgttttccattaaaattaattaatttatattgcaattttttttaaattatttaaaataaatataaaatttatttgcttcttcatattaaattacattccgtttttttttgcgtttcgcctcggcttgttctgaaccataaaattattttaaatttagaattttattattatttctttgttgacgccttttttgaggcaggccgaggattcgtcctcgtcaattttcgcataagtaatgagtagagaccgacttttgaggcatatgctttttttctgcgcacttgtttcgatatattaagcataaataacacattttccacttggtttgaggtttctactttgacttttatttt

SEQ ID NO: 31588 - DNA, 1644 bp, Heterodera glycines
taaaataaccttcaaatcatcattaaaaaagcatcaatcacatctcactaaattgagcaaaaatcttcattgaaagccctgaataaaaacccatacaaagtaaaatagaggatgaattttgtttttttagtattttaaatttgttttttggttttgacctggtgatatgtccacatttgtcaatttttaaaaagaatttgttgattttttaaattattatttaataatattccaaaaataatttcaaatttgtaatgtctcccaaaatgccttttcattttcctctccaaaattggcccacctgctcaaataaattcccgtggatcactggcagcgggggacagctggcgaccgcggcagaagcactctctgcgctcggctgacgtttcattttaagccgatgagaaacggagagaggggaaacttctgaggaaatgccaaaaaagacaaaatgcaaaacgatcgacaaaatatttttaacggcatgaaaaaactcttttgctgcgtgagaattaaaattaagggtagaaaatgccatgaaaaataaaattgtttgtgccgctcgaagacggggggggggggggtcgaatttggagagataaaccatcaaaacctttgagaaatgagtcgtaatttaatgaattggatgtgatgtgacctcattgatttgggccgagaaaagggtcaattaaattacagtaagacaccgttttaccgggggcacttccgttgtgacgcccgttgcgctgctggcacagaaatttgttgccgggagggctgaaaaggctggtagcacttgaggaaatgttcacggatagcagcgaatcagtgcccatcggggaaatgttccgcaaagattaattcatccgcacgaaaaacaaagggagaaaaaatgacataagggagagagaagagagatggaggagaagaggaagaggagagagagaggaagagagagagagagagagggagggagggaggaagagagaaagagagagagggggggggagagagggaggagagagaaagagagagagagagggggagagagggaggagagagaaagagagagagagagagatggaggagaaaaggaagaggagagagagaggaagaggaggagagaaagttggagtatgccaaaaagagtaaaaagcatgcctcattaatttaattagttgaaaaagaaagtggaggaaaagagagaagaaaaagcgggtgaaatcagcagaaaaaaagaagagagtaaaaatggaagagaaagaaaaagaggagagacaaagaaaaattgagctgaacaaatcgtccgagaaatttaatgtttaaatgaggataattgaataaatcagaagaaaggaatgggcggtgattatcaaaaggatggcactgtcgtcacaattttctctctccaaaatgcctccattgtgtgagttcggctttcataaaagctaatccacgcgctaatgacgccattagcgaaatgagcggtagaattcaatgggaaagacgaaaggggcgggaaaagtcacaacgaattgggggaggggactttatgagcagagaaacctagtaaaagggcaattaggacaaatttagccaattattgctaatggtacctgaaactgttgtattcccattttaaat

SEQ ID NO: 31589 - DNA, 1040 bp, Heterodera glycines
  misc_feature (1022)..(1022): n is a, c, g, or t
agattttatgaaatttcattgtcaataatttttctctgtatttaagtaaaaaatttaaaaaattatattctgatagataaaattaaagccactgaattataccattaaatattaattggttgaatttgagccaagctatgaatttatatatatatatatatgtataacccatttttgttttcaaacctattggcggatttaaaaaacagcacgaattgttgactttggcaaattgtccaaaaaatcatattattttcttgttcttaaagtttaataaaatgttgatgaaaatgaaatttcgggagaaaacagggccaaaattgtatttacattgcagaaagtagcttttaaaaaataatcaaactaaaaataaatttaaaaaaaaaagttaaatactcaaacgatctaatttatatgtacttggcattatttgggtcgaggcagcttactatttgccactctctcattatgcccacataagcaatggttttaaaaagccatcaaatttcgagaatcgaaaattgctcaacagggaaaggggggaattagccaagaaatcaaacagaaaatattttaccaaaagagcttaaaacagatttaaaatgcgtcgtttgtcttcttcttattaatgacatcctcttcggcatccttttcatcatcatcgtttctttattcatcaccatcgtctttctttgcacctgttaaatacacaaataaattttttttgatcagttttaacaaggcgttaagtcaatcaaacccccaagaatttgcgattaaagaaaatgccatgaaattttcgtctaaacacaaaatgctaatctcaaggaccaattaattcaaaagatcaattataaagaaatttatcacccccgccacccaaggtgtaataatttaaaataattttaaaaatatttcataaatataatctgatttttactaacttcaatcaaaaaaatagcattattcaaatcactctaattgttcacattaacagtgacactcattaattaattaccctncacgagatgcactacaat

SEQ ID NO: 31590 - DNA, 1087 bp, Heterodera glycines
tcattctccaatcattattcattcttcaatcactcattgttcatgcccttccccccgtgtttccctagtccactcaaaccaatcgaattctttcttcaccgattcttctgctgatcatttccattcaaaaggcagcagaaccgttcattgcttcgcttttgtttctgctgctgttttccctctctccctttcctctgatcagtttttctgatcactttatctttgtttttttggtcccacactcttttctgcttatgtttcttgttattatataattaattgttctaattaagagaggagagagtgaaaagtgagagagagtgcattgaatggtcccttttttctctgactgcgtttgtctctctcttcctctctctcttcccttttctctctttctcttccctctctctttttaattcgctaaattatgcattttttcctccaaatttctgagggccaatcacaaatcatccctccgaaatgaagagacaaaagcaaattgtccgccaccgccgcacaatcaatttttgtttcgtttcttttcaaattgaccaaattattgtagcaaagcgactatcaaaatttcgcttttaaatgctgcttcttttttattatgtttttttgtgtcaatttattctttcccattttatcgccgattttaataaaatttttcgttcgctaaaaataaatttaaatggaataaaaatgtgacaaaaaaggaaaggacgaggcttctttgggtggaatgaaagacaaacaaataaagaaaaaatatcagaaaaagggcaatcaaagagagaaaaaagaggggggggggagaatgattagccggaaatgggcaaaagcgaagtgatcggagagggacggactgatcagcagacaaaaaagtgatcggacaaaagtaaacaaacaaagcgacggggggaaatggacaacggcagaacaaaaccatcattcatttctaaaaaataaaattcaaagaagctttgtctgggtctgttgtctatcttaaaccaataattctttttaaaattgaaaaaggccgcgctcaaatttggcatttttatttttaatttttgactctaga

SEQ ID NO: 31591 - DNA, 1673 bp, Heterodera glycines
acatcgacgatgaagtcttcgaattgctcgggtccaacgatgcactagaccaaatgacgaacaggtataaaaagttttagtcaaaaaatggtacaatatttagaacaaagaacaaatttgttggcagtgttaactgcgctgatccgctcaacatacaatttccccctggtcttttgacaaagaatgatgagtcagtcctcatttatgatagccgtgaagtgaggactggacaatctgatgtcgtcctgattttcagcaatagcaaggcgtgtctccatattttcttttttaattaatataacttcagttgctgtcagtgctcaaacaaaatcggcggtggagcttcgacggcacatttcgcagtgcgccaaagccatggatgcaggtgttcgtcatcggttgttatgtcaacaaccgaatggtggttgcagcgcaagccttactgcctggtaaagcttctaagtattacacagaagtccttcagcagctgaagcgtgcaattgaacccctccttccaataaaaggcaacagaaatacagcaaatcgccttcactgataattattttaagtaatgagcgacttcgagatcggaatgttgaaagcgatgcgccatgtcttcccgtcatgcgaacactcgggctgcagcttccacatggcgcaagcgttgttccgaaaggccaggagcatgggaatttttaatctgttggacgaatatgatgacgaagcactggttcaaataaaggtcgttcacaaaacatttaggtttttgtctttcattagctcatctgtgtttaattgtttcccaaatcagttctctctttggcactcattccagcagtttacgttcggcacgccttttcaacgattcaacgcggcaccgcttggaattcaaggatggcttgcgtattttggcagaacatacattggcaccattcaattcgagattgatcgcggggcggaggcatatgagccgcaggctgatgtaggacacttccttctgcgtcgcattcgaagcacaactcgtaaatgcgcctcttttaatgaaatttatgaaattttaattttagcgttcagtgtgtcccaaacgtcaataatgacaggtagtgggccaatacaattcggactgcattcgccacaaccatcaactccgacgattccattgtctgaagaaagcagcttacaacttcttcgacgctgggaacaagagatcgtccaacctccgcgcttcccaatctcgttttggaatgtgcacaccagggctcaaatggaaattgagcgaacaaacaacggcatggaagccgcgcatggacaatttgcagtataaaatttctccataggagtatttatttttgttaatttagcgtgaactcaatcatcatccgtcactgagtgatttcatagcagcattcatcaaggaaggacatcgacaaacaactggacattggacgagcagaacgtctccagaagagtcgaaaacgaccgcaacggtacatcatcaaggaacagagtgttgtgcgtatccttgacgaggctgactttgaatcggaagaaggattggcaaacgccttgcatctgctcggactcgtaatgcagggctttgtagaggggcttcacatccgtggaaatgatgagagtgatgaagaaactgctgatgccgatggaaattgaattta

SEQ ID NO: 31592 - DNA, 1163 bp, Heterodera glycines
  misc_feature (76)..(76): n is a, c, g, or t
  misc_feature (92)..(92): n is a, c, g, or t
  misc_feature (111)..(111): n is a, c, g, or t
  misc_feature (1025)..(1025): n is a, c, g, or t
  misc_feature (1089)..(1090): n is a, c, g, or t
taaaatataagcgtattgtatgtgcttatttgagggtggctaataatttcgatgcagagaaatttcgacaaactantagaatgagatggctntatttaaaataaagaattngatgaaattaccgttggtaaaaatgaaatgaaagacaaaagattggcaatatttaaattcgatagaaaatgcagaagtgtcgatttttgaggaaaaaccatacatataaaaggcagagaaaaatgacagaaagtgtctttttttttgcaatcataatttacgactaattaattataagtgtgttcagcgctaattgccacaaaatgaagcgaccttcaaggaaaatgtaaagaatttttaacaaaaaatttcataattacctattttttacgcatttcagctggatttgtcttgacgtttggatggacattcttcggcgcgccaacgattcgtcaactcgacgattcgtcaactcagccaaaatgcgacgattcgtcaactcagccaaatgtcaacgattcgtcaactcaacgattcgtcaactcgacgattcgtcaactcagccaaaatgcgacgattcgtcaactcagccaaatgtcaacgattcgtcaactcaacgattcgtcaactcgacgattcgtcaacccagccaaaatgtgacgattcgtcaactcagccaaatgtcaacgattcgtcaactcaacgattcgtcaactcgacgattcgtcaactcagccaaaatgcgacgattcgtcaactcagccaaatgtcaacgattcgtcaactcaacgattcgtcaactcgacgattcgtcaacccagccaaaaatagttttaaaaagcagtttcaagagcttttaatggcgcttagcacaattatagcattcttttaggctaatttagaaacaagaacacataaaatcacgacccttccgatgaaatattctatcaaaaacttgcataaacaaattttattaaacaaaaattcaaagaaaaaaacgaatcaaaatgatgattatcagggattgaggttanacaaatttcaactgatattatagggtgaatgaaggtttaaaaatttcaatcaattgcaattggnntcatcttccgcttctgcatagtcctcatgttcttgtgcccctcgtgcacgcagcccgcccacatatccctgca

SEQ ID NO: 31593 - DNA, 1004 bp, Heterodera glycines
tatcaaacaatcttacgatatttgaaactcaaacaaaaaaaattcttgaccaaaaatggttatctcttttttctcatttttttaccgcaaacttggtaccaacagttgccttctcttgtctggccctatcaaacaatcttacgatatttgaaacgcaaacaaaaaaaattcttgaccaaaaaatggttatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttctcttgtctggccctatcaaacaatcttacgatatttgaaacgcaaacaaaaaaaattcttgaccaaaaatggctatctcttttttctcatttttttaccgcaaacttggtaccaacagttgccttctcttgtctggccctatcaaacaatatatctgaaacgcaaacaaaaaaaattcttgaccaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaatggttatctcttttttctcatttttttaccgcaaacttggtaccaacagttgccttctcttgtctggccctatcaaacaatatatctgaaacgcaaacaaaaaaaattcttgaccaagaatggctatctcttttttctcatttttttaccgcaaacttggtaccaacagttgccttctcttgtctggccctatcaa

SEQ ID NO: 31594 - DNA, 1225 bp, Heterodera glycines
  misc_feature (1126)..(1126): n is a, c, g, or t
  misc_feature (1181)..(1182): n is a, c, g, or t
taatgcgatttgtttacaggtttttgtccaaaaatgaccaaaatttgcgattttgggctaattttttaagaaaaaatgaaaagaaatagttttgaaaaagaagaaggtaaaagaaatagtataggaaaagaaaaaagcaaaagaaatagttaaagcaaaaagatttctcttggaatgccggagatttgagtcccagagattgaaaaaatttaccaaatttcctttgattattttttccacttttccaaatgctcattttcaaggacgtccttgccattcaaggacggatcccatccctgcattaaaataaagagatagtacccaaacagagagaaattacaaagaaaaagagaaacgacgagatagtactaggcttttctctgcacagtggagttgacccatagtgctacaccataaatgccgttgataggcatttaaaattaatcattgatttaattggcttattttgaaattctatgtgggagtgcagacagtgaaaatttgacagttcctatgttaatgcatgttgtatgtaataaaataaaaatagtttaaaaaagttttaaagaatatgtaattattatatacttttacatcattctaattaattacagaaaatgcagagacttgctaaactggccaatactggcggacttttaattcctttgtctggtgccgttcagacaatttcgacgaggggcgttcttcgtattccgcactgggagaatcacatccgtttcgacccccgatttggacgcaagcgaccgtgtcaagatgtattggaccgattcgcaaggctgaacaatggtcttcttctttttttatgcttcattttcttttaaatttacaatactttccataaaggtttgtgggtgcgatcgcgacaaggcagaaacaaacaagtttatcagaaggacgagatttttcgaaaagtcaatatgcagtgggacacgtgcaccaaaagagaatgtgcaatgcttgacaaggtccccttgtcatgacaatatttatcttttcagcgcactcacattgtttctcttaattcaatttgtgtttagcttatgactccgttttggcttcgtcccaagcattacgtcggtgatccaatggagccttatcacacgcngtatgggatcactttcgcacgtgtcgatgatcaaaaacgtcttgtgcgagaaggnnccaactcctgctttgacgattgactctgaccgattcttttgac

SEQ ID NO: 31595 - DNA, 502 bp, Heterodera glycines
tcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaattttgaagggcggggggggggggggggc

SEQ ID NO: 31596 - DNA, 1075 bp, Heterodera glycines
tcgcggctaaattccagtcgagacattcccacgcttgatcaacgtgtgcacgtaatcgcccttggcctctgacttctgctgagccccagcgcccatggcctttgacttcacaatgggccccagcgcccttggcctttgacttcatgatgggccccagcgcccttggccattgacttcacgatgggccccagcgcccatggcctttgacttcacaatgggccccagcgcccttggcctttgacttcatgatgggccccagcgcccttggccattgacttcacgatggcctcagccaggcccgtagtgtagaacataaaagatttcgcccggtgggactcgaacccccgatctctccaaagcatggagtgctctgtccaactgagctacgggcgccacttgtagagtttctcctttttgcgcctgcttttgcttcagtctgcgccttcgattgcattttcctcagttgcgcctgtcttcgatctcagtttccaccgttttgcacttccattccgccccagattgtgcttcttcaaattgtgcttcgtcaatttgcgcctcttcaaatttggctttttcaatttgctcctcttcattttgcgcctcctcatgcgtctcttcaaattgtgccacctcttttgcaccttctcaacgcgcctcctcaattggcacttcttctgtttgcgcttcatctttgcgcctgctcattttggccatcctcaattcgcctcctcaatttgcgcttcttcgagtgtgagataggctcactgcctaagggctcggcacactgccgcccttctgagtgcgagataggctcgctgcctaagtgcatgaccattctttactgaggggctgtggtgcggaaggcgaggcgccacgggccaaaaagagacccgaggggccgtatggcgcggaatggaaagcgccccggtcacaaaagatccaagggaccatatggtgcggaatggaggcgccccgggttacaaaaaacccgggaggccaaaaggtgcggaatgcaaggcgcggaaaggcgaggcgctacgggtcacaaaagacccgaggggccctatggcgcgga

SEQ ID NO: 31597 - DNA, 1151 bp, Heterodera glycines
acttgtattttttatttatttaaaatttcaaattctttattctttctttatgatgaaaattctattaatttgcagattaaccaatggcatccgactgtaatccgtgccaatggctctgaagtgatggcattggccacaatgttaaagcagcacagcggaggcaaaattggcactaatatttgtggaaaaggcccggattcgaatgtggaaagtgctgcagcgattggacacgcaaaagtattaaaaaattaattaatggcaataaataaattaataccagcaaatgcaaaatttaattttagaatatgaaaattattgaatctaattgctttagtgtttttttgtaaagattaataattctattttttcagattgtacaaatcaaaatttccggggctcctaatggcatcaccaaattattaacgaagagcaaaaaaagattttaaaaaattgccagtttaatgattattgggttcaactctgaaattcattcaaaatttcccggggcccctaattgcatcaccaaattattagcaaacaaaaaaaaattcctttatcaaatttttcttaaaattaaaaaaatgtcatatttattgtttttttggggttcaattcatgtaaatttgatttaaattatgttttataattaaaaggatttggcattgtgtagcggaagtgttgtggcaatgactggcaaaactgactttttgattgacccatcatgtccatcattaatgacccaattggacaatggccacccactgatgaccaaagtcaccggcatcggatgtgccctctcggcgagtgtcgctgcctttttggcactggccaaatcggacgagcacaaacgacgcattgcctgtctaaccgcgttggctgtacgtacttaaaacagttgatcagagatgattctaatcaaagaaagaccttttttggcattcccggtcaaatttatggaaataattgatttcatcgaaaataattttttttatagttttagctaaggtaggtcgggaccgggaccaaaacacggacaactgagtaccgaagtctcggttttggccagttttgatcggaacccggaaaattcccgggtttttcccggttttcccagccaaaaagtccggttttttcaaccgaaaagtcccggt

SEQ ID NO: 31598 - DNA, 1280 bp, Heterodera glycines
gggcttaaccctatctgtccaattggcaccatacagtcgggctcggcggcacaaagcaaagccatgcaattttaaattattttatttagttgggttgagattttaaccaaataattcttataaaaaatgaagcttatgctatgataagactgcatacttttctattttgtcccccccccctccctggattatgacgccgtgttgggacatttcctaaattccgccaatttgtgcaataaataataaattagtccatatttatttactacacatcatatgcctgatggcggataggtcctagcaccttatgaagaagctacagcattttacgccaaaatgtcttttactgagtgaaaaaatttgatggttcgatttggttaggacattcaaacattacggagtcggaatcataattgtattgcatttctcagcagttcaaattacccctaaaaatctaaatgaaaaaattctaaggcttgtgacaaaacagaaaagtacctttgtctaagtttttaccatttcatcacttgccgcgtttgctcggatttgtgcataatcacaaagtttgtctcgaactgtggcgggtcggttttgatgatgggcttataagttccaatcagttcgtatgttctgttcggctcaaaattggtgtacattggcaaaaattcgtacattcctgggaatatggggtgaattacaaagtaaggccattgaaaatgttttttttaccaggatgagttgacatattcattgtgtggagagcaactaaaaaatgataattagtttataattcactcattaactttaaaaggtcaattcatttcactcacagcttgggatttgcacagtgccaatttttccgttttgcatcggttcaaaaaatcgtttgaaatcatttttacggaaaaccactgaagtgtcaagccaaaccacagtgtcatactccaataaaacgtgctttaccattttaacgaatcattttaaattcaaaatttaaaaataattaccgcccacacaaaaattttccacgcgtaacttttggggtggcgaacccgtccttccaccatttgaccgaaatcgaaaattcgccattcgaaattgcacaccgaatcccattcattcatcttcagaaataaaggaaaaaaacattattagaaaacggatttttaagtacaaaaatttcacgaagttggaactagctgatttattattaaatgaataattttaattaaaaaattttttttgaaaaaattcttaaatttttacttaaaaattttttt

SEQ ID NO: 31599 - DNA, 989 bp, Heterodera glycines
ccgcgaaaattatgcttcaatttcttgaatgcttttttagaataaaaccaaagaaatgcaaatgtcaaaaattttattaaaaatttatttataaaaattcctttttcaaaaaatttttccgtttctttcttgttaagtattaaagaaaatatttggcattattttaaaatactttaattatttattaacagcagtttactaaattaaccatgttttacttgtaaaaaactgtcattctcaagaaatgcatcaaaataatttggcgaatttaagaggtgccgaagtttatgaagctttatagtatccaaaaatgaaattgttacctatgtcctggaattttagtatctatttcaaattttaacacctatttttgggtcaactatttgctgttttggcgcctaaaaattttatattgaattgtaatgcatgcgtatgtaactttgcaagaattgacataaaaaaatttattatactaaaatgccaaaataagtgccaaataagtaaataaaaattatgaaaatattgaaagcggatttatcacttgttgtggacatttttgaggctttgtggctataactttgtttaattttttgggcaaacgcggcgaaactgcggtttatttcgtcacagaaaggtccgctgaggactatttgaattagtaacatatgttatttgaatgtatcagttgaacacatgtcatatatattatatatatagggcttggattgtatggatttccataaatttaccctgcgctgcccacaggtgccgtcggggaaaatttgggtttttaatgaaatttgtttaagagaattgttcaaaattgttaatttttaaaaagcagcgaacatcagcggtagttaagcattgattttatttaaataaatcattagtattaaaacattgattttttcaatggcagacaaacaagaaaaggaaaatgaaaaattaacctggtgattgcttttttctttaaatatgtaaataaa

SEQ ID NO: 31600 - DNA, 1326 bp, Heterodera glycines
ccaccccctttttccccctttttttttttagccatttctcattgggttttccgatccacccttcggggtacaaaattgtttaacctcccaaccttttaaatcaaaatcttaaaaaaaatttggttgattttttcccctttttattgggcaaatttttgaaaaaattatttcttatttaaaataaaaaattcagaagcaaatacaagattttttttatttttaaatgcattttttccccatgaattatgattaaattttggcgtttggattccatttgaaaattaagaaaaataaaaattgataatcatttgatgatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaactctgtgacccctctctgactctgccaatgcaacagttgtccatttttaccactattttctctcactcatcgtctgctcgtctctcctttattataagctatttttccaaagccaacaacgcccttttctccctcttttctgttagtcatttctcattggtgtttacgatccaacattcagtgtacaaatttgttaaacctctcaacattttaaatcaaaatcctaataaaaatttcgttgaatttcttcgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttgaaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaactctgtgacccctctctgactctgccaatgcaacagttgtccatttttaccactattttctctcactcatcgtctgctcgtctctcctttattataagctatttttccaaagccaacaacgcccttttctccctcttttctgttagtcatttctcattggtgttgacgatccaacattcagtgtacaaatttgttaaacctctcaacattttaaatcaaa

SEQ ID NO: 31601 - DNA, 1686 bp, Heterodera glycines
gatcaaaaaattggggtataatcattttaggattttttctgtttttctgctgaaacctttagacggcattcttttgccacacaacgccggcgaggttggcacggtcacactgaatgtcgttccaccagtcggtcgcacgggtgccacacttggacacactcttccgcggactgatcttttgccaaaaagcatcattcatattagtagggctgccaaaaatatgtacaaaaatatgtaaataaatttttaaaatggttattttcttgaaaaaggcacaaaatgccataaaaattatctaattagcagggaacggatttatatgtgctaaaaaacgccaaatctgtacatatatatgcgccaaaaatccccaaaatatgtgctaaaactcaaaaaaggctaaaatatgtgccaaaaaatgaaaaatatttaattttaattatacaattcaaatcggtgtcaaaaataataaattaattagacgattatttaaaaaaaataaaataaaaaagagataaaagcattccatctccgaccaaaaaaaaattacatggaaacgaaaaatttaaatttcaaatcatgaacccatcaaattgatttgcaagtaagcttactagtggatttttcaattttagaaaaaagacaaatctactaattttctactgaaatttcacccaatattttcgtaaatttaagttcttcattcgtttccccataaatttcatgcattttccccataaattttccatcatccctattctttttccactcaaaattattctgcatttattaatggtacgaagctagcatttaaaaaacattgaagaaaagttgaacctcgaattttaaaattattattaatattcaattaaaaaatagctttaaaataattcaatttaaatatttttattgacactgatttgtgagactattttcaaaatatgcacataaaaagtaaaaaatatgcacataaatttttccaaattgggcaacattttcacaaattcttcaaattcgttaaatttaagctaaaaatctcgaaaatagctaaatgcaaaaatatagctaaaatttattaattttgaagaatctgagtaaaaatagaaaatttttaatttttggacatattttccattttttaaaaagttacattttttattaatatttttgaaaaaccccaaaaaatgaaatttttgaaaatttttcggtccttagagatcaaaagtttctgttccttgtttatgaattttgcaagctcttctcgtcatttttgtaccagtgttatcctcgggggttatcgatggcgctgatcacgaatctgacatcagattatcatataaatcatctaatctatgatttttcatcaagtgataatgtcaaaaaaatttttgatggattttcacttttactgttattcattcacaaaaataaattccatcaatatgtatgtagctggaatagttgttcgagacgaatgacacaagtcaaaaatccaactttcacatgaaaacattttcgacaaattttatgttgtcaattaattttatgcatattcaagtacatacataaaaggtataaacaaaacagtatattagatgaaagtttttttagtgggtgaacaacggtaaaaaagtgaaaatccatcataattttggcatgaatttactagaattaagcagaccgagttct

SEQ ID NO: 31602 - DNA, 953 bp, Heterodera glycines
ccaaaccaagtttaaaatatgtttttcgtgcgtttccggtcttccacagtccaggaaaaaaaatatggatttccatataattccgtaccctagtgattatattcgaaaataaatattagaatggatgaattcattatactcttttagctgtaaaacggaacttgatttgttctgtcttgaaatcgacaaataaaatgtttattggaggagcaaataaataaacaatttagaataggcgcataatattttggaggagcacaataaatttaggcgaaggaaaatgagtatacaattataattgtatttgattttcataaaaaataacaataatttttaaatttgaagaaattcggaaatattaacctcagtcatttttggtgcatgtgacaaataattcatccaacactattaaattaataatatctcgtaaactataaaaccggttttaatcgtttaatatttaaaatacagaaaactaatggttaaagaatggttggttccaaggatgttaggctttattacaatttcacggctttaaaaaaaattacattaccaaaaattgtttattttatataaaaatatgataagtttaatgctccataatttccctgtcataagcaatcaaaaaagctcttattgcctagcccgtcggtttctctatttactcataaaatttctaactaaagttatgctgataaaatttactcgctttttcgcattttttggttataacttttttgttagcaaaatttttggaattgatattcgtgtagagaatatataaatgctattattgattcggcatataatgaaacatgcaaaaattagcttggaagcacgctcatcaggaaaagatggttgtggtctttcacttggtcttttatgcggtctctcgcgctctggattgtcattttctgctttgaaaaaaatacggaatttataaaaagatatta

SEQ ID NO: 31603 - DNA, 1329 bp, Heterodera glycines
  misc_feature (1192)..(1192): n is a, c, g, or t
  misc_feature (1287)..(1287): n is a, c, g, or t
  misc_feature (1302)..(1302): n is a, c, g, or t
gaacgactcaccacggattttggggtttaggtattcatctatttatttttatttaagctaaaataattatttatttaaatattggtgtttgtatacttaattgtttttccgcataataatggacgaaagtgagtgaaatattcccatttttacattcatatttttatttatttttcattcatgaaaaggataaagggtaaaaatcaaaatactgaaaccactgatttgatatcaccagtcttcaccgagagaagtcgaatggtacaacgcacaacaaaattacatacgatactaaagtgtaggtctaaccgtgctgagccgaacctaaagaagtcaatgaggcgaacttaaagtctcaatgctaataatatttaaatttattattttaaatttatttgcagaatactaaaattgtaacttattgttgctcaaactaaatcaattttggtacttatatgtagggccgcaacttttagtgacgaaaaatctcgaaatagttaactaaaatagtgagtaaaaatgccaaaatagtgacgaatagtgacataattttcagccaaaaattgagcaaaaataatttttattcactgattgcagttgcaaatgagtaggactgggattagctccaaaaaatctcacaaaaaaaattttttttttcaatgatgtgtttgtctccacattcctttattcgatgtatcgcctcgattcaattctttttttggtataattgcacaaatattgtctaaaaataaccaaatttaaggattataaattatgccagaatagtaaatttttatgggtgtttttgtctaaatccagggtttctatttcaaaataagaataaagaccatcaaaaataagaacattttgcaaaattgcttcaaatatttttacattttattcgatcaaaaatgtattctattattatatttttcatagatttcagtgcattcaggatcactacatcagatttttaacattttttgcggcacatttccaaaaaacttggtgaatgtgcgaggggagaggtccggtggtgccgattggcgccgcaagcggaaaatttttaagactttatatgaattttgttagaaaatagccaaattttttagaaatttcccttctttagatgaaaataaggtactaccccaaaaccagaacatttcttagaaataacaacatagaaaaaccngttttttttgaaaaaaaataaaatcaaaagaaacgtcaaatcggtgtcggactcatacaaaaagtatttggtaatgggtgagcactaaccactanaccacaatattttanaaatacaagcaattttactttatttca

SEQ ID NO: 31604 - DNA, 1026 bp, Heterodera glycines
ttgttttccatttgaatgcattggcgttttgttttttacgctaatgattttttgccgcttttttctttttttaccgtccatgaagacaaacgaaatatttttgtctaataaaaaatggagtagcgccccatgttccttggtatacaaattgattaattttattacaaatattacaataatattcaatgagagaatgctaacaaaaagtgagttaattgtttgtttgttttggttttttctcttctccccactctttccagcgcttttcactaattgcccaaaaactgttgctgtctgatcagcccacaatggttttgatcagttggcagaattggtccgagtgcaaaatgcccacgtgagttgggcccacaatttctgtcacactgtccacctgaaagtgagaagccgcacattccccattttatgcttttgcccatttaatttcatctttgctcttgccagtctcagaattaccaatttgccctgctccttccatttttggcacattctcatcgattcggcatttaccaatccgtcccccgggcccattatcgtgttcgcttttttgtcaattccgttcggatagtcaaattccgtcggagtgcctttgtcggaaatcgaatgcacacaaaacatctttagcaaaacgattaaatctgaatcggtggaatagcttaagctttaccggcgtgtatttatttgcgtcgatttgtgtcgacaaactttggtaaagcgattgcatttgggcgatgttagcaaccgacaaaagttgtgccaagtcggcaaaagtgtaattggtgcccgaaatagaggccaattttgtgtccgattggaatgccaacgaattgggcaacaggaaagcgacggcagccaaagttcggataaattttctgaccaccaaatttggcacaattagcgaaaggccggggaaaagccggtcgacatttcctaaattaactagaaaatgcaccttttttggtcatttaccagagagtatctgctcgatgataaatgttgtgccgcccc

SEQ ID NO: 31605 - DNA, 1111 bp, Heterodera glycines
tcagaatattctgattattaaggttcaaacttaataaccgaaaaagttgtgattttcattgcaaaatcagaatgcagttttgctttacctttcatattttaagtattttgatgactcagaatattctgattattaaggttcaaacttaataaccgaaaaagttgtgattttcattgcaaaatcagaatgcagttttgctttacctttcatattttaagtattttgatgactcagaatattctgattattaaggttcaaacttaataaccgaaaaagttgtgattttcattgcaaaatcagaatgcagttttgctttacctttcatattttaagtattttgatgactcagaatattctgattattaaggttcaaacttaataaccgaaaaagttgtgattttcattgcaaaatcagaatgcagttttgctttacctttcatattttaagtattttgatgactcagaatattctgattattaaggttcatacttaatcaccggaatatttgtgattttcattgcaaaatcagaatgtatttttgctttacctttcatattttaagtattttgatgactcagaatattctgattattaaggttcaaacttaataactagggttcggaccccgtgggcgggggtggcttttcacgggggcgggggatggcgggggtcagagtcgcgggggcggggacgggggtttgatttgaattaactccaaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggtttttggggggccggcggtgccgataggccgcctggcgaattttgaaatttaagctcgatttctaacagatgtttacaaaaaaataagatttttacgataaatgtgtgtttttttaatatattaaattatcatgatttactccagcaaaaatggaaactcagatttgtaaacatattttcttgaagcacattttttccaaaaaaaaaaaacttggtgaatgggcga

SEQ ID NO: 31606 - DNA, 1508 bp, Heterodera glycines
ccacgggctgtgagtgccaaaaaggaaatgcacacaatgccaatgctttgttgtaaggtgcacgaaatcggccacaccctcggcctgggccattccaaaaagcagcaggccatcatgtttccgatctaccgcaaggagcagttggaaatgatgcaattggacgtggacgacaaatgcgccgtcaattggagttatgtgggcgccaccgatctgtgtctgtacatttggctgttgagtgaggtgttgccgaagaaagtggcacaggaaagggagctgtccagcaacagtgagcagggggagggtacgaacggaatgagaaaggggtggggacacccccgggaaggggggggaagcagtacttgggcatgaattgtttcattaggcgtctccctttcctccctggcagtgttagcggatgacaaagacgcgccctgggaggacatggacgccctcaaaatgcgtttccgtggcctcaccatgccgcagtgtgggcatggcccgggtggtcggatgcgttcgcagttggccgaattgctaaggcgtcgcttgggctttggccatgccatcgcccgtgactacggtaatcaccgattttgagatggaatctttcattcattcatttccgtttagccgaaaatctttgcgaatttttcgacgcctttcgcaaagaattcgacttgaaaagtacggacaaactgcacgaagtgatccgtcttcacagcgtgcacaattacttccatcccggcgacaatttcaacaaattcgagcagttcggccggaaacagcggttcgactccgccttctttcaccaattaatggcaattttctttggcgggtaatccaacggaacacagaaagtcattcccactgaacgcactttaacaaggctgagaaaaaacataaaacattgttccccaatttggcatttctttccctttttggcattttccgtttttctcgcccttgtaattctcccccccccccattttctgtgcaatatttttgttttcattcgttgcattttccatcctcctcttctcccccccccctcattttcctcatcttccggttagttttacgatagaattgtccttattctgctgcccattcattcccattggtctttgccctcatttgtatttcgtccgataaattctaaagtaattaatttgattgattaattggtcaattacccaattcaaacgaaaaaaggcattgggcgaagtcgaaaaaaatggaacaccaaaaaagtggggaatggaggagatttattggaacaaatggataaaaggaaaaagaaaaggacaacagaaaagtcgaaaaatggacaaaaggacaaaagacggacaaaaggacactcattccattccaatttaaacaacatttccacaaacaatcaatatatacatacacaaaagagcaaaaaaaaacccctcccagcgaagaaatgtcaattaaaaaacattcatttaatttatggggttttggaatcccctcccccccccccc

SEQ ID NO: 31607 - DNA, 959 bp, Heterodera glycines
gagtagattagactataaaaaattgaaaattttgaaatcatgtttccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcataccccatttttcgcaccgtgaatgttatttttagtgaattctgaaccgttttgagtagattagactagaaaaaattgaaaattttgaaatcatgtttcccactcccttctcccaggggtattattttgtaaagtctttttttcccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagcagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcaaaataacttttcaaaccccatttttcgcaccgtgaatgttatttttattgaattctgaaccgtttgagtag

SEQ ID NO: 31608 - DNA, 1670 bp, Heterodera glycines
  misc_feature (1667)..(1667): n is a, c, g, or t
aatgttcagcgcgggacttggtttgtgcagtgcatctgcagagtgtttttaaaagggcgcgtgaggatgacttgctcacgatgatgacgcgagtcaatcgaatgatgcaggattttatgagccgagacgagaaggccaaacaagtcccgatggtgagttattctctcaccaaattattttattttaaccccgaataatgtatttattgtgtctcttttattgttttttttggttttaaataatcccgttggcccttgggaaaggcataattaattatattatattgcaataaaaaaattttaacattttattcccattgacattttaaatttacagaacaagaggagggtttaatgtggggtgtgtgttcatttgttaattgtacggtgttgcatttcacaaaatttcaaaatagaaatcgttttcaaagcagttgttgaaaattcgcgattttaaaggcatcaataattttttattataagtattattagagtattacaaaataaagacaaaaaaaagtgggcgtttttttaaatttcttataattttaattcaaagaaaaaataaattgtgcaataaaattaaagtccagtccggcgggaacggcattcttgcgggaaaaccagggaatcccgtttcggtcttttttgcctgacgagatttttacgggaacgggaaaaaaggcgggaattccaccctgttcatatacctttccagttcccgttccctgtaaaattctgtctttcattatttgtcgcttgggttcaattccctactgaaattggagatttttaatttttttataaattaatttaaatgatagttcattttttggacaaattctgttaacagatttcacaaaaaaaatcaaattttttccccggcgacccctatcggcaccacctgaccctcctgtaccactaaagattttgtaagaggtgcgccgcaaaaaagagacttaatcaataaaaaatttgtcaataaattgaaaatatagaaaaattctctaagaatttggaattataaactttctttttcgttttcccgttcccgtgcatggaaaaattttttaccggaactctaaataaaatggagggcgcccccacaaaatgtccatgccacgaaatgtccacaagagtaaaaacacacgaaatgtccaaaattttcaaaatttataaaaacaaaatgagtctaatttggggtttttaggggtttcggggtcgctgaatacgaatatagcctttatattaccccttgcctaaccttaggcccatccgaataataaaaaactcaatttcaagacttggacatttcgtggcctggacattttgtgggtcagcgcatttttcatcgcaaatttcattcaaaatttgtgacattttcccggtaccctcctccaagttcacaaaaagttttgaaaaaagcgcgctgtaaaaaacgtgtaaatagtcactccttttcccaaaaatgttctaaaataatgaaaaatgacaaaaaaagattttgataaaataattgaataattttttcaagagaatatactaaaaacatttgtgaaataccttttacttggttaagaattaaaaaagttagcctattaaaatatttagaaatttttttattataggagatattttttgaaaaatttccgatttcttgcaccgcanaaa

SEQ ID NO: 31609 - DNA, 1460 bp, Heterodera glycines
attttttgtataaattttaattatcgtttgttttttcatttttttaaatgttttttgtattcgtttttatctttttcaatatttaaacaggatatcatattaaagcgtaaaaattagtaaatgaatatattcatatttatcctttctttattttgataaaaactttgtttaactattttattaatctaataaatttattttgcattaactcaatgtataatataataaatatttaacatcattatttaacaatattgttattagacaaaattatggaatttttgggattcatagattttgtttttgttttattttcaaatcggctgttaattttcattcctaactaataagaattttttaaatatttcattatttaaataccttttattatacttataaaaatttattttcagcctcgttttttgatcgcccccagcttgacatcattgctccttcgaatacgatgacagttaaacaatggtttgttcctcctttatataattaccattaaataattacgtaaattttttatttttttgtacttgcaaatattattagaatcattttaaaagaatgctgttttttatttattctattcatttttagccgagatatttgcccacaaataaatgttttattatgtttattttaaatatttctttcactttgttattatatttcattatagacttatttatataaatgaattactttgtttaatgttttattatagctatttttatctaaaaaattagctccatatttttaatatgcaatttgttgcctaattttcttgttatttagaaaattgtgccgactattttgagtgaattctaattttattgcaatttcctccggtttttgtgataagcatatcggccatggtccgattgtatctttcaccgcttgacgactagtgatatggtagatgtctggtgtttgaatccccaaattttggctagagattcaaatgttatgttcagaaaatgagtgccacactcagtgacgagtatttttggtagaccgattaagctggtattatatttatttattgtgaatttcaatctctaacagataaaattatttattaagaatatattttaataaaaattttattatttgaatttttcagcaaagtatattatttatttttatttgatattaatgaaatcgtacaaaatttattgtgctcacgcggccagctttgactcatcatttttcatttaattatttacattaaatttgataatatctcttatttaaaatatttatattataattaataaattttttcattaaagttgaataataaaagtgtttaattttttgataatcatttttcaattaatagatatcatggattggtaaatcatcaaattttctttattaataaccatgacattaacagaatgttttttttttcaatttgaaataattcacttacaaatttctgctttatt

SEQ ID NO: 31610 - DNA, 1777 bp, Heterodera glycines
ttttctgtcaaaagaaacatttatttgatttggggtaggggtaaggtgtggattttaaaaaggttaaaattcaggggggtttggtgtttgaaaaatcctctagaagaattcgcttttctcgaccctttaattatccatataaaatttaaaaaaaaaactaacgaattgcccggaaaactcattgttgagcagctgatcgaagtgcacacttcagacaaagtggcactgatacaattgacatgttcgaacaaagccaaaactaaaaatataggaaaaaattaagttataggattttgaaaattttttttacgcattccatttaccccctcccctaaaatttgcattttttttgtatgccgggttgggaaataacaaattttgggtaaaaaatagaaaattttcaaaatgctttgaccatgcgatgccagccattcgtgtcggtccaaccccttaggtaatgtgcacaatttgtccaacatttggtcgtcaacagagtcggccacgcaattgtccaccgattggacaacttttcgtgccgattgagcagagccggactgaaaaatggattttttttttaatttaactgaaaatttgcaaaaattttcctcggctgcgccatttggcaccattttggacgactaagttccctggattttttaagaatttgacacaaaaatgccatttttctccgcggtgtttaaatttggaaaattataatggcaaaaaaatagactaaataagagcaaccaaaaaaaaaaaaaattttttttttcgggtacccacgtcgaaaaattgtgcgaaaattttgtattttttcatacttgcgaaaacgatgggatatgcaccgcctttttctgtccagacgatgtgcacgcggacggtccgttggtgtccggcacgggacacacgccgttggcacgggactcgccccgctggggtgccaagtcgcgcccaccggtggccaaatcggcgcccttgcgacgggaacgactaggagaaaaatataaaattttatacattgaaagcagattgaggcctttgtaagcaatataataacctctttgaaaggcgaaatcaggcctaatttttttttttttgtaattttgaaaattttaccccaaaacgaaaaaaaaattggaatttgaactcatttttaaaatattacaagcgttcaaataggttgacaagccaattcgacgtttccaaatcggcctctttaaattcatttgaattagaattggtgtttaagtcgcaaacggcgaccgttgtaaaatggcgtttaatattctttggcatatataaaaaaaactatcaataatatgtgttatccgagggattatctcttaaaaaatgggtttaaattaaaaaataaatttttgaaaaaaacgacctaaaaagaaagacaattctcaatgaaatgtaatgatttattatcgacgagttaatttattatttgacagcagagcaataaaatcaaaaaaatatttactcaaaataatgtttatttacaaataatttgtgtgtttgtcttaatgagaagtgtttgctgtctgaattttgtacggtttaagaattaattaggctaattagaaatgagacggagagaaatcggaaattatttttagtaacatatcattatgattattttttgctttgcttcatcatttgacggaatgcaaattgagccaattaaataaattgggagtttttagcgggtgaatttttgagggaaaattttatggaaattttagttgtaaaaattcatgataggtttttc

SEQ ID NO: 31611 - DNA, 918 bp, Heterodera glycines
ctttgactgtttttgcctctgccgctcaattccctgctcattcattactcattgtttcctctgttatgtgattattcccttttttgttttaattaatcaattagcactaattatcggttgatggcattaattaatttcttccttgccttcccttaatctctctctctctgccattcccttaatctgtctctctctctctcttcatcgtcccaccgtggtaatcgccgtggcttttcccccttcccaaaatgcactctttcgcctgcgtttgctccgtcttcgtcttccacccgttttcatctccaatccgtgaacaaaaacacttcattctcccctttttccctctcatctctttcgcgtccgtccctctcattaccctctcaatgggcttcttccttatattcctgatcactttcacgttcttccctggtttgtttgattattcaacatcgctaattacactttttcgatgttttttgacattggcatcactcaaatgggggggggggcgtgagtgacttccccacccccagcccacaaagtggccgaaatggaggggccttttcgcagtgggaggggagggactttaaaatggtgagggagagataggggtcgcagcgagaattgtggcattgtttagtaatttattaataaatttcatcaaaaattaaatattttacaggagaacttgaaacttctctaaattcccttaaatttcatgtccaaagcaaaatctgttaagaaacgcaccaaatttccctattttcctttattctttgtttgtttttcctttttgttatgctgttttgcttagtctgctttattttcattcaaaaacatttgtaaataaatgtaaattaatttgatcattccgtcgtcactgtgattcactttggaattggaagggcccgtggggat

SEQ ID NO: 31612 - DNA, 1547 bp, Heterodera glycines
aaaaaaaaaccaatttttgggattttgagctattttttttcaaggaaattaaggagttttagtaccgctgagagaatttttttggaattttaaatgaaataaaaatcaaacaaaatttctgtgtttttctactccccctcccacttgcgttcgacaaatccctctattgtttgtgggaattgcaggattatcccccgggatcccgttccgcaaaaaaaaatttgggttcaaatcccggagcgggatgcgaaaatttgaaattccctggctctagcagagatagtttgattatttaaaataattaattaattattttgtcattttgtctcacttcccaagcccatcacgcgctgtacggccgaaatgatgcgctccaaatgtgcaatttgatcagggatgatcccattcttgttcacgttcccgacaccagtctcgaatcgtgatttttcctggcgctgatcacgatcatcatcgccaagcattgtccgctccaaagtgtcggccactgttgataacggatcgaatggctttctgactaaaagcaaataatttatttaaaattatttaaaaatatttttgtacattttgtgggcttgatccgttggccgggcaatggatgctcagtgttggcacggctttgcttaatgtggtcccggttttcttctctcggcttgatccgctgatcaatttggtcattgattttgtgcaatgatttctcagtttgggcgaatggcatcacttttggcgctttatcatccgtagttgtcttcttccgatcgttgacattattctctttgggatcgcccagatcaataatcactgctttagacttcaccgaagtattggcagcatcttcctttggctttatctgatcagttccgatcgtttttggctctttctgatcattagtctcttcctttggcttcataaaatcagttgaattcgccttcggtttttcttgatcattaatcccttcctttggctttgtctgaccgatcattttggtcttttgaccatcgatctcttcgttttttttcatctgatcagtttccaatgcctttagctttccatgatcagctatcacgtcctttagcatcttctcagcattaatttgttctttgttgatgtcatgctcttttttgttgctctgatcagtcaatgcttcttttggtttgtccaggccgttgctttgatcagtaacttctggcttcttttgaacattaatctcttcctttggcttggtctgatcgatcgttttggtcctttgatcattagtctctttgttttgcttcgtctgatcagtttccaatgcctttggctgttcattgttgatgttatttttgttgctctgatcagtcaatgcttcttttggtttgtccaggccgttgctctgatcagtggcttctggcttcttttgaacattgatctctttctttcccgcccgctgatcaatcaccactccattcgtcgcatttttttctttgatcacttctttaggcattttcggatcagcgatgatccccgtttttttctctcttcaactttct

SEQ ID NO: 31613 - DNA, 1103 bp, Heterodera glycines
aaaatgcttttttcgtgcttatctaagcgtattaggtgcgcagaaaaaagaagacctaatgatcagtccctgtaatatacttaatgaaataaatttgaaataaaaaaggttcaaagcgttcaattatgccattcgccgttcacttaagtgccgatggaccaaaacaatgtggcggtgcaacggaagtcgctgagtcggctcgaatttggggacatttttgtaaatgacagagaagcgatatatgttttgctatatcgtatttcctaaaatggcttttaaatcaaatataatttacttagaatttatggaattggtaccattttattggatttttgggttctaaataatattatctgataaaattattttatcatgcaacttcaaaattgattaattcaatgattgtccatgttctgaatacaggatttatttaatatttggccatttttccatttttaacaaaacaaaatcaaactatcatattttgttaagaaaagatatttacacctttaatcgccaattaaattaaaggacaaataaagaaagcataaatactttccattttttcacttttttttgctttccttcaatttattccattgtgaattggtcctaaataatattatctcataaaatgattttatcatgcaacttcaaaattgattaattcaatgattgtccatgtcatgtttctcttattcaattcagtgacatatttcactccatgaaattgttaaaatataattttttgggttatattttttcatgatcaatttgcttccaaaatacctagcccatttagaagcgttttaaaacaaaactaaattgaaatttggggtaacgacagattttggcgtcgatgaatttgaaaattttaatgcgattattttcttcacaagaggcgtcggcgggagaaaatttcgcaaattttttgccatttcttaatagcaattttgggtttggggtcaaattctgaaatttacacaaaatttttcaaaggttaaaatttgtttaatcaaatttcgtttttattttcacgaattcccattcgcaatcaatattttatcataatgggcgaaatgtttcataaatatagcgcgccc

SEQ ID NO: 31614 - DNA, 1229 bp, Heterodera glycines
tttttgcgatttttcgacaaaacatggcataactttgcttaaaggcaatcaaattttacattcttggtactgtttaaacaagctttttttctattagctttgcaaaactttaactaaaattatccaacatagcataagttatggcagaaatagtacttattttcgtacaactttttgtaaaattaaccaaattttttgttaatttgcatactaatagagaaaaagcttgtctatcgaatggtactaacaatgtaaatttgattgcactttaagcaaagtaatgccagttttgtcgagaaattcgctaaatggcggattttatggaacattcaaatgccaataaatatatatatatatatatatatattatatgcatgaattaaaaattttaataactataaaataaaaacatttattcatgaattaatgtcataaattgaaggcacgtgagacaaaaaaaatgattaaaaaacacctgctggtccttgaaacttcaaattctgcatcgtttgttgcagatgagtgaattggccaaaagtttctctttagtattaatatttatatttaaaaaatgggaatttacataaaatttctttacaattggccagactaataaccatgacaatttgcacttttctatttatatgcactataagccatcattgtatatgattaaatatttcattatatgccatcattgtatatttatatggactataagccatcacatcattgtatatttatatgcactataagccatcacatcattgtatatttatatgcactataagccatcattgtatacaatatgcactataagccatcattgtatataacatgcactgtaagacaccatgtatatattatgtatgcctaatagtagcatggaaatattctttttttggcacattgccaaaaagaagggcaaacaaaatgaggggtgaataatatgtatatttttgcacttgttgctaaaactttattataatagcatagaaaaaatatacggcatcgttgtaaaaaaaatcatcaaaatacaaggcatcattgtaaatcattattaaaatggttattgttgggcacgtgaccggaaaatccggcagtggaaaatgcgtcagtagaaaatgcgtcaggagaaaatgcatcagtgatgcaaatattttaaaataaaattctatgacattagtattgtaatagagaagtaaagttctataaaaaaatcattctca

SEQ ID NO: 31615 - DNA, 1306 bp, Heterodera glycines
tctccttcctcggcatcggccgtgacgtgaagtgtgttgggttatttcggttggaccccaatggcatttcccccggcacaattccccctttgactttcattgttcccccatttcacagacattgtgccttcatcgttgcccaatcttttgaccatttcgtttgctatgttttccatgccgacccttccgccgcttcactggccaaaacaatagaagcggcgtgtaagctgaggtaccaaaaagtgatggacgcgcatttgccggacaacggagaataaacggagggaggaaaaagatcggatggaagacggacaccacattttgaataaaaatggataaagtcgaaattcatcaaggggatgtcgggacaaaaagcagcgattttagaggaattaaaaggccattgggccctccttttttatactttgttacactgaaaaatcagtcgttgaaaaatggaacaattatttcacgacatggtctttttttcctcggcaaaatgtcctcagatctgattggagaaataaagggtggaacaaaggttatgtgctgcagaagaacttcggtatcggatctaatagaaaataaataaaattaattgtacgaaaattccacaattcttagtggtatttttgaaaaattttttagaccgattctcaggggtgcattttttgaaaaaatgtttaggtcgtttcttaggggtgtatttttttggttttattgcatttttgttaaggaattttcctaaaaatgtcgaaatagtaaattttcactattttagtacgaagcgccaaaataggtagtgatttctagtgcccgatagtgacatcagaatcgaaaaatttcaacgaaaaaatacgttttttgagctcctttcttcaaaacaattgagcaaaaaaattcgttaaatcactaaaagtagcgacactaatcatcagaaaagccaaaaaaaaaaaaaactaaaaacttttaaaattaaaattaaaaaaaataaaaaaaggcttcttcgtgatcgtttcgtccatctttcaccattaaaaattccaatttttatgcataccggaagcaagaaaatgatagattttttgtcattttggagtcattttcagaagttctttaacataaatgcaataaaaatgtttttttttgacgcgatgacattttttggcgacatgttcaaaataaatttcaaaaattttccactaaataaatcatcgaaaaataatctcccagtctccattagtctaccaatctccaattatctacccccttctgaggaggttgaaaaataatataccatggcata

SEQ ID NO: 31616 - DNA, 1176 bp, Heterodera glycines
aaaaggtcaatggaacagttaaggggaaaaagcttccaaaaaactgaccgtaatgttggtcaccaacatcagaagacgcccgaaacggccgatggccaattgcatttgtgtgcattgatcaacctaagaaaaagcaataaaatataaaatacacagatttgcataattgtaaatttaattattgtaattaattataccgtatttcctaaaatataagtccccctccctctcctctgaaataaaagcccccttcctttttgagagagagggggggggggggtttaaagatactgtagaagtgccccagggctctttttttagaaaatacggtaaaataaattttgtcaaaatttcctaccaaatgcaaaaacagcgcattctgcacactgtcgcgcgccacgttcagcagacgcaccgtttcactgctgaggccgggcgtgtgggcgtccaacgcgacgattgccttcagtgtcacatattccacctccgtcagcgacagctgttccagcgacggttgctgaaagcgcaaaataagatttattttaattgaaataattattaaacaatttttgagggattttttgccctcagataaccaaaaccaattagcaatgtgattattaactgttgaattgtaccaaagtgttaagccattccgagcgaattgcgccgatgcgccagcgcaaagactcggggcaatgactgagcggaggcaccagaaggttcagcggcgtacgctcgtcgacaaacagtccgttcgggagcagaatttggtcgggtcgatggacaaacgaactttggcacgccaccgcaaaaaccataaaaggcatggcagtggagcggagcaaactcagctgaaaacgagggcatttttaggagggaatttggaaaaacattcattgagccgctttttaggaaatgaatatttatttatttatttttgaattttacaaattctcaccctttccgccaagtgcaaatccgcgatgggtttcagcgtatttgcgtagtcaatcgccagcaacatttgtcttctcaacgcatcgcgcaattcggcccattcgccgagcggacgcccaccggagtaattaagctgaagggggaagcgaaaagtgattagaaagcaacagactaaataatttaaaaatttgaatttgttttaaggtctaccccccc

SEQ ID NO: 31617 - DNA, 1025 bp, Heterodera glycines
aaatgaattttcttaaatttataaatgcagcagtgtggtgcatttctttaattgaactgataaacttatattttttaattaaattagaacgtaagttttgtttgtcaaacaaaacttcttcttatgttttgacagattgagccttaaaatgatcaattatataataaaatcaattctctatcttgaaaaccttttagttcttaaactaattaaacaataaaaggaaaaagtgcgcttgtttttctcccatttgattcagtcgattagtctcgtttttatttaatgcattttcatacggaattttattcaaaaattttgagacctgtgaaaattatattcaagagattaaattaaattaaaaattttcagaaatcatggcttctttttctcccgtttttattgccattttaataatcatttacacttccgctgttggagcgcaatttggtcaatttggcagtttgctaaacggctttggaggtgccaatggcggcgccaatttgatgaacggaatggcggccaattcgcgcaactttgccaatatgggtagcagttttggcggcatgatcaatcagttcaaagggatgggacgaaacttcaaaaggcagttcggaggcaacccttcgcatcatcaccatggaaaatgatggcacccattcattcagtgttcattttgtggctaatatcacacatacatattaatataataaatgtatatgttttcagtgtttttcattttatgaaaatagttaaaaacgctataaaaaaatttctgatgaagaaaaattaaaaactgaaatattacactataaaaaaaattttttttttttactattattattattattgccaattaatttctgcaccaatgcccaataggctgttgttgttccctgcaactgtgaatagatctgctcattctcttgtcacaaattaacctcagcaccttttactaagcatttgggcagctaattaaagaagcaccaacaattaagtgcgtggtcattgtcgtcgtcgtcttcgtc

SEQ ID NO: 31618 - DNA, 1217 bp, Heterodera glycines
gggggggggggggaaaacaataattttttaaaattttttcattttttttttttttttttatatttttttccaaaacgggtttaaaatttaataaaaaaaaccattcccgggggggaaaaaagggggtttaaaaattttttggggaaaaaaaaaccttttaaaaattaatcccctggggggaaggggggggggaaacaatattttcaaaattttttaatttttttttatttttatttttcccaaaacggttcggaaattcaaaaaaaaatacctttcccggggggaaaaatggggttaacaaatttttggggaaaaaaaggtttcaaataattcccctggggagaagggagtgggaaacagattttaaaattttcaattttttttattttaatttacccagacgggttcagattccaataaaaataccattcccgggcggaaaaatggggtttgaaaagtttattgggaaaaaaagagtttacaaaataatacccctgggagagggagtgggaaacatgatttcaaaattttcaattttttctagtttaatttactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctgaaagaaaaaaattttcgaaaatctgagtctttcgtctctagggagatttgcaaaattaattcttaaataattttcagaaagg

SEQ ID NO: 31619 - DNA, 1110 bp, Heterodera glycines
tttctttcctttccttccctttgcttccctttctttccctgtccatccgcgttccaattccttcggttcccctccctttcctattcatccctttcctttaatcctcactcacagtccgttcctccatgcttcctttcccccgtcgtctcttttcgacccatccctttcctcttcctcttcttcttcctctttctttcttcttccactttgagctcaccgcttccaaatctgtcgttcatccaacgcactttcattacttcaaactccggcattcaaagtgacgacaaaagcgctgacaaatcgggcaataaacggcgatgaacggaaaaaaggcgaaaaggaagaaaaggcgggggggggggggagcgacggtcattttgttgaaatccgaaattgaagattaattactgcgaaaggggacaaccccgcaaattccatcacatccgtcccctttccgcttgtttcagctaatttcgcatccaatgccaaaaaccctttccatcgccaagtgccgggaaaacagcgccgatgtttaaaagggtcctcccccccattgatgaaagttatataattttgaaagagaggaaaaaatttgaatgactgagaattttaaattttgttaacccgggcctgctgctctgctgtaatccgtgctaagatggcctaatcctattttttgttttttcaatttttatattatttctcgatctgctgacgtcgtatcagagtaaaaagccaatagcaccgaattgtcccaaaaatgccaaagaaaggcggcgggtcctcccccccccctccgtcgctattctttctcagtcccggcatttgtttggccaaagctgcagcaaatttggccctattcttatcaaatgtttattttcgcggatgagcaaatatccatttattactgtttcaaattactgcccttccctttttcatttcttcgctttgcttctcttcctctcactctgtggtcattttttcttaaaacttccatctttgttctcgtccgcctctttttcctttcccattaccccattctctcccttctctcccccctctctctttctctttctcttcctccttctcctcttctcttcttatctctct

SEQ ID NO: 31620 - DNA, 1479 bp, Heterodera glycines
aaaattagcaatttgccaaaaaaaacttaagatgatcaaatgattcaatttatcagtcccattaattcacctgccaattctgcccgttgaacagcgccttgagcacttcgtacccccagagttggtaattccggccgatgaaagagttcagaacgaagaattgcatggccacgttgcccaggtagagcacctttatgccgacgtacagcagctgaaccgggggaaaaaagaacagattaaacaagggggcatagaaatgtcagaaaattcaagaaattataagttattttcagcgccgaagagaaaaaaaaacattaattagtaaccgctgttcgagaaaaagtgacgatttttttttgccattttgagtaaacatttcaaaaatgccaataggtgtcgccggcagaaatttttgaaattttaatgcattttataagaaaattttttttaaatgccatttttctggcaaaaatttttaattgttcgtttaaggggtcgagaatcccccccccccttcccctgtctacgcgggcgtggacacaataaacatcgaatgattgttggactcattaaaacgcggcaaattcataattatatttaatggtaatttgttgccatcaaaacccaccgaaacatatgcgcccatcgattgcccaaatcgacagccgacgatccgccggtacgggtcccgattcagcacggcttcgctcagcttttcccggagttggttgatctgctcctggcgctcctcaatcggtgccaggggcatgcccttcagcttcgttgcctcctcgatgaatttggtgaattcgatgcctgtgaaaaggggagaggaaaagggagtgaataataattaatcaattaaataattaatgaactaattagtcataataacagtaggagggatttgaaaaaatttagcaaattcttcacataaaactgcttaaaatagtaagaaaattttcaaaattaccacttaaaaataatgggagaactgagaacatttgtgcccatttctctttgccaaattaggagcaaattcagtccccacacccctccgggagaaaatggaaaccgaaatcttccaattgcccgattttgattattttcgaggacttaccgctctgctggttcagatggttccacaaccagttgggcaggtagaacagcatcgcttgcaagaagagcattatcggcacccactaatgggtatgggtgtattagataattattttaaagaaaaacaaaaaataaatttttgaaccaaaaacgaaaatcataaattacaaataaatacgtgtccatgataaattttcaaaaattttccaatgtaaagttattttaatggtttttaggtccgtagaatctatttcaggcattcacttcgagttaaagacaaaaattaaaactttcggtgatcgttttcgaccattttcatatttttaaatcattaataaaatcaaaaaaacattttttttt

SEQ ID NO: 31621 - DNA, 975 bp, Heterodera glycines
  misc_feature (944)..(944): n is a, c, g, or t
tcttaatttgggttttaattcggaattgggtcagcacccctttgaccaattccgacatctatttatttttaaagttatttctttttttttattaatatttcgagaaaatagccaaaaaaattaaattttttgaaaatttcgttatttgaaggtcaaaagggccgctttaatagagtggaccgttttaatagcggattttttgaaaaaatatacccaaatacgcacataaaatatgcatagaaaatcgcgtaatgtgctaaaatatgcaaatatgcacaataaatggcgaatatgcacaaatatgtataccgtatttgctctttttatgtgccagtctccattaatctgcccgtctccaattatatacccctttcggactaggttgaaaaataatctgccagtctccatttatgtgcgaggggggataaatagaattttttaataatttagttggcacatttttcaaaaaaaaataaaatcaattcaacggtagggatacgatttatagttttttcattatttttttctgagctccccgtggccttaaatgcacgaaaaacatgttttttttcggctgttgttaagctacttttggagttattagcaactattttctagttttttatttttagcaactaaaaaactataaaatttttgataaaaactttttcaactatttttgggtttttcccaaaatttgtctaataaaaatgcaataaaaacgaaaaatatacccctaagaatcgacttaaaaattttttttcaaaaataaacccctaagaatcgacttaaaaatttttttcaaaaaatacactcctaagaatcgacccgaaaattttcaaaaatacacccctgagaaattaaaaatttctcaaaaattcatctccaaatttatttatttattttttaacaacaatttttgattttaaaattatttatctcanatactgatttggtttaattttgtaccttttt

SEQ ID NO: 31622 - DNA, 1772 bp, Heterodera glycines
  misc_feature (1582)..(1582): n is a, c, g, or t
  misc_feature (1679)..(1679): n is a, c, g, or t
  misc_feature (1727)..(1727): n is a, c, g, or t
  misc_feature (1753)..(1753): n is a, c, g, or t
aaaaaaatcaccagttggaaggaccaaatttaattttcgttataattttttaatatatcaaaaagattttttcgctgatcatcgattttgtttaatgaaaaagaaaaataaaaaacaaaataatggatatattcacgtatctatttaaataaaaaaatattaataaaaaagatattaaaatgatacaattttattgtgatttaaaacatcaaatacaccgtatataatttaaataatatagaacatatagaacaaaaaagagcatcacgatctagaccatttcttgttcttgtagatcatgaattcaaaactttgttattatagaaattaaaatcttaataaaaaaatatgcccatatggaaatagataatttatttatttacacaacgatattcgaccatttttaatttaatatttattcttcattaaagtaatataatgcaatattctgaagaaaataaagctgtaattgaaataaatattgatccggattccggactaaaaggaagagaaccgctcattcgattttgccatttttgcataccgattgaataaaaattatacattatcctttaattataaaaaatgaaatataaatgaaaaaaatcctttttaaaaaagagatccttttaatcagtattaattttactgctttatgcatttattaaattattcatcaataattatttatttaacatgaaatttttcagaaaaatattaaatgttgataaaaattagattagatagcatatctaaaaataaaaaatacaaaaaacccaatggttgaattgattttttgttatttcttgcatatgaataaccagcggtttatgttagggttcctcctcgagcctcggggagcaaaatgtcggggaacggggaggaaattccccgaatgaatttgtcggggatggctggagaaatttaaaaaatgtcggggagcaacaccttcgtcggggaggaaattttcataaaaagtctaaaaaagcacaaaaagaaaaagtccagaacaaaaaagtcttaaaaactcatttaaagatacttccatcttatttcaagtgcaatttacgactttcgtaattccccgaaacatgtcgggggttaaccctaaaatgaacttttaaatgggtttattcaacgaaggtataattttcgttttgatgctctattaaacacccaaaattattaaatgtaaactttttgagagaacaccgtgggttactgaatgatataaaatcaaaaaaatttcatttgattgttttttgactaatggccattttgattgctcacagcgtccacttctgatttatggtcattttgctaatttcaagttgccaatgatggttttacttttttaaatgaagattagggctgcgataccgagtatattgttgtcactagagactggcgcgggacgggattccgagcgggattctacgggatcccagtccataatccagcattttttgaaaattgcgggattgcaggattttgctggattaatcccgcgggagcccattccgcagaaattctgaattccaatccagcagcgggatcagctaaggacatctatcaacaaaanttttagaatttttccattgctacaggccggcctttgcaactggcaaataaaaaatgtttattatggaaagattagaaactttcatcaattggttaanaatggtgttggcaaaaagttagttgcccaatttattttttttagaggntaatgcctccgtctataagtgctaanacgacgatttgccatcaaa

SEQ ID NO: 31623 - DNA, 1237 bp, Heterodera glycines
attcattaggcgcttggcaacaagtgataatccccccttaggccagctaatataagcttaagcggctgatggtggcaaaagcgccgggggcggggcgctgagaaagttcaaaagtcaacggcggcggagcgtaaaaacactgtcaacagcacggcacacaacagattaattacaaaatagggagattagataaattgggaaggacacaaattgctaaaaaacaaaaatataacattaataaaaaaaattggtactctaataggatttgataccatttatgtgggattacccaaatagaaatatttaaaaaatgaaacacattttaatgttaaagataatgggttttggactcaaaagcacacatttgttttgtgcgcaatttctcaaaaaaaaaaaaaaattttttttggatggcttccaccggttttgaaactgatacggagtaaatttttgggtttgaattaaaaaaaatatatttaaatttaatggtcatatttttaaaacagatatttgtgcgtgccgctcagtcaaaaaaaaatattatttaaaatatttttataattttcaacgaattttcatttaattttactcaaactactgtgcaaaacaacaaaaaagcatttaaaagaattacaaaaaactaatcacaacaactttttttttgtcaatgcgtacatccgcagcaaaagacaaatttgatgccaagaaaacaaagataatgaagatttaataagccacattaatatatgtaggttttagtttaaataaaatttgtcacgaaaaaagtcataaaaaatgcaagtacgaggcttcaaatcaagtgtagaacacttttaagtcattttaaggtcattttaaggcagcaaaaaaagtcatttttgacttaaattcccagccctaatgatgcgcagaaatgcaaaatttatcaaaagtttttttttctcaacaagtcagacagacaatgacatcatcaacaaataggtaaatcactcaatcgttgttttccatcggaagcgtttgttcgtgttcaacatcctcactatagggaaacgtcaccagcaggaccttgcaatagttcagcttgtacacttttgcgctgaaaaataagcatatgttaaaaggctgccaatttttaagcttaatttatgagggacagcaagcagataaagcaagtgatatgggtgggacagaattagtgaatgcatatgtatgatgttttatttgatcatttaaattt

SEQ ID NO: 31624 - DNA, 1492 bp, Heterodera glycines
ctgtccggtctcttctcactgatcactttcctctcctttccttacagtcttttccctctccctaaatttgtctgtcggtctgttacttttctctttcgccctaactcttaaaagctcttcattatttccccactcgtcagatcattgccgaccattccccgtccctttgatccgatggcttctcagtgcgtttctcctcttcccgtcaaaggttctcgacggaaacatcctctcctggcaaatttgctcctcgtcctcactctgattagcgtatttattggcattggcatcgccttttttgtcagacaattccaaccttctcaaaggtattgtgccattaggagaaaaaatcggaaacgcaccgccgggggtggtctaattaattaataaaatgaaaattctcgcgactaatccgccggcacttttcgaatgcagaaccatcgacatgatcggcttcccaggcgaactgttcatgaacttgctcaagtcgttgatcctgccgctgatcgccgccagcctcgtgtccggcctcagtcagttggacacgcgtcaatcgggccgtatcggcgcgttcgccgctttgtattacgccatcacaatggtcagagagaatcagtggccactgggccgaatgatcgaccgatcgctcactcattttcccctccctccctccacccattcttattattggttttaaggtgctcgccgttacggtcagtcagtcgatgtgaaaagagttaaatgaacggattaattgggccaaaataaaatagcccggggggagagactaaaggacctttgattttttggcagtgcttttaccctttcctcggggaacagaatcaaaaatttcggaagcaaaaagaagacattcagcacaaagagaaaaaagggaaaccaaaatcgaatgtgaaattttgtggacaaaaactaaacgcaaaagaatttctgaaaatgggacgaaatgaaccaaaaaaacgaattgcgtgccctttgccctggtcagactggcatttgccttgtgcttctcatccatcccggcgacccgagcatcaaagaacacttcgcttccgagaacgattcgcacccggcaaatgtgtccgcgttggagaaactgatggatttgctcaggtggagaagaaataaattggaaaaattgaaaatggactaacaaatacataagacaaaattagtgggcattattattcaattcgcttttcgaattaatttgccttttaatgccaatttctccccccccccccccacttttttcattttccccttttcgcccccatttagaaatatgttccccgacaacattgtccaggccactttccagcaaatggagaccgaatacgtcgaaattcgtccaccaacaaatgtcagcagcacaacagcaattgtacacgcggtgcacagacacatcgacggaatgaacactttgggtgggcaaagaaacggggggaaaagatggcatttttattccattata

SEQ ID NO: 31625 - DNA, 1338 bp, Heterodera glycines
cgagaaatagagttaataataatatgaaccagatcaaatgttcatcaggccccgcatttaatctgcagtatttattgtgccattatgatgcacgatattatttttaaaaatgattaagaatttatttttgctattgaaaccttttatagtgaataaaaatatagaaataattttgtttttaattctacctccgacaacaggtatagccatatcatttaattttctaaaatgattttaggctttgtcgtgaattttagaaaagagtaaaaaatttgaatttacctggtccttcgtttttaaaaattactttgtaacgagaaatagagttaataataatatgaactagatcaaatgttcatcaggccccgcatttaatctgcagtatttttgtgccattatgatgcacgatattatttttaaaaatcattgtcggattaaatccgaaaaaatataaaactattaaaaaaaacaaaaccaaattaaaataataagaattttacctgaaaatacaaaataattaataaaaataaatccaaaataaaataaacatttcataaaattttttattttaaaataaaattaaataaataaatgaatataaaataaaagtaaactaaaataaataaataaaacaaaatgaattcataaaaaacgaagcgaatgcttctcacaataaaaactaaaaaataatctaataaaacgccccaaataataaataaatttattccacaataaaacggttgaacgtaaaagcaattaaaattgtttatgaaaagttttcctttcttaaataaaaggggagaaaaaaaataaaacgataaaaaataatttagaaatgaaaaaaccataaaatgataatgtgtaaattttgaatgttattaaataaccaaaaatttttggtataaaaaggggaagggttttcagtttaggcatgcttcaaccaattcactctgctagcccatcggttctcttcactcaacaagccggacaacaactcgctctgaatacatcacaactcgggcattcgaagcatcgcggatattgatcaattgtgatcagaaatccaccaaattttccacgttgtgtcttttgtcgccccatcccaaataaaatattaaattaattgattggatcaaccagtgcatcccatcaattttggtgccacgacccgggaagtgcaaacgacaaagaacaacaacaacaacaaaagctgatcactgatctgagaactggaaaaagccggtcatctgttcaaatagaaaaattgttgtgcactgttaaagaaaactgcaagactgttcatcatctaaaactgttcttcgtccatcaaaagtctga

SEQ ID NO: 31626 - DNA, 2087 bp, Heterodera glycines
  misc_feature (2067)..(2067): n is a, c, g, or t
agcatttgcaagtggtgaatggccgcggccgcgttgtacgccttgaaaatggaaagcgaagcgaattattttaattaacacttttttgtttttgctaatttttattccgttgaaaccggcaccggattaaagcggatatgaatgagttggtttcgggagtcgggatttcagtgaaattatgggatgttggcacgcatttaagatgggaccgtgggacggacacattttcaaccgggattcgggattctcatgcgcggaactcattccaccgaatgttttaaatcgggtccaggtttgccgcgggttgggaaaaatgtcgggattcgggccgaaacccttggttgggccggcccaaaaatccccaaaacatctggggatttgaatgccttcggcactttttttaaatgacaaatcccatttaacaaattgtcaagtgctattcatccactgatgcttcttcacttgcctttcgccacttccgtttggccagactcttcttcagatgagtgaccacagtgatgtgaatgtcttttgtgcgtgcggtgttaccactgatcctgcaacagcaacaacaaaaaaccatttagaattgagacgagaattcaaaataaattcgagaattgggttatccaagggatcctgggccctgttttagagaaattcaattgctctgccagcaggagttgtgtgaaaacaagatttttgtcttgtcctggtccatctcgaagaccactggtcctgtggtccgggttttaattcaaaattcggggctccaccgctaattacccccctaaaatgagccatgtatgcattaaattgcactgaccacgggtgggccaatgctcgctcgcatgtgtatctttgttccggatcacagcacatcagatgggcaatgaagtccttggccgactcactgatttcgtcccaatatggcgaatctgtgagtgaattgatctgatcgttcttatcaatcacgctgatgatctgctttacatctttacgcatatcactactactaaccaaattcgtattctcccttgatgatctgtgcgaacaaatttgcgtcgttctcatcataaaatgggggatagccgcacagcaaaatgtacgcgatgacccctgaggggatgaaggagttggttggatcactttttgaatgtacattagcaaggacagtgcgtgcgggaattactggttttccagggtccgaaattccgatttttgaaaaattttggggccgcctcggaacgccgtatgcaatcggcattctgctggtcaggattttccaggatttcgatcccaattacggttttgccaattttctggtctcttcctggggtgggctgagaacggcacgagtgttacgccaaacacattaaagtgccatgcattcccgaataccggtacatgtcctcaattttcatggtgctctcaattgtgccgtgttcaaccggccgagtccgaggaatacaatacccaatcgaatccgatgaatacagtagccgaggaactaacaataagcacacgcacagtaacccaaaaaaacgcaccaatggaccaaacgtcgaccgccttcccgtaaggccgttgttggagcacctcgggcgccacgtagccgggcgtcccacacgctgtggccatgatgcccgactcttccgtcttggagaggccgaaatcggagatcatgatcttggagtcgtcctcatggttgtagtagagcaaactgtaccacgggacgggaaattttttttttgtccaagaaggcataagtattgcacatacttttctggcttcaaatcccgatgcacaacgccattgtcatgcataaatgacactgcttccagcacctaatgaatcatgtaatttgttttatattccgaaagatttatggcaaattttaatcgaaaattccatttttttctgtctactatgccctcaaacttatttgggaaccccaagaactaggccagcagatggtctagaattttaaaggtcagcaggttcactatcggattttgcgaaattctgaaaaaccccccaacggttccgtggaaatgattcatccangattaacattataatccaag

SEQ ID NO: 31627 - DNA, 994 bp, Heterodera glycines
  misc_feature (956)..(956): n is a, c, g, or t
agggcggtgccaatcgccatttaatttctcagagaatttttaattttatcttattccaagaaaaatgattatctctattttgagaaattttatacgtttcaaatgctctcgagcatgataggaagtgcggtgcgcaatcggcatttatttcacagagaatttttaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttatttctcagagaaatttttaattatcttatatccaagaaaatgactatctcttatnttgagaattttatacgttacaaatgctctcgagcatga

SEQ ID NO: 31628 - DNA, 966 bp, Heterodera glycines
ggccagggatggacgaaatttcgtttcgttttcgtttcgtcctacattttcggcactttttgagtttcgttttcgtgtttcgttttcgtctaccaaagttttttcgtttcgttttcggtttcggttttcaaaattttgtttttcgtttcgtgtttcgttttcgtcagagcaaaattagacgaaaaaagtacgaaaaagcactggtaagaataggccccgttggtagatttttcattggcattccgtttttttccaaataaagggggggggggggcaaactacagaattaccatttttcttagtccgttttttccgtgttataatttccgttttactacacatcaaagtcttttttaggcctattaatgtcttccaaaagcaaatatctccagtattttaattgcgacacaattccaagcggcaatttatggtgttgccgttctgaaaattgcagctacaaatttgaatcaaagaaattgtctgggtatccaatggcttcacttcgttctcacttaaaaaatcaccatcaaccaaaattgaaagaattggaagaaaaagataaggctgcagaaagcctcaaaaataatgaagcgaacccgagacaaccgacgttaaaacgaatttttgcgacttcaagtccagtgattaaaaaaatagcgagggctgaatctgctacctcgtcgcaattaacctcgaaaaaaccttttgtacgaatttaattttaaatgaatttacataacattttcagctcaatggacacccgacggagaaatgactaagaaaattgacaaggcaattaacgatttggtatgtactgctggattgccgttctcttttgtggaagaacctgggctaaaaaatttattaagaatattggttcctcactataaaactaggtattaatttgataaataaaactttcgatgatcaacttttttcaggggcagaaaatatttcacaaatgat

SEQ ID NO: 31629 - DNA, 977 bp, Heterodera glycines
tcactaattggggggtactaattggtcagcggtcaagagggcactaattggtcagccgtagggtgtggggtagcaattaattaattaattggggaaacctaaacctattgaacggtttcaaattgtcttgtactttttttgacagaaaatttgattgatttaaaaagtgacagccgaggggggagggggaatttgattgatttcaaaagtgacagatgagggcgggaaattttttgattaattgtaaaaatgacagatgaggggaaattcaaatttctgatgggggggggggatcggaattttgattgatcaacatatgacagtttttgatattattaaattattcaaatgaagtgaaataatttgttttgcactcggtctttatcaaacttgttatgaatgtgcaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccaacccattctattgtttacccaaaatggcaccacgtgatgactctattaacaataacaataatggtcagccagtcattcaatttgatcaacaaattcgccaggaccctggactaaatgccgtttttgactttgttcgggaacagggcgcacgggtaatttgtcacaacaaattaattttttcattttttgattaattttgtttagcatggcattttcaacacacccgccgaaatcgtcaatgttcttcagcaaatggcacagcatcgactgaatgagcgcagagcggggaataattgagagaatgaagttgagagaaaatgaagagcgaaagttgagaacaaattgatgaaacaatacaaagatgatggaaattctgaattattattttttttttcttacatgattttcttcgc

SEQ ID NO: 31630 - DNA, 1250 bp, Heterodera glycines
attttaagtttattatttctttgatggtttcaattatctttatttttttatgaaaaataaagaattcatccaattttacttctatagataatatatttattaaatgttctaatgtgctgctttatatttcaattttcggtatttttattcttattgttttttgattttacaaatatgacaattttttatactttagaagacaataaattgtgttcttcaatttttactattcagttttagaataataatttataatactttaaaaatgttcaatctttaaagaatctttgcgaaatgatcttaacatgttattttttctattaattattttcttattcctcatctttttctgactttttacaaagcgacctttatcaatttttgagaatttgtgttgtgttgttaatatttatagtttgtttaatgtttaatgtttaatgtttgtatttttagttgtattttcatcttttattctcatgctctttctgttgtgtgttggcacagcggaagtaggatttatattatttatattcattatcaatatttattttgttttattagtaatgatttttaatttatcttaaacaaattgagttttattttttgttgtggctgttagtgcttttttcttttaagataattcaattcaattatctctttttttgcctcagctttattattgttaaactttcgagttttaactttatacagtcatggtcatatgtttaacaacactcaaaattttctaccaaatttgatttaaattgattataaaatctcaatatgactatattgtgtttatatgttttatatttcttgtagcattttttgtgggctttataatgataccattcactatcccttgtaaaaatgttattattagttacaaacaattttaccaactgcactccctttttggggtggtcatatgtttaacaacactacccatatattttttcatagcattaaaaaaatctaaaaaaattcaggtaagcataactttggatgctgatcaaaaaaggtagcaacaccaagttgatcagatcactccttcatggtgatctgatcagcccattttggctgggaacgtggggtaaatttcaaaaaaatttctagggggttgggaaaatttttctggaaattttgagtaggcccgttttatagagcacaaaattctctacaatattcaaaaaaccgcatgtctctatgaatgataccggctgaggtatgggcacttcaatttgacgtag

SEQ ID NO: 31631 - DNA, 1278 bp, Heterodera glycines
tcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcc

SEQ ID NO: 31632 - DNA, 1166 bp, Heterodera glycines
gatcaagtttattggaattattcaaaataatagagcttcagaaggggctctcaatgataccaacaatgttagatttggtggaaaaagaaaaaagttatattccaaaatttgggctggcgcagaaacgagcggcgccgaaacgaggtggacccaaccccgacgcttccaaccccgactcttaaccccgactcggggtcggggttaaatatacacccctaagaatggcatttttgttgaggaaaggcaaaaaatttaaacaaaatttcaattttttaaccattttgccaaattatattaaataaagtaaaatgcatttgtttattagtgtattgtgaggtgtggcggttattgcttcaacataacattactcctttatgagttcgataccggttaacgttttctttttaatatatttttatgtgattaataggattttttaaatcaaaaatacccatgaaaatcaatcatccttgacataatttattgacctatttaacccaattttcctttagtttaaattaaaaattcaatttttttactaaatcatcaaaatttaatacatttcaaaataattttgacaaaaaaaccaaagaaaaaacaaaaaattatcagaaattcataaattttttggtgaaaatctgttacaaaatagaacttaaatttcaaaattcgcccggcgctgcctatcggcatcgccggcgccacaaaaaaaacttattttttcttaaaaaaatttggatcaaaatcgaaaaatttatcattttttggacaaaatctgttaacatacccatccaaattttcaaaatttttttcggcggcgcctatcggcaccgccggacatctttttcctaaaagcctttagaaaaagagcgcagcgaaaaaaaagatgattcgaaaacaaaaaaaagaaaggtgatcagaatttttgaacattttttttgaataaaatccactatttttgggggctaggcgtcagaggaaaaatttgaaattttgactatttttacagattttcaccgaaaattggtcattttaaatgccttatgcgtttttaattaattctatacaaaaataattatgaaataaaaaaacacctataattattaaagaataataaaaaaaattttaagcaaaaataatataaagttttttgattatatggcata

SEQ ID NO: 31633 - DNA, 1084 bp, Heterodera glycines
aattccattaaaataacattcacgtgcgaaaattgggtttgacaagtttattgggaaaaaagactttacaaaatatacccctggagaaggagtgggaaacatgattcaaaatttcaaatttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttaaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttatagtctaatctactcaaaccggttcagaattcaataaaaataacattcacggtgcgaaaaatggggtttgacaagtttattggggaaaaaaagtctacaaaataatacccctgggagaagggagtgggaaacatgatttcaaaattttcaattttttctagtctaatctactcaaaccggttcagaattcaataaaaataccattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagaaagaaacatgatttcaaaattttcaattttttctagtct

SEQ ID NO: 31634 - DNA, 1233 bp, Heterodera glycines
agcaatgctccgtgtacaggcgaaagcatttgccgggccgcgttcgacccgcccttccggccctttggacggcggaggcgcgtgaaatgtgttggacgagcagcgactcgatcttcgagttggggttgtaaatgttgcgcttgcagaagcccgggtcgataacgtacacaacgccatcgatggtctatgagggtaagcattggagagataaagcagaggattaaagaaagggaagggagggaaaaagcattagagagagttaatcagaggattattcaaggggataattatttacaaagatgaagaagcccaagaaaaagaatgaaagactgcggcataacatgaccaacccaccattgatgtttccgcaacatttgttgccacaatgcaacggcgataacccgtaattgctaaagcaccggcaaattaattattaatcaatatttccatttccattaagcgttcaccattagtcaattggttttgctccgcttccaacaatttgcgctgttgttcgagttgcattgagccgtaaagcggcaaaacgtcctaatgaaatattgaaaaggcatttaacggcacaaatgcaaccgaccaattggccactttcacggcatttttttgcctcttcttcaagcatttcgcaggccctttcgatctccttgatttagttgtaattttatactttttaaattttattatttttaatagttttcttccatttttaaaaactttcatttacatcttgcccacaaagaaacagcagaatatcgccgtgcgcttcccttcgatgaattgcaatggctttttccacagcttttgaaatgtattcgttcggctcaaaggtcaaatcccaatcggagtgctgaataattaacgccaattttaatgtaatgattaaattccaattagtaaatatttaaatacttttatttcaacgggaaatgttcgtccgctgattttcattgtaagataatcgaactctgagaaatattgcacaaatgtgccggtttgcagcgacgcactcatcacaaccactcgcaattcgggacgatgtcgcattattctctgatgaagcgggggttataaaaatgttcatctgggataaaggaaatgggaccactgactttgaccagtcccatgaccacgtcggtgatcatcgtccgctcgtgtacttcgtccaacagaataaccccgtacattgacagcatttcgtcacgagacgactcggcc

SEQ ID NO: 31635 - DNA, 1056 bp, Heterodera glycines
ttttcggcactccgttgcgccgatagcaaatgccgtcaaaatggcattgaaagttcggcagaaaatcgtcgtgccgttctcggcccggcactgttcaaaattcgattcccgcttatctcaaaagaggaatttttgaaaagcggcacaaaattaattttgattaattttcatctttttccccaaatttttcagttccttcaaaggttttaacagccgaagaaaagttcggcatatatcagttccattgccaaccgaattttcgtggaaattatactcaattttatccactccaatttccgagcaattgacgaatttggacatttggcagaatttcgatggacattgagaaagtgttggaatttgcgagagaaccaatgtagagttacagattcagtgatgataccgtatacataaagggactttcttggaaaatattggcacaaataaaagaaaagacggaaggcactgacaatgagaagtatttgggcattttctttggtgcaacgacccgagggaaggtaaaacaacacaaaatgactcaacttaattaatataattgacatttaatagatgtaaattggagctgcaaatgttcggcaacatttcgaattgtctccaaaatgattggcgtggagaattccgttgggaaattatacgattttgtttttaacaataaaccgcagggtcgtggctttagttttgaatttgcagtgagtgtaaattgaataattcccttaattgatcaatttgggttaattaaggaattgatggaaccgagcaaaggattttatgacaaaaatggggacaaaataacagtggcaatcgatgttgctgtgtgcgaaccaaaagcggagaaatccatttctaattcaagcaaatcccatgggacactttcaatggatattgaaaaagtctcggaatttgctcgagaagtgtttttgagtgaacgtgaaagtgtaactgtcacatacataaagggattgccatggaaaatattggcaggaatatgtcagaggacggaaagcagtgacaataatgagaaatggttcggcattt

SEQ ID NO: 31636 - DNA, 1010 bp, Heterodera glycines
tgataaaaacaaaacatggcaattgatgttattaaaataaagtgataaacaatgatatttacagacagtgataaattgatattgacaaaaacaaagataaaaaaaataatgataattaatagtgataaaaacaaagtgatagtgataaaacaatgataatcattaatgtgataaaaataatgaaattgatagtgataaaaacaagataaaagcaatggtaattgatattgataaaaacaaaacatggaaattgattgttataaaaataaagtgataaaacaatgatatttacagacagtgataaaataatgaaattttaatagtgatttaaacaatgaaattgatattgacaaaaacaagataaaaaaaataatgataattaatagtgataaaaacaaagtgatagtgataaaacaatgataatcattaatgtgataaaaataatgaaattgatagtgataaaaacaagataaaagcaatggtaattgatattgataaaaacaaaacatggaaattgattgttataaaaataaagtgataaaacaatgatatttacagacagtgataaaataatgaaattttaatagtgatttaaacaatgaaattgataatgataaaaacaagataaaaaaaataatgataattaatagtgataaaaacaaagtgatagtgataaaacaatgataatcattaatgtgataaattaatgaaattgatagtgataaaaacaagataaaagcaatggtaattgatattgataaaaacaaaacatggcaattgattgttataaaaataaagtgataaaacaatgatatttacagacagtgataaaataatgaaattttaatagtgatttaaacaatgaaattgatattgacaaaaacaagataaaaaaaataatgataattaatagtgataaaaacaaagtgatagtgataaaacaatgataatcattaatgtgataaaaataatgaaattgatagtgataaaaacaagataaaagcaatggt

SEQ ID NO: 31637 - DNA, 1299 bp, Heterodera glycines
cttcgtctgccgatttttccatttgttccgtctccgatgagcaaaatcagccgaccaaagcgttgccttccgcggtgaccgcaatgagtttcagcggggcggatcaggtgaggtgcacctctggggctcgctgatcacacgaatctgacattcattggagggttttagcccccccccccccccttagcctagtctccctcctctccctggatacacctttgtttcggtgtcggtcagaagtgagttgttaggttttcagatggaagttttggtcgggcgcgagaatggccgcgtcgaccatttcaattctttgactgaccaattcaatgcgctttttgctttaccacagccttccgaactcaaaggaattcatcgcatcgacgggtttcgatttcggacagcatttaaaacttgtggtaattaagtgatcggattctgactgctcaagaatgtggcactttggctgtttggagcgcttctggagaacggcaaacgaccgaaaattggacggcgggagaaaatttgttgacgatgcgaacagagcccggagaaaggaccggagtgttcgcaacgggcggaagagaaaacccactcaaagtttggaatttggaagagcaaaagtgcgtattcaccgcgaaaaacgtaatgttggacaatttattatacaaaagttggtccattttaaggtacgtccgaatgcgctcgaattacgtgtgccaatttgggtgacgtgttgccgcttcttgggagaaacgggccaatttattgtgacgagcactggcaaaagtcaggtcgcttttagacaaatgagagccaaactcacaatcagttaattttatgacctttgagtcttcgtagttacgactttcgaaccaaaaataaattcaaattttatattccacaccaaatttttggttttagttgaatgcgaggtcgtcatcaaaaaggggtcgggagcagcgatttgttttctcatccctccaaaaaacttaattttctaggatttcgctttttgtgttttcaacaataactttctcgggggacacaaggttttccaatacggattccttaaattattgctaactattatttttttaagttttttcagaaatcgcttttagttaaggctttacgatttgcgagcgcagcggcgacccctttttgaagagaaatggctcgatgagcccattctcgcgttgtccacgtgctgcagagattggcaagtcattgccggcaacagtcggggagaagtcggactaaacgacttgcgttcgtccgttaaatgtgagaccgccttca

SEQ ID NO: 31638 - DNA, 1121 bp, Heterodera glycines
tctctctctctcttcccgttctctctctgtactaaaaatcccagtgtacttctccgaggccaattatctgcttcgttgcaggcattttcggtctctcaacctcagccaaaatgatgccatgccaaaagcatttgtgccttatttgccatttttcctctgctgctgtcggcattttgctgctgaagttgacagctgtttttcttgcgtctgttctgctctcgactgacggaagaagcccaaactgaccggattgagcaccgaattgcctttctcacctcaattttctgaaagcctcccttttcttcgctgccgatttgcttaacatcaaaaggagacgagaacgaaaatgggcactgctcagacaaaaaaggacaaagttcaacgatttgccgaggacgacgagaaaaatggagacggcctcctttgagggaaaatttatgaaattggcacaaattaacaatttaattttgcttaatagaccggcataggattaaagccattagagagttctccaaatattaccctcctccaattttacccattccaagttgggattctgcagtggataagcgggccttacgaacagttgcacaactgcggaaggcgtctgacaattgggcgggcggggggggggcaaagtgttaaatacggcacgtaaagaaagcgggcaaagacattcaaaagatacttgtgtaatggtgaagcaagtgatgatggacacctgaaagcaaaagcattataaagcctagccatgggaagggggagaggggcgggggggggtcttggcttggattagcggactgacatttgcaagtgaatgttaagcaagaaataaagctcaaaaataaaaatttcactaacaaaacacaaagaacaaattttattcgttattttattcttttattatcccccattttgttttaattacattttcaaaatgaagtgtccgtccgtccgtccgtccgtccgtctgtttgtccttcctcttccctttctcttcttctttcttttcaccccttcctcttctcttcctctttcttttctccgcttttctctcacctttttttttgtctctttctcaagtttctctaatggaatagaccgacagaatcaattagcca

SEQ ID NO: 31639 - DNA, 957 bp, Heterodera glycines
acaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgtaaccccgatgctaatccgttccggagagcctcttcaaaattttttccattaccctaagagctgcggaaattgggaattaattctcagaaaaatggctatctctttttaggacattttctatctcgtaaccccgatgctaatccgttccggagagcctctttcaaattttttccttaccct

SEQ ID NO: 31640 - DNA, 1575 bp, Heterodera glycines
ttccacgatattccttgaaccatttgattgatttactagctcactctccactcggcataaattcatggcccataaatggaattggcaaatgccaagaaaagaattccctcttgcaaacgcgaaattgcgtatttagtcatcgcataatcggcatattcattaatggaattaaatcattgaaaattatttttaaaaaattgttgaaatttttttctttttgttaatccaacatttgccaagtgtatgttttgtgagattttatttgtcatttataagcagcgcaacgttaaaggaacagaagaaaggtattgtgggtcgattagcaaacaatttgagaaatttatgatcagagcgacggttttgcaccgttagtctgcatttacaccactaagaaaatgctaaattttaattttaaaataacaacaacactgaaaattaaaaaaaaatcgttttttagcattttcatgtcaacaaggtcacatcaaaccatcttaaaatttgctactgatttgccgccaaatattcgtccacatagccctcacagaaattggcaagcgtttggatgacttaattatccacattatcgctcattaatgggcatttttttttacatttttgtgcccaggaaatgtcctggagattgttgcggtcaatcgtctcaaaaatggcgtcaaattgaatttcgaaaatctccggagtaagttccccgcgaaactggttttcagtcaagccaaaacaattgtcgagacggaagtgagaggcgatgactgaaaatatggaaaattatttctttgtcataatagtaatggcaaattacagtcgaatgatactgtaaacagtaaataaccaaaaatacggtaaaagtgtactgtaaaaaaagaaaaagcactggaaaacttacgatccctcatgttgcgcaagcggttttcaaacagacggaacgacattaatttaatccgacgttttgcctgtccaagccgtcgcctctaaatcccaaaaaaatgtttaaataaattaaaaattaattgaaaaatacattttcttccacaattttttgtctgatcaattcatttctgatccattgggcttgttttttgtacaaaaaatggtcaaatgcaaaagaaattcgcacatttgcccagcgaatatcaaagggaagtgccgccacaatttcgacatttaattcggtcggcatttttctttttggcatttttgaattgaatttttggcataaattttgtaattttgggaggaatttggcgaagaatttgtcgctgttttgggtggagggcgaaatgaaagggcaaatgaatgagtgaatgattatgacgcccacttttgcgcactttgccctccgagcagagactaaaaccaccgctgagaggagggtggagggggtcaaatgtttaccaaaacgaaaccattttaaggtgccgtttaaaaagttagttactgatttgcagaatggcacccgttataatggaaattttttaatattttcctcgggtactcgaagctgaaatcccgtttatttttcaagggcatgtaaaaatttccgataacaaatgaaggccg

SEQ ID NO: 31641 - DNA, 945 bp, Heterodera glycines
  misc_feature (36)..(36): n is a, c, g, or t
gtctggcccgaaggcggtccgagtgctatcgaaatnttattggacggctgagcaggaggcgcgtcctgttagccgttactttgtgcaacgtatggacaagggccgttggattaatgtgtcgaaggttactaattgggtttttaaaattgttatgtggggcgagggaggttcagctaatgtcctggatttctgagatcgggaaaatcgcgaattccagttttcttcaaaaatctttcgagaaatcctcccgttgaatattttacccgagccaaacatcggttatgctgctctctctctactgcactcaaactttaaaaatttaagttgatttactgatgggcaggcaccgcactgaaaatttagcaaatttatatttctataagaattttaataactacaatcaattcttttcagcccattcctttcactggacaagccgaatactgccacaactttcggcctctttcacttgttcacaacatcgagcacactttccgcgtcatcactgtgtttgttgatgggcaggaggaggcgagtgaaacgtttactggccgtctcactatgaatgcggtaagcttcaattgaccgtaattgctgcttaaacattgaatcattttcttgacttgtttagtgagtgaggaaggcccaacaaatgctgtgtcagtgtgtggagaaatgaaaaagctccgtcctcttcacatattgttgtgttgttgctgttgttttgctgttggacatacttatttaacttatttgttctttttctgataaaaccgtgtagactttctttttctttttttgcaggttaaaaagacatttgaagtgcaaaatgaggcggcattagcctatttacctagttggtttttcacattgatttgtcattttgcttgatgatgcaccaaacatcatcattatcattgtcaccctcgtcctgatcgatgccac

SEQ ID NO: 31642 - DNA, 884 bp, Heterodera glycines
atataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggagtcgcgaaaatagtaaatctgaggttattgccgcttatcacctgatccgtctgcaacacttaaacagtttatatttaaagcctaattagc

SEQ ID NO: 31643 - DNA, 912 bp, Heterodera glycines
ggaaaaacgcttatctctttttctgctcaccactctagacaattccaaccccattacggaataatagcgccaaccctaattttcccggaatttctttctgggcgagtttgattgtgaaaattttggaaaaacgcctatctcttgttctgctcaacactctagacaattccaaccccatttacggaataatagcaccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccacccctaatttttccggaacggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaaagagccctatctctgttttctgctca

SEQ ID NO: 31644 - DNA, 1088 bp, Heterodera glycines
ttttttataatttttgccaaatttttgccccgcctccaattattagttttaaatgtttcactaccctaattacatattgttaattgttcttcacccaatattaattattctccccctcccaatccatcgttaattgatccgtccatctttaattgtttcacctcctaattaacattgttaaatttctttgatcagtcattaattttctcctccccctaattatctatcgttaattgatccgcgcatcaaattaggcaatggctaattggcgcttcctgaacgtgttgcaccgcgactcgcgcgtcaacacaagcgttgtcgaatgcgcggcactattaccattgccggcacctgtcggtagtcgaacatcctccactgttccgctttgggtgctactgtacggacagttggacgcgtttgacccgcgcaccggacggcggaacatgtcgcctgcgtttgtcggcacctttgacgggcggaaattccgcgcactgttcgagcaggtgaacaatcttcataataggcttcaagatcaatgaatgttaaatttttataaaatataaaaagaaataatataccgtagcagaaatcaaatactgcaacataccgtattcaaaaattcggcaaaaaagccaaataaaaagttgattcaaaattgagaattataaagattgtgaattatttcaaaaattattgaattattggaagactaaaaatttattaatattttcaacagagtcttaaatatcggtcaaaaatattcctttttcttacaggaattggacttcgccactggctcctatgcattccaagtaaaatatggcactttaacgaaaaattttaattttaaaaatccctgattctggattccggttgttttcaaaacggcatattttttttacccaacaaagtttttctatgcattttcaaaataattttcgttataactttgtttaaataatcggaaccagtgtattcaaaaatcggaagtcatatttcaaaaaaagaggaaatctttgaaattggccgaaaaatataatttcgttaatttttgtgaaaatatcccaattgggggggggggggggggg

SEQ ID NO: 31645 - DNA, 1619 bp, Heterodera glycines
  misc_feature (1571)..(1571): n is a, c, g, or t
cgcgttttgaaatgttcgtcgacgtaatggtcaaatcggtggctaatcgtcgcaatttccagtccaagctgagagcgtggaagcaaatcgaacactttgagccaacagtcggcagaaatgaagctgaaacggaaaagcaaaattattaccatggaaaatcaaatttagataaattgttttacatcgctttttccatttctttatccgattccttcggattgtcagacattctttgtattggtaatcaaagcaaattgaagaagtgaactgaaaaaaaaaatatcaaataaattcggatggaattaatgggatgaagaatatgacgggaaggggatttggtcggctttatataatcgaagtccagaaaaccaatcggagaccccatcagtttgtgccatttctgacaacaatgacgtcacaggttttcttgaccagctcgggagacccattctatagtcagctacagaatgggatggtacagcaaagaccgagcaagaaatggtgcctgccgtcccataaaagtcgtgctccccgcctcatcttttcggcgcacatgccttcaccaatggaataaaaaatcattggaaattcgccgacagttggacaacaaaaggctgaacatcagggaatcgctcactcaagaacaactgaaatcgagacgtgaacttcaagcgcagtgtgccgaaaagcgaaaggaaacatccgctgactggatcatctacaacggcatgcttgtgctccgaagtgaaatcaaaggaaggaggatgaacggagagaacttgagcgggccttttcctcacattgactctctgctgacacgctatcaaaaaaactaattcatgacagcaatgttctgaggtttaggggtagacaaaatttccaaaaaatatattctcaaaacagaaaatcccctaaacctcatcgtaaattttctcatgctaatgtatcggcactgtcagagccacaaaattatttttgggttttttcccttcatttttataccccagaaaactgatgattggcaccatttcccggcaaattcaaaatttgagacaatttttattggtcacgaattgttaaactagtttaaaatgggttttcccattcattgctgtcttggtccattttccaaatcttgtggccatttttcaaaatgtacccattttgttttacaatactttaccatgtccgttcagcaagtacaacaaccaattccggtgccaacaacaccagcaacaacaacaattgaacataaagtgctcaaggaactcaaagtttgttgcattttaagagtaattgttacatttttacacaatttattaatttcagcatttccaatgtttaaattcgggacaaaaacgccttgaaaagcagattttgaactcaaaattcagatttttaagaatataatttagtccaggagactttttattcctggaaaaggttcatgaatttttaatgcgatttgctaagaaacttgggtacttgtgggttttgggcctaaccaaaaaattttaaaaaaggtcaaccaagggcgtgctggaggcgatttagccatttccataccatanatttgcttcagattacggctcgccggcgttcaacggaggcagttttta

SEQ ID NO: 31646 - DNA, 1143 bp, Heterodera glycines
tgatgggtcccggtctttttttctgtttgacaggaaacaagattacaaactctgatccttgattacatctaaatgataaaaaaatttgttttttgttttaagaacagtttatcaggtataaatataaattagaaataaattgacaattaattctcaactgctaatgacaaaaacatataatatattggaaattatttttgtttttatttttaaatattaaaataattttaaaaaattcataaaaaactgcgtaccaaaaattgagtaaatgctttatgtatattttttggatttcaaataactcagttattagatccattttaataaaaagaaaaataggaattttgtggtgggattttcctatttttcagatattcccaggcatcatgcctcaagcatttggggaggcgatatacagtatgaatgaaggcacgccggtaaaagacaagcacaggaacaacgatacggtgaaaaagctggaggcagtcgagtgggcgcaaaagaactcgatacatgcagcagcaaagaagttcaaagtggaaaattttttatttaaaatggatttttggatgattttttctgcaaattttcgtgatttaaaccggttcaaaaaccggtttaaacgctttgccgcgcagtttttgatggtttagctgttttcagctcctaagaaaacacataaaagtatttttatgcaatagtgagtctgagacctatgatggatattttccgacgacaggtatgtaactttattataaagcaaaaataaatcaaaaacaatttttaagagaaaatattttttgctgaaaatcttcgctttcccttatttgtccacacccaagacctacctcatcaaaatttccaaaaaatttttttgtaattttttgggaaatctaaaaacctatcggatactgccgcatttgtctacgtaaaatttgcgccaagttttttatgaatataaataatttgatttaatatttaaaataattattttttgttatattttttaaattagtttttaaattaaatattgcattataaagctaattttcatcaaataaaattttataatttaattaaattatatttatttttgcttataaaatgctttgctttgcttttttgcagtggcttgtgtgtcta

SEQ ID NO: 31647 - DNA, 1931 bp, Heterodera glycines
taacgaggtaataataataataagaaaaatagttgttactttttaaattacataacatactaacaaaatgcttcaaagcaaagaatagacacacttccgaagacaaaaactaaaacaaataaaggctttaatcgttttattattgctatcctttcaaaatttcttttaaatttcttttctattgttaaagttctgaatatattaaaaattaaaaataataatacaaggacttatctatatcatagacaaatctacaagaaagatttatttctaaatgattcctatttcattttttatcgaaaaaaccacgtttcttttaatctaaattaaaataatttttaaaattgttaaatgaaatcaaaaaaaaactaataacgacggcctttaaatttttaattaattttatacttttaatataagttaaattgtaatttgagaaaataaaaaaattctgttatgaaaactttaatactcaaattattcaactaaatattgcgtaaataaagttagcaatagctgctcctacacgtttgaatatggcatgataaactaaattttgtataaacaaaacaatgtattaattatttttcaataaaattataaaaaattaaataaaaattatatacaattaaataaataaaagttaaaaacacgcctcttattgaaattatttcatagctttaatatattaaagcaggaacaaatttgaaaacaatttaaaagtattaaatgcaaaaacaagataaaaccgcgtccagtcatttgcgggcggacatttgcggacggtttttgaatttaaaaaaaaaattattttttagaaaaaaatttggaagagtgggcctcgtcagtacgttctctccggttaaaaagcaactaattacgtgtgtttcagccggcccaaccgtagacacactaacttaaaaagcgcacaccaacaaacaaaaaaagcaaagaaattaaattttctgattaattaatatgtgaaatttattaatcgataaaatataaaatcattattcatggattaaattgtcaaatccattggatgctaagcgatattgaagggctcttaagtgattcacaatttggtatggttcggggtttgcaagtgcataaatctagtgagaagagtgtgtatggccacatcattattatagtatgtccttcgcctaggttgcaaattcaaagcgcttgtggggtccaactcataagtcctaactttgtcttgatgaattctttcttcctctttcgtaactaaaattatactggtcggttttttattcgaaattttttttcattcagagaaaatagtattcatttacatatatttttttttattactttggctaatgtttttttgatatatttaaaaaactgcttatataaattttgaatatagaaactagattttgtatttgttcttagcatgagcttcataataaataaattaatttatgatattaataaaaaattttcctttatcgctttaatttctatattattattattattacttttcttgtcagtttatgtttttacacatgtttttacacacagaaatcagtgttcgattacactttacacgaacttgttaaaatgatggcctagagatgcttcggaatgaagtccaggttaaatttcaaatttatgccattatttatttaaatttttaaatattttattttcaatgtttatttttaatttattattaattttaaagctgaaattgcgagctgctttaacttatgtgaaaaatgattacttttgcgtaccaagaataaaagacaaaacactttgttaaaggagaaaaattagtaatgcttcaaagagtaattaaatattgtacactcacaatcaagatagaaataaagtaaactaatatcaaatttaaatactatattttaaactagccgtatcgaaccttaaccaag

SEQ ID NO: 31648 - DNA, 1135 bp, Heterodera glycines
  misc_feature (1097)..(1097): n is a, c, g, or t
gccagcgacaggatattgtaaggaagaagccgcttggatgagtaaaacgcggaaagcggggattgataaaatccagggggaaaatgaataaaatgataataattgggttatttaattctgcgccgcaaatgtcgcatcaccggcgggaggattatacttagtaagaataaattaaggaattgaatcaaacggaaaagcaatcgaactaattgtgacacttttaaacgacaaaacaaacgccaaccgtatgacgcaaatattgggcatcacaacgaagcatactgtaatagaggaagaaaagggggagagagtgcagggaatactagagagggaagagatggagagcaaaaaggaagtcaacgccggagcagagatgaagaaaagggtgaaaaagaaaaagggaaaaagaaataacgaaaaaacgacggaggaaaacaagacaggaaaagaaacagagacggaagagacacagtcacgaaggaagacgggaaaagaaacagagacggaagagacacagtcaccaattaaaacgggaaaagaaacagagacgaatcaaatgggaaatagcacatgcagggaaggcgacacagaaaaaacgccaaaaaattcacaactttgtcagaaaacggacgaatggacgaataatctgagaggaaaaataaattcatcaaagatcaaattaaaatttttcgagaatgaccattttctgactgcaaaaattgaggaattcttaagcaaatgttgccaaaatgaaaacgaaaaaactagtaaaaataacagtgaaaataaaagttccgaaacggacgaaagcattagcctaatccaaatgctcaatgtcggcatttatgccaatgaaatttggcaccgattggtaataattgagcaaatcgaaggcgatgaaaaagagggaaaagagttgggactgaattggcggagattgaaagggacggaattggcaaatgatgcgaatggagagaaggccaatttggcacatttggaggacaaattgcacaaactgttgagacaaattgtgatggcaatggaaggagaggaaatgaaaagcgacattttcgccacggcggaggaaaggcgcgcgnatcaagagcatttgtatttgcacaaattggcattcctt

SEQ ID NO: 31649 - DNA, 1696 bp, Heterodera glycines
tttgggagaacatgcacgtgatctggcttttcaaccatcgaatttgggagcatcaacatctgatcagtcttttcaaccgaatttgggagaacatgcacgtgatctggcttttcaaccatcgaatttcggagcatcaacatctgatcagtcttttcaaccgaatttgggagaacatgcacgtgatctggctttacaaccatcgaatttgggagaatcaacagctaatcaagcttttcaacaattgaatatgagaaataggatacccattcaagctttgcaaccatcatatgtgggagaacatgcacttgatctggcttttcaaccatcgaatttcggagcatcaacatctgatcagtcttttcaaccgaatttgggagaacatgcacgtgatctggcttttcaaccatcgaatttgggagcatcaacatctgatcagtcttttcaaccgaatttgggagaacatgcacgtgatctggctttacaaccatcgaatttgggagaatcaacagctaatcaagcttttcaacaattgaatatgagaaataagatacccattcaagctttgcaaccatcaaatttcggagaacggacatctgatctggctttaaaactttcgaatttgggagatatggcatttcctcaggcatttcaaacactgaatttggaacaaccggcgttgatgccttttgtaagttagtccagtggttttattcgggaaaatctaaatttttttttatcaatttaaatttaaatcctattttagcgcaaaaaacaaattcaacaagcaaaaatgctttacttaagtcgggcacaacagcaattagctgccaaattcgaaaaaatgcgaagcaattttttggcaatatacggcgaattgcccaaattctcgggccaaccaaaatcgcttttgggtatgccggcacatcttcagcaacagtacaaatcgcatccgtacattgccaaactgctcgaatatccgcagccagcccaaccaacagacattttcatgcaaaacttaccaaaaatgccatcagtaccgcaaaatcatcaatgcaatctgagcaccagccaacatttacggcacaagcaatgccatttgagtaccaaacacaagcaatggcacctgagcaccagccaacatttacggcacaagcaatgccatttgagtaccaaacacaagcaatggcacctgagcaccagccaacatttacggcacaagcaatgccatttgagtaccaaacacaagcaatggcacctgagcaccagccaacatttacggcacaagcaatgccatttgagcatcagccaacatttacggcagaagcaattccatttaagcaactgacacaaacaatgcaatctgagcaccagccaacatttacggcacaagcaatgccatttgagcatcagccaacatttacggcagaagcaattccatttaagcaactgacacaaacaatacaatctgagcaccagccaacaacatttacggcacaagcaatgccatttgagtaccaaacacaagcaatggcacctgagcaccagccaacatttacggcacaagcaatgccatttgagcatcagccaacatttacggcagaagcaattccatttaagcaactgacacaaacaatgcaatctgagcaccagccaacatttacggcacaagcaatgccatttgagtaccaaacacaag

SEQ ID NO: 31650 - DNA, 1249 bp, Heterodera glycines
  misc_feature (186)..(186): n is a, c, g, or t
gccatcgatgggacgacacaattcttcggcattaaatgctaaaataaaacaaaatttttggaaattttttatcaaaattgtttttgtgaaatgtaccatttttgtctgcggttatctgatcatttgaatctcctacttcaaatcggatgatggtaaacaaaataacagccaataaatttgccattntaatgaatgtcaattttgaagacaaaaagcaattatattattttatctaattcaatcaaaacataaataagttatttaataatatatttagataattttcagttaaaaaaatgaatgttatttattaatgaatgaatttttgactggtacataaagcgattctatgcaaacgctcttttttgatgattcacttctattggcttcgccattctgtgcgatgaaagcgtaaaattatggtgatgttctgctgataattataatattgcgatagaaaagcgtcatttatattcattttattttattaaaaggattatagtttaatttgtaaaaaatgataattcttaattaatttaaataataaaatggtaattaatgatggaaattttaacgatcaattgatattggaacaaaggccactcattaacaatatttagttttatggatttcaaaataagaagtaccagtggcggttttctagtgccaccgttagtggtattaacctggtaaaatttgcattggtaagaatgggaattcgagcataaattattcatgaaaatttggaaatggtgaaggaatattttcataaaggtcggacatttacgccaattttaaaacaattcttttctttttttaattatttactagcgcaggcgcgctcgcttcgctcgcgcacctcgcgctagccgagctttgaaaaaatttattatcttctctctctctctcacctctctttctttctccctctcctctttttctctctctctctcttcctcctcttttctatctctctcctcttctctccctcctctttctttctctctctctctcctcttttctatctctctcctcttctctccctcctcttttctctcccttctctcctctctttctttctctccctcctcttttctatctctctcctcttctctccctcctcttttctttctctctctctcacctctctttctttctccctctcctccttttctctctctctctcttcctcctcttttctttctctctctctcacctctctttctttctccctctcctctttttctct

SEQ ID NO: 31651 - DNA, 2213 bp, Heterodera glycines
  misc_feature (117)..(117): n is a, c, g, or t
  misc_feature (133)..(134): n is a, c, g, or t
  misc_feature (173)..(173): n is a, c, g, or t
  misc_feature (181)..(181): n is a, c, g, or t
  misc_feature (199)..(199): n is a, c, g, or t
tttgtatgatactgggtagatatgggagtaaaaaaaaagtttttttgtgactatttacaataaaaatttatgcagcatttctaaaaaggatctaaaaataatttctgcgtaaatatnttttacattatgtgtnngaagaattgaggctgctttctgatgcgattgaaaatttntcagcttntcttgaaaagttttttcncagaatttatacagctttcccgacaaattgtttagataattattctagacgatttttttatatctcagtgcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttattcagctttcccgacaaattaattggataacaattatagacgatttttttatatctcagtggtaaagtattgcctttttgtatgatggttggtagatattgagagtgaaaaaaagtttgttcgtgactattcacaatcaaaaatttatgcagcatttctaaaaagggatgtaaaaataatctcacacataatatttgttacattatgttgcggaagaattggattgtgcttatgatgcaatcgcaaaattgttcaggttttctccaaaagttctttctcagaggtcggatgggtcacataaaaaaataaacatattacattcccaatttgaattcccttgcattgcgggttcactttattatgcgggcacataaaaaaatggagtcatcccggtgcaatactttttgtgaatggtcaagggctctcgtccgcccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatg

SEQ ID NO: 31652 - DNA, 1108 bp, Heterodera glycines
tcttcttcggctttgcatgtttagtaggttacgccatctgaacacatgaccgagcttagaaagggacggagggaattgacaaagaaaaaaggagcggaccgaccaagtcgccacagaatttcctgctgatttaagccggtgttcaggctctgcttggccaacaggcaataggcctcctcgtgtttgttctcactgtcaagttggtcgatgtattcaaactgaaaaaagagggagggaaccattcgtttaaatttaaaactttttttttctgaattttgagaattttttttaccatgagcagctgaggagcacggaaaaaagtcactatgaaaacctgaaattaattacaaataaatttgtttgtacttatgtacatacaaatgtatgaaggacgagagaaaagcaaataagagacaattaaattgaggggagggtcaagaataacacaataacaaattataagttacacggaataattgttgttatgttcatagacagacagaccgaagaagttggtgcttgagacaggccgtagccagaaaaaatttcggacggcagaacccgaagttttttttttttgctattcgggcaaaaagcaggaatttgtaccgcttttgccaaaaagaagactgctttttgctattttcggtcaaattttcaaaaatatactaaaatgggggaatagagtctggcggtgctgttaggcgccagcgggaaaattttctggaaattttaacgcaatttgttaaaattaaatatttaaaaattactcattttgcttgaaaattttttatttctgggggaattccccctcccccttctccccctgactacgggcctagttagaaattcgtgcagaaacggagggagggcggagggtggagggggcgcaatcgaagaaaaagaaaggaaaacgctcggcagtgctccaaacagaaaaaattgatttaggtactcatattttttgaaattaaagaccttagtctgaattttctgcacgatttgtaaaaaatgaacctgcctacaaataataatacgaagcgaaataaaccgcatatccttctctaatacccataaaactaaaatgaatggggaaacccgagtaact

SEQ ID NO: 31653 - DNA, 769 bp, Heterodera glycines
cacccccgctgttgaagggaacgcgtcacggcacgccctgcggggctttatctacagatgacggcatttgttttaaaacaaaaaattttataactcataggattgaattgtttaaattagtcatcatggtcaattttaagggataatttgaaccaattttttttgaataatttaaaataagtttatgaataaaatttcaaaaaatttcatcatcgaaaaattaaaattattgtacgcaaaaagatagggttttgaataatttttaattattaaattctcttttaaaatcattttgcactttaaacttgaaagtaattaaagaaaattcataaaaataatggaaattcattattagttgatatatgaaaaaacaatgtaaaattttaaaacaaaaaatggattatttgaataaaaagaaaaccatttaaaaaagaaaactccgaaaattaaaaacaagcattttgctctgtcatagaaacaaaaaaacaatagataaataataaattaagtaaacttttgattatttgaaaagtaaacacaaaaaaaaaaataattacaaggaaatagaaatttaggaaaaaaattgaaaattttaagccgcttaaaatttggcgtcacggagaagaataagaagaaaaaagctaaaaaatgaagcaaatttgtttaaaaaattgagaaaaaaatatatatatttagttaataaattcaattaaaaaataataaaaatttgagactaaaacaaaattaaagttttttcaattattgttat

SEQ ID NO: 31654 - DNA, 1739 bp, Heterodera glycines
tagtaacttgatagcctatccattggttctcctctattaaccttttttgcagactaatggataacacttttactatcgaatgatagtttttttgcttttgagcataaattacgataaattatttgtcgaagaatgcccaatttatgaaaagactcggcacgaaagaaggaaatggtggaaataatgccaaagtcccaccgtaatcggttacggtgccccacccgaataccattctcctcaattggccaatgctcccactgacctgatgctttgctcctgcgcctcgtccgccgcttctcctccctcagcttctccttccgctcgtcttccatcgccgactttgccgcgccgagaagtgtcatgataattcccgtctgcgaattgactcccaccgcagtaattaccatccgaccgctgccttccatcactaaaaggaaagtgcgaacaacaaaatgggcaccactgaccatgagttcccgaaagaagcattgggtcatgctcggccgactttttgatttggtccgattcgccggtcagcgacgactcgtcgattttcaaatcgttgctttggattagcactccatcggtgggcagcaaatcacctgaagaagcaagggaaagtgtcaatgagtaaaagtgccaatggtcggcttgtcaaagtgccatcgtccgctttttccggcaaatcattaccgtatttcacttgcgcaatgtctccgaccaccaactcgttgaccaccacttgcagctgctttcctccgcggatcactgcgaatttgtgttccgtttcgatcttcgcttgcaatccttaaattcaaattcaaattaaattcattttttgtccgcctttcccggggatggccaacctctgaattgtctctcttttgtgtaatcattcaaagccgtgacgagtacgacaacaacaaccgaaatcaaaatggccgcaccttcgatccaacccgcttcctgctcagtttcgtcttttccacctgaggaaagacggcgattggaaatgatggaaaagcgaacctccgagttccgatccggggttataaaatgaaagggcaagtgaaacgactgcggcactaagtaaaatgatcagagtgacgtcctaaattgaccgacaaaaagactcattaagaaatgccatcggacagacctggagagcctcccagacgagcgtaaagaaagactttggcgggaggggagggatttcattggcaccgaaggcatccctccgcctgaaattccaatttcaaaggtcaattcacacagaggccttaaaatttaaaagatgggcaatcaaacgaggatgttcatcggcactttggggcttaaaagccaacaaagggccgaataatcggaaaagtcaaagaaagaagagtttgtcggactatggccagcaaaggcaacctcttcagttcgtcctgcgtattcgctattccgttgtttgggtctgtcgcgagtctttcgcaaaggcccaaagtgtttccgtagtcggtgcttattttctccaatgcttcgcctccacgaaattccatcaatgtccgcagttcttctatcgtcacatcgaaggcaccggcacccgacactccggcagagtctcgatgcccggaatcgggactcattctgtcgagagtagctgtccttctgctgggagagggatcaattttgcaaggaacggcgtaaagcggcgattgaacattcattcattcattcgttggcaatgtgccgtttct

SEQ ID NO: 31655 - DNA, 1398 bp, Heterodera glycines
ctgagcacaaatatgatgtttattttaagtttcagattctttggaatattttaaaaattctttattttttggcaattttttggccctcgggattttggcttaatatttgaaaattcataacaaatcgaagggttgatcaattttacagtaataaagccttaaaaatagagaaaaatcaggagaattttatggactttatttggaatttctatctaaaaaaggaaaaaagttattccagaatttctggaaattttcgatttttcagaaaaaaattcagaactcggttctgtaaaggtgtttttgaaattttaaatactgaaaaaatctgcaatttttttctctataatataaattttattttgcatttttatcacatttttaaaaaaagatacaaaaataaaagtgattttggggttcgggaccaaaggggggtgcacatggtttttaagtggaaaatttttttcaccaaaaatcctccaaaaatatgtctttaggggttatttgggccgctgatcacgaatacgtgatcagattttacttttgacatcgtcaagacctcagaatccctgtgtgattggggattctgaggcatcattttttgggggggtggcgaagttcgaagccgggcggtgtacattatttttctttgtattttttgggttaattttcattacttttaataaatttaaatgtttggttttattaataataaatttttttagtttaattaaattattttttgatgaataatgattttcatttaaattatttattatatttaattaaagaatttcagctattattttaaaatttaattgtaaaatttttttcatttcaatttaaataactattcaattattatacatttcataagggaggttcggacccgggcggtgtatattatttttaatgcattttttcgttatcttcaatgttttaaactaatctgaagatttgttgtagattattttaaaaaattttttacattaaagaatttaattatttattttttgaatttgtaaatttcatctaaaatttattaaataatcaatttttaattttcaacgttattttcaattaataaatggaggatttatttttaaatttaataaatttataattcatacaatttttaatttgaatttatgttgtacctcttctagtcactgttgtacctcttctaatcatagttggacctcttctaatcactgatggacctcttctaatcaccgtggtacctcttctgatcactgttggagcacttttaatcgccattgtacctctcctaagcacaggtggacctctgttaatctcagctgtacctcttctgatcactgttgtacctcttctaatcactgttgtacctcttctaatcactgtttacctcttttagtcact

SEQ ID NO: 31656 - DNA, 2107 bp, Heterodera glycines
  misc_feature (36)..(36): n is a, c, g, or t
  misc_feature (86)..(86): n is a, c, g, or t
attgatgtgaatcgtcttaaataataatttattttnttattaagtaaatttttttccaataaaaaaatttattatttattaaatanccctgcaaaatccaatgcttcgtatcacagcacttatttcttctgattgaaaatcgctgctaaataccaataaaactcgtccaattaaatacgcatttgacaagcttttaattagcgatttcaaatatttcacccgatcatggaccttaatttatttttagtaaatttgaataatatttatatatttttttaattgattttatttcaaaaaacaaatttaaatattaattacctggattatgatcacataatctacattttccgcattagggtcatcaaatttgtctattcggtccgcagaaataatagagctctatatgaaaaagaaggttcgaaaatttaatccgatgttaaaaaaaccggaaattcacactaataaaatgaatgtaataattttttcttaaaattcaatcgatgacgatttattgaaaaaattctgcttttgcttttaaagcttatttttcctggctttttcatgctaacaattgagaacccacgtaaaatggacccaaaattatgaaaataagcaaaatattatagaaaatatttttgtttattaccggatttacagaaatggtttcaattttcttgaattgttcaccaacagctgttctaatttctggcaatttaaaaatttttgacgaatttatcaacaatttatgccattctaaattaatgttcatgtcgtccaaatttggcaatctgtcaattttgctcggaatttcattcccattttttggctcagacatttttctgtcgttggagttcagaaacatggaatttagctcaattttttgccaataaattgattttgttgcattgaatgttacataaaagaggaatggcaacagaaaaatcaactaaaatttaaatttaatttaattaaatatacttaattatttattttcatcaccgcgataataaaaatgattgtcgaagggcgaacaatgcgcaaaataaagtcgtgcataaaaaaattatttttacaaattaattttaaaaaaaatttttttatgaatttgtgggccgaaaatggattttaacaaatatatcaattcacaacatttatgtttatatttgagatttccaatctgccaatgttcgagaataaattggagtgggtgatggagggattatcttacgaatttgcattgattaatattgaatggagacgaatatgtatgttgtataaacatttcgcaccaattatttttataaaaaaaaattttcttttattaaattattattaaaataaattttaattaaaaaaaaatttgcctgaatttaccacatttgtttaaaattattttgagtgaagcaaatgttgctttattttggataaacaggtatttatttatctgatctaataattaatgtgaattaatgtttctttttttttatcttgaaagttcatgtgaaacatttaaaaattttgaaatataaaagaaaagtgaataaaaaaaacctcgtaactctttaaacacataaaattaattgtattaaaattataataattgttaaataattaatgtatgaaaaatcataaaaataagtaataaataagcaatttaacactctaatatacataaaaagtcaaataatattttatattttttataaacgattaggtagtaagaataaatgaaactatttttggttctattttaatgtaaatataatcttccagggaggaattctcctaaaacactgaaaaaaaattaatataaagttaattataattaaagttaattaaaattttcataatttctcagccactttttgacattttttcaatttaataaaatgtcaaaaatttaaacaaaatagtattactcattcatcagtctcattaaacacttgacatatggaaacataattttaataaaaaattctaactaaatgacaaaactgaatcatcaaggcaagttttacaattttgttatttaatatcggcaagaatatgttctctctcaatccattttcaaaaattattttattgctacaaaatgtcgatgactcta

SEQ ID NO: 31657 - DNA, 999 bp, Heterodera glycines
  misc_feature (962)..(962): n is a, c, g, or t
tgtgccgaattccaaggcaacaaccagcaaaaggagccgcctatgttgcgcagtttcgacgtcggatcgaaaggcgatggcaaaaattgcatcatttcgggcaccaccagcggctgatcagaagaatcaaagaagtgttaaaatgcgaaaggaattatttaatcgaagaattaataaatataaaccttgaaaatgtcacaataattaattacttattaatatgttgacgcaaaattttgtggataaatttgtaatatttgaaaaaattcataaatattatttaattcttaatggaattatgcatgccaaataatgggtcaaaaattaggcggagttattgaaatcaatgatttttttctaaactcatatatatcatagcccgaacagtagaatatgtaatttttcctcaaagaaataaaaagatttttagttcatttaagtataataaataattaattagttaaataaacactctcttttcaccacaagtaattcaaaaaatgtgttcttaattctctcaatgaattgtcatataattaattttcattttaaaaatattcgtattattttttgacttttctatcttttgtcatacaatgagtttgcagttggcatttccatatgatcagcaaacacacaaattagaaatgtatcaaggattagaattaaagaaaggtgaaaaatctaaattaggtgtagtattaatataacgaattaccaagaaagtttttgctattttttcgaaaattttttgctgaaaatctgttaacaaattacaattaaatttcaagaaatatttccggcggcgcctgccggcaccgtcgagacccttctgttccctagaaaattttaaaaaaatgagtggcaaaattttttttcaagcaattcattttaaatttttggtccaaaatttatgtgtaagtcttttaagttacaatgccatttcaaaaactttctccggncgcaccaggcaccgccggcactccaaattccccttca

SEQ ID NO: 31658 - DNA, 1176 bp, Heterodera glycines
aaaatagaagagccgatctcgaggtaaaaactagacagctaaaaaataaactgtgattcgatagagggggacaaaatatgggcctatacaaaatttcaaaaaaagttaccctcgggaaaaaattttttcccagggcaaacatttcaataattttaattcttttttagccaagtccacaatttaaggccaaaccaaataaaatttacaatattctccagaattttcccttcaaaatgagcataaaatggttttatttgctctagtattcaccaagttataagctaaaaaaaattcataaaattatcgatgctgtacgtaactaactcttattgaaaataatttttttttgacgcgaaaacttttattaataaaaaatatttctgccttctttaagagaagaaattgaaattaacacacaacatagggaggacttgaacctaggaccccccttttggtgactaactcacagaccactaagacgaaaaatccagcataattgtacttggagcccaaaattgggccgctgtgtttaagatgcaaaatttgaactttagcgaagataattccgaaaataaataaatctttgagagcaagaaaaaaatttatgccaaaaagcattaaaatgcttttattagcattgtgctagcgaattaataaaaaagggagacttttttgagaaattcacgtttttattgcagtttttcttcagtttttggcacatattttggctttttttttgagttttagcacatattttggggagttgttggcacatatatatgtacatatttggcgttttttagcacatataaatccgttccctgctaataattaaataattaaaaaattccccccccccccccgcctccaatacaatttttttttctcgtcgatgtcgtttatgccaacgcattaatcgttgtattaattcttagaggcatgcgaaaatatatgcgtatattgtattattcatagttatagccaaatgaatattcccccttcattttatcgaataagtcatattaaaataagcattgtcattattatattcatttctcgcttccatgagaatatgcatttttacttttttgtaagaattattacatttataggaggttatatttaatttaaatatggataattaaattgagtccctatgataatacggttttatat

SEQ ID NO: 31659 - DNA, 1153 bp, Heterodera glycines
acatgccaaaaagtttaggcttaactttttttatataaactgatcagaagcgcaccagattttgcaagggcatcaaaaagacaaggaaaagcaccgctatgatgctaacgccagtaactctttatttaaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttatttttttaatagatttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctag

SEQ ID NO: 31660 - DNA, 1037 bp, Heterodera glycines
  misc_feature (917)..(917): n is a, c, g, or t
  misc_feature (994)..(994): n is a, c, g, or t
attaaaaattttttaaaatttattcatctccctttttgatagaaaaagtatcagagtgctaaaattaactcgtaaataaaattcgggtgcctttcagagcactttccgaaaaaatatttatcgaattaattttgcaaaaaataaaaataaattggtgcatctttaaaaattcatagaaaatttaaattcatagttaccggacttaaaacatcacagagatgcttttcctcgtcttaaggaagtccttaaaaaatatactccgcttttgatcagtactcgaaaaatgagtgattgaattttcactaaaaagttaagcctaaactttttggcatatttaaaaaggaattaaaaatttttaaaaatttattcatctcccttttatataagaaagtatcagagtgccttatttaacttgtaaataaaattgggtgcctttcagagcactttctgaaaaaatatttatgaattaatttagcaaaaaataaaaataaattggtgcatctttaaaaattcatagaaaatttaaattcatagttgctggtcttaaaacatcacagagatgcttttccttgtcttaaggatgtccttaaaaaatatagttcgcttctgatcagtactcgaaaaatgagtgattgaattttcactaaaaagttaagcctaaactttttggcctgtttaaaaaggaattaaaaatttttaaaaattttattcatctccacttttgatagaaaaagcatcagagtgcctaaactaacatgtaaataaaatttggtgcgtttcagaaccctttctgaaaaaatatttaagaattaatttagcaaaaaataaaaataaattggtgcatctttaaaaatcatagaaaatttaaattcatagttgctggtcttaaacatcacagaggtgcttttcgtgtcttnaaggatgtcttaaaaatatcgttcgcttctgatcagtactcgaaaaatgagtgattgaatttcactaaaaagttaangcctaaactttttcgcatatttaaaaagcaattaaaatttttt

SEQ ID NO: 31661 - DNA, 852 bp, Heterodera glycines
  misc_feature (803)..(803): n is a, c, g, or t
gggaaaagggcatgaaaattagcaaaattattatttttttgaaataatttttttgctttggcaattgtgaagtgaaatcctggtaagagaccggggacggtctttggtaaggttggaggtgtaagagagagtcgaaattgtcgggtttttactcgtttaactgccgaagctctaggatttcattattttcacatttatttctttttgcatttaattttcctttttactacataattgtaccgccctcccagcgataattgatcgatgacatttcacttttcacttgtatttaacgtttgccttttcaagcgaacggagctcagtcgtcccgagaataaagccacttattgtgtgaccagcgagtgtgggaaggcaatcccgggcttgatcaccccgtggacccatccttcgggaatatgtggcacttttccctttccctccccattccgaattccaattcccaacgccagcacgaccaccgcgcacggccgcgctactataatatgcttaccccccacccctctcacaactaattatgccgtgcaacttttttccgctaattaattttccattttcatccgttgtcatagtgccgccgattgttctcctcccactttcacatgaacctttttgtacactgtgtggtgctattcttggccagaatggcattggccatgccatttcccaccccctctcccccctaaaaattatttgttgcccctcggagatttattggcgtgacaccaccgttgggcttcattttggccgcctgtcttcccttcacatttttccatgattaatangctaaactcgttgtttggaaatttcatattatcgcttttgctgcacctg

SEQ ID NO: 31662 - DNA, 1718 bp, Heterodera glycines
gccgcgattgtgcgcgtaaaatctttgcgagtgagcacggcattgccggcttctacaagggcgggctcagcaatgcaagtgtcacttttcattcttttttttgaaatcgacagcatgaactgctccaagaaaggggtgttcctggtcttctcaaattccaagcggaaaatgtttccgtcttgaacttgtgtctctcattatacgacatagtcgtggcctggggcgttaagttgcccctctgccattttctgaatttaagcaaatttttctaacattattacaatttgcaatattgcgtaattagcattaacaaattatacaaaattcctgaatggccgcctaattcccccgcttctctcctgatttatttgaaaattgcgctggttaaaggctcgcggcctatgcaaagccgtgaataattttgattttcctggaaattgaaatttgccagcaacctttccagtgccacaattattgccttttgtttcagattcttcgcagcaccggcggcgctttggtgctcgttctttatgaggaaattgcaaaatttacccccaattaatgaagaaaaacaccggatttatgtttcattctcattcattgctacaaaatgcttctcttctcctctcattgctcaatccgtgatctgttcgactttctgcaaattattttattcaaattccttctctcctttccttttgctgtaaattccaattttgccaattctcattttgcaattttcggttattttgttgtgccaattccttttgattattttttgttttgtttcttctcctcacttctttcctcctcgtttttttttgttatgcaatccaaaataagcaataaaataaaaataaaactttctccgcccaaaaggataaataaaacaatgtttacggaaaacttttttcagaatggtttgtttttaacggatttgtgtaggcaaattataacaaaagtgaaaaacattagctttctccctccataatcattcattaatcctcatccatcttttcgtttaattctgatcgactcagttttgctttcctgaacttcctcaacaatccctcctccttctgcaattggtcccattccgaaggcgcctttcgcacgcgccgtttcagtccattctgaatattaaaatcgggtcaaaagcagaaaaatttgctgaaaagaagaaaaggtcccttgaaaatttgctttcgagaacccccccccccccccgtctcatccgtcgtatggcgtttggcctatgccactccttaaatatttacgaaaaaaactaccgaaaataaaaatgagaaaataattgtttatcattaataaaaaataatttttaaataaaatctactttaaaaggaattttggaaaataaatttttgaaattttcgagccaaaatttttcagccttttaggagtgcgtctcgaaaatttttaaatttataataaatcacatatgctcaaactattttggctaatcctgaattccgattctaattaattcagaatgttcaaaatggatttctaatttgtcggtcagcaactattatataatttgttatttttctctatccgtccccgtccacctgctgctgttgtactccattttttgcggttgttccgcgcttggccatgcttgggccatttgtcctctctttcccctccttccgtctcttctccccttcattcgtcggtggttttcgtcccccaaattt

SEQ ID NO: 31663 - DNA, 1296 bp, Heterodera glycines
ttttccatgtttcagttggctttgcagcgacgtttggatggacattctcccatcttttgaccatgcccaactcggactcaaaatggcattgctttccgatcgtttcgacattttagtggacaaacattttgatggcaaaagcgaattgacaatttggagaacaatcgcaattcacccgggcattgaaatgccaaaactttttgtcgaaggcaaatttgtggcatttccgatgccggaccgtccgcttcccaacaaaatcctctttcataatcttgagattcggtcagtcttaacttttgtgcacattaaagcattttaatatttcttcaggtacattgatcattccgtcattgaatttctccatgccaacaagcaaatttgggacagaagtggcaccaatttggaagtgtttgtgtgttcaaacaacaaggaagatgagcagccaatttggaatgtttgggcccgtaaaatttggccaatttttgctaccaacgttcgacatttatgcattcctaatggtgctcatttggacaatttgcgtcgtctgatttcaccgacaattctcactgatcttgaccaactgaattcaatcgatgccggtcttctgttcccagatggaattgctgacgatggaccaaatgcaactgccgggcaagcgttgaccaaatggttacacacaccgagcaaaaatggacaaccgaacgaattgtatcgcgatgcttgtttgaatccacggaatctcgaatgggtcaacaatttcaaagaggtgtctcgccatgttttcgtcaaattgttttttttaccaatttttgtgtttagaaatttcgccatgccaccacttctgtcagttacacaattcaactttatactattgtggaaccaacgccaactgaacaatttgaattggtgaatggacggaccaatgagaagctgacactgaaacacagcaaagagtccattggatcagtgtataattggctgttgcaacggtgcccaattattggggagatggcgacgacggcggcagttaagtggaaaaaccgcgaaaattcgggtgccaatttgaacaatatcagatttgatctccggacttgcaattatttgtgtgccaatttgaacaatatccgatttgatttgtgggatggaattcattgcattgggtgagcagcaacagcaatttttgattgccgtaaagtaaaaaagtaaaatacttttaggccattgtcgtcaccagcagtggaagaagaagaattggattaaagcaatggaaattaattatatttgataaatgatcga

SEQ ID NO: 31664 - DNA, 773 bp, Heterodera glycines
tttatttttctttcccacagcaaatgggtcgcaatggtaactaaattatgaaattagccatacaagaaagaaaattttgatttttcgcgaaaatttactattgaatatcattggcaattcacaacttattttaagaattataaacaaaatgcagaatcattattttggttcccacatttactttcattatccacatccacaacataagaaaaaacaggaatttttccttaatgttgttgaacggcaatatgtagtttagaaattagccaaatagcaatttaaaggttggcttaagttttcattgcttttcgttatactggatatcttttctgcagtaatcaacatgcgattttgcctttttctagatgtatacaatcaccctttaaaaacgtcgaaaattttaataaacaaactgaacatcagctcgctaaagtgaaagttacacactactataggaaattctgaaattgccagttctgctctattttattacaaattttcttctgtagttattggatttttgccggcaaactgcagttaaataggttttctttttatttattgcagcttttcgcatttgaagccgcttaaaaattaattagaactgggaaatttttcaaatgtaaatgccataaatccggtttatttttctttcccacagcaaatgggtcgcaatggtaactaaattatgaaattagccatacaagaaagaaaattttgatttttcgcgaaaatttactattgaatatcattggcaattcacaacttatttt

SEQ ID NO: 31665 - DNA, 1183 bp, Heterodera glycines
aaatgttactcaattatgtacacaccgtccgaaaaaacgagatgtgtaccaataaatagagagtgccagagaaaaaaacatctctttttttggcgtactatttctttatctctgttaatagaataacccgaatttacttcgtctatagaactttttttccgccttacagattttctttaaattttgcaaatcgatagagaaaaatataaagaattgttcaatcgcttttttaaagaaaacaatcgcttttattttggtctaaaatttaaaataaaatttcgaactcctataacttttttctaatgcatctaaatgtctagcttttgcttagaataagcttctcctcaccaagagctttcgaatgataccaagtttgtccaatttggttggcaaaaaccttcaaaaataattcccaaatatcgtgattttttaatattttggacaaaaataaatggaaatattcatgttgcacaacggactcgaaccaccaccctttgtccctttactatcttacaaaaaccactgagccacacacgcaaatcttttttggtacagcagctcagttaaaagaatcactcgagaggccaatacttcgcccaggctcgcatcaattcttcaaaaacaaatctaaaaatcaaaataaaatgtgaatcttttgaaaaatggattttgacttttttgttcgaatccgggtttggggttcggaatgggccaaaatcgtggcgcgacgtttgcggatttgacatttgcggacccgacatttgcggacccgacatttgcggaacccgacatttgcggactcgacacttgcggacccgacaattgcggataaccccgacatttgcggacccgacacttgcggacccgacaattgcagactcgacacttgcggacccgacaattgcggactcgacacttgggaatcacctttttaataaaatcgtgttaaaataattagaaaaatcatttttgaattcaaaaaaaaattattttttaattaaattaatttaatatggacttttcaaggcaacaaagtcgttgattctttatttgaaaaaaagaaaatgcctttcccaagggccaacgggaaaatgtagttaattactccacatcgggcccatcccaattttcaaaatcatttcgcatcagacggtattgcaacgatctcagatgagtaaggaat

SEQ ID NO: 31666 - DNA, 1104 bp, Heterodera glycines
tattaaatatttataaatctcttttcgttgcgccttagtcattatgtttgcgcaaatatgccaaaaaattcgcctctccacgattagcaattgcccttccccgttatttgaattacgctttcccttcaacactgagaatgtttatattagttgcgctgttgggttaatcgtcggtagccaaaaagggatttacggtcagcagttcaagcactatggcaaaaaatgaagatgagagcggagaagaaatctgagacgtcagaattgtcggcaaattgggttgactgtggatgggcgggatcaaaacgataaatcgagaattgactgtggttttgatcattcatcgccttttgtgtctccaaaatttttttatattttcgtttggacgatttgcttataatagaatacaattattgttttccagctaacaactgatcaacaaaatgtcggactccagtatggatgctatccgtgagttgcaacgagcgttgcgcgaacaacagagaacaatcttctttttgcgaagtcaaatggtggaccaccgtgcggtcatactccaaaatgttgcgcgcacggaagccctggagggctacgcggcgaacgtaattttcaaaccaaattttgaaatgaattttaatcagtcatatagttattaaagtataaatttaatttggaaacatttcagagtcgcgggggcagattccgcccccgctattctccaatggtttcgctggagatgactcatcttggacgacggctcgaagagcgagagcagcgctgtcgtgctcaggctgaaacggtggatgccccagctgcaacagagagcgctgaggagggaacatcttcgagcagtgctccttctaatggtccgttttaagacaaatatttttctaatttttaaaattttcaagtccaaggaacttccggtccgagtactggaatggtacctgtcaacgctgagttgccttcaaattgtgtgttttaagtaattattttaaattatttattaaatattattaagcacaagcaacaccgctcagctcccgggttaacaatggtgtgccattgccttcaagtatgttggcttaattcatttgaaccaaaaaa

SEQ ID NO: 31667 - DNA, 1460 bp, Heterodera glycines
gtaaaaacggaagagccgatctcgagttaaaaacatcaactctcgaaaaaataaacaggggattcgatagagggggtcaaaatatggcctcatcacaaaatttcaaaaaaagttacccacaggaaaaaatgttttcccatggcaaacatttcaatactttaattcttttttagccaagtgcgcaatttaaggccaaatcaaataaaactaacaatattctctagaattttttttattaatgaaaaaataattctgccttcttctttaaaagaagaaattgaaattaacacacaacatagggaggacttgaacctgggaccccccttttggtgactaactcacagaccactaagacgaaaaatccagcataattgtacttggagcccaaaattgggccgctgtgtgtaccaaatacaaaactaagatatcatatgtattttaaattgaaatttttttattttcacaaggatttgatattttttgaattgaaagaaactgttttattttcacaatttaattcgataattaaatttagctatcaatggtacaaaggatctataattaatagaaaatttggcaaaccttttcatgcatattaaaggaaaggaagattataaaaatggatgggatttatatatttatttttttatccactaatatttttttatcgaaattttttagttttatttcgaaaaattatttaaaactcttggaatttgaccttttttcaaatgcactaaaatatgagcattacttaatatttaggagttagttacatatttcttaacaatttcgggaaaaaaggcacgaaaaaggtattaaaggctgttccaaaattacgtgcccggcattatgcaccaaaatcgcagcaccaaaattagctgactgcgtgttcactgaggtattgtcatatgagattgtccacttactgatagttcgctaaccatccattagcaattctcaactcgattctacgcaaaataatccgagttttttacctgataaaaaccgtcaaaattttccttctacgcttatttagtgatttgaagccggattttgttcaacaatgggtgaaacaatgaatgctgtgatgctgtgaaatttttgaaactcatcgacatctgattgttttttggaatagccgattttaaacaagtccatcagatcacgaagttgattcattgggacttgaactttctgcaataaatacataatcatctattgcatatttttcatggcaaaattatattttttgtgaagcccattaaaaatttcctggaaccataacggaaaacgaaaaaatcgcgacaggtttcccgcttatttcccgttgccgccaaattcccgtcaatttttgcgcaaatcccgacgcaaacataaaaaatttgaatttttcataaatttatttaaatattatcaggtggaaaatatttaatattaatacatttctttgaacatag

SEQ ID NO: 31668 - DNA, 1045 bp, Heterodera glycines
ctctcccgctctctctctctctcccgctctctctatcccgctctctatctcccgctctctctctcgcgctctctcttccgctctctctctcccgctctctgtcccgctctctctctctctcccgctctctctctctctcccgctctctctctcccgctctctttcccgctctctctctcccgctctctctctctctcccgctctctctctctctctctcccgctctctctctctctctcccgctctctctatcccgctctctatctcccgctctctctatcccgctctctcttccgctctctctctcccgctctctttcccgctatctctctctcccgctctctctctctctcccgctctctccctctctcccgctctctctcccgctctctctctctcccgctctctctctctctcccgctctctctctcccgctctctttcccgctctctctctcccgctctctctctctctcccgctctctctctctctctctctctcccgctctctctctctctctcccgctctctctatcccgctctctctatcccgctctctctcccgctctctctatctcccgctctctctatcccgctctctctctcgctctctctctctctcgctctctctctctctcccgctctctctctcccgctctctttcccgctctctctctcccgctctctctctctctcccgctctctctctctctctctcccgctctctctctctctctcccgctctctctatcccgctctctatctcccgctctctctatcccgctctctatctcccgctctctctctctcccgctctctctctctctctctcgctctctctatctcgctctctatctctcgctctctctctctctctctctcgctctctctctctctctcgctctctctctctctctctcgctctctctatctctctctctctatctcgcgctctctctatctcgctctctctctctctctctctctctctcgctctctctctctctctctcgctctctctaactcgctctctctctctctctctc

SEQ ID NO: 31669 - DNA, 1237 bp, Heterodera glycines
  misc_feature (58)..(58): n is a, c, g, or t
  misc_feature (94)..(94): n is a, c, g, or t
gacttatatgcggatttgacgggaggtgtaaggcagctatacatttatgcaccaaatntaatcgaaaacacaattatcggcaaccagatggccncactcttaagaatagttaacgtcgtcgatgacccgggatcaattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaaaaaatgacacatgtgtttttcgatcccgagtcggtcgattggtcatcttttatcactccccagcatggaagaggacagaaacaatattttgtcggaagcaagtatcaacggggattcggtttcctcggtaatgtggcacgtttcttgacccctattgcgaggaatattgcctcgagtgcaggacatgaggggctcgccgctgggcagagagttctgagtgacatcgtccagggtcgtgatttaagggatgccgtcagggaacattcaagacaggggttgactaaccttaccgattaatattattttaatcattaaaaatattttagttatataaatgataaatcgaaatttattaatgctctaataaaaaaatcatttgataatggattcaacagaaacggaaaaattagcactttgtggaaaatattttacttacagatttgaatgtttcagacgcggtgtagaatcttaaaaaattaatattatttaaatcttttataagatttacgcgatacaaattaaggaaatagtaaagttcatgtgatcttgatagaaaatggataaagaaaaggtggtttattgaaaaaaatggtgttaattcgcgtgcagaatctataaataaattaatattattttaatcatttaaaatattttagttatataaatgataaatcgaaatgtattaatgctctgataaaaaaagcatttgataatggattcaacagaaacggaaaaattagcattttgtggaaaatattttacttacagatttgaaggtttcagacgcggtgtagaatcttaaaaaattaatattatttaaatcttttttaagatttacgcgacacaaattaaggaaatagtaaagttcatgtgatcttaatagaaaatggataatgaaaatgtggtttattgaaaaaatatggtgttaattcgagtgcaggat

SEQ ID NO: 31670 - DNA, 1192 bp, Heterodera glycines
taatatttcatcaaaatggattcattatttgttacatattgtcattgttagtgctcatttggtttgatacgtgcgttttcctcaaaagcggcgtgaaagtggacaccaaaaatagtgtcactgaaaagcgcaaaatctgacatcatttatcaagcgaaaaaatgaaatgtcgtcggaaaaatgtcatcttaattgtcctcactcatgactctcgagtttctccaaattctaaattaaccagattgcaaacgatggcgactttttgccggtctgctcaacgatgccaacttttttatagtaaataaattttaattgctccattttcgactgtggcgcttgtcagtctttttcctcagccctccgtctcgcctcaatacttgctccgtcttcgcatgctcctttttgcgaaattttgcttttaaacactgggactcaattgtcccagtgttcaggtggcatcgcttcgactttatttcctgatttttagattaagctcatcaagagctttcaaatggtaccaaatttgtcaggattcgatcgtttaaaaaatttatagtgcgaaatctctcaatttttcgagttttgaaccggttcaaaaaccggtttttttggcatttccgcaactcgcgacatatttttccatgcttagctccttgagacgaatcgattggtatatcatttgacccttttttttcacgggtcgttcactacagttcacccgaaagatttatcgctatttgagtttaaaatcacattaaagaaaataagtatgtatatagatagaacactttacgtgaaaattaagtcactgacgaaaatattcactgtcgaattcgatcactgacgaaaaaatggatggcaatgagtttgatgagtggcttgtggaattaggccggttggcggaagaattttggcgattatgatgccgtttttcaccatttttggttccaagtttctgaactttacccatgcgaaaattgatctagcatctctgtattgtccgctaatttcaaacatttgcagatttcggaattttgcagcatatgattgagttgaattttaagctattttatatgttacgtgtgaagtagagtagagcgggaccgggaccaaaacacggacaactgagtacaactgagtaccgaggtcccggttttgaccgggaccgggaccggtcccgggttttttcccg

SEQ ID NO: 31671 - DNA, 1993 bp, Heterodera glycines
tacgatttattcacccatttcattttttgccagatttgtcgactggttcagctaccatttgtcaaactttgagtatcgttggtcatggagtgattggattgaatgtgtcgaggttcgttttttttttttgaaaaatctgttccattatttcgatttttaattttcttaaacctccctcccaaaaatgtttttttaaattttcacagttggattcattgcatccaaagcgcatttttgtacgtgaagtcattgaaaagtgtttgcgcttttcataccacaaaaaattggtcgaatttttgccctcagaattggcgccgatcattccgggcgagctgaacatcatttacattcttgacgaccgtcagtttttgcatattacccattttagaaaccttggtgtagtaccaatcaaccagtcatgccaatttccaatggaaatttgtttttccaatacaaaaaagggttccagttttcagttagctatagtttcggtatcagatagtccattgtggctgcatgattcgcgtccgtcaaaaccctggcggtgaaaaacaaaaatgcaaattatttagctgatataaaaaataaattgtgccatttaaagcaatttatattttttgtatatttgtataataaactaaatacataaattaataatattccttttattttaaactttacccaccgcgagagcgagttgagcaagcgacgaaaacttggaactatccaaaacaatgagaacataaagcgtgacatagtcctccgaacaatgtaaaaaaaggaagaaattgcgcggcaacagcaatgaatgattacggcacaaatacgcacagacttttgttggtccaaatttacggtctgagaatgtggactccaaattctggatggaaaaaccataaattatttattaatatttatatttttatatcaattttggagcaattttaccaaatttaagttgaaaatgatagtttaattttaatattaaaaaaggtaattaataaagctaaagccatgtgaagagaacgctttgtcccgcatttaactgcgcataatgcgtgcgctaggcaataagcaaatgaatgataagacagagaataaggagaaatacaatcatcagagatctaagcaagataaagctaacttatttttgaaaaaaagaagtttaaacttgaagaaagcctatttcaattgtttgatctacgattttctcaaccaaatttagttcaaaaagaaaaataagatctcaattgcacaaaagtaaatggacattttccattatatatttttaaaaacactttcacgcattacccaaacatcgtaaggctcatgccaagtaattgcatgtttgccacccgtaagcaaacgacacagaatggcactggttgtaagcatttgccgaacgcgccaaaaatagctgggccggacccataggagcagctcatagatgagctcattaggaagccaaaagtttcgttgttgtcctttagcagtgccattcattggcgttgccagtgccggcatggcctttttgatgagtttgttctttttgggtgccaaaacggaggaatttctgcaaatggcatctccgacccctccttcatagtcttcttctcattctttgtgagcagcagcagatggtcaccatttgtggcataatccgggaagagatggagctgatcagatggcttagtcagcgagtgacctgcatgatggaacatgcaaattttgttcccgattatcctcgctcattgttcaaaggagtgataaataagcaatttgtgcacgatttaattaaagacgaaaagggcatcgtaaggaataagcagaataattttatactatgcataagaaaattcaccataaatgaatgccatattgggactaaaaattacaatgaacaaatgccattggaaatcccgaattaattaaaaaatttaaaaatatgcaaaactaaaaacccccacaattttgttccaaaatgaccaaaaaa

SEQ ID NO: 31672 - DNA, 489 bp, Heterodera glycines
  misc_feature (354)..(354): n is a, c, g, or t
  misc_feature (359)..(359): n is a, c, g, or t
  misc_feature (366)..(366): n is a, c, g, or t
  misc_feature (372)..(372): n is a, c, g, or t
  misc_feature (381)..(382): n is a, c, g, or t
  misc_feature (392)..(393): n is a, c, g, or t
  misc_feature (398)..(399): n is a, c, g, or t
tggatttttattgcatgcaggtccaagttcattacatttttcgtaaaggtggatttttcctggacctggattttcctggattttcgtccaggaaatccaggtccaggtccaatgtgaaaaaaaatccaggtccaggtccaggcaaaacacgaaaaacctggattttcctggacaaaattttaaaatttattatttcaagtgaccgatgttttttttaattttcaaaaaaagattaaattaatttaaaaatacattattattatgaagtagatattttttgatgtttctaagcaattaattaattttttcaaaactttttttgatttttaagatgagtttcaaaaaatccaggtncaggnctggatncaggtntcgaagagnntggatttttnntgganntggattttttggaatttttgttaagaaaataaaggaggcaggttgaatatggaatccaggtccaggcttttttcaaaataccgagctcta

SEQ ID NO: 31673 - DNA, 1087 bp, Heterodera glycines
cattgcaaaaactagataaggactaaacaaatatgcaactaggcaggcactcgagaacgcatgggaacgatggcgagataagaagtttgagaagtaaatttactaataatattcaacagttttaaagtacaatttcttttatgtaaatcatttattaaagtacaaataatcacttattttatctagagttaccatacgcaaaaagcgataaatactgtattaaagaagttgataaaaatgaaaaatttttaattttatgcatccactgacgaaaatgttcactgacgaattggaacactgacgaaaaaaatggaaaacagcaaaataaataaaaatagtacactgacgaaaatgttcactgacgaaattatccgctgacgaaaatcactgacgaaatcgttcactgacgaaaatgcttactgacgaaaatattaaccacgaatacatagtgtactattactagggctgggatttttatgtgctaaaaatcctgaaatatgtaataaaatatgtgctaaaaaacccaaaatatgtgctaaaaaccaaaaaaaaggcctaaatatgtgttaaaaaatgcaaaaatatgtgctaaaaattggaaaaaccaagtgtatttacgcaaaaaaaaaaatcatatttaatatcagtctttatcaattttcgcccgacctccaatcaaaattttggcgatatcaatcaatttgtaaagtcccggattaatttttccatcagttgaataagttccttccgggaactttgaaatccagtgacgatttaacacagcgtttgatttggctgctttaggcatttaaatatataaagaaattttctaaatgcttaagaaacgtaaagtagtcaatttttagggtgcattttcagattttcttgtatttttttacgatttgaagcagccgactgctggcggtgccgccgggatttatttggtcaaacgaaattggcacttctgctgataggcatgggttttcggcacggcacagtttcacatgatgatgctgacactaatgaggctaattggcccccgttttacggcgtttgtttttttgccggacaattccattttcagtga

SEQ ID NO: 31674 - DNA, 848 bp, Heterodera glycines
gcaacaacagtcgccttgtttttcgccgaatatttagcgtgcagacagtccgatttcttctgttgccttttaaacaactccactttgtcggcctgtctcagcatacattccaacttatgtcagaacatttcatccccgaaacattatcgttataagtcaccagcgactgcatacatttcacacagattgagacccaattcgtgcgctttgaccaaatcttcgtcaaactctgcccgtttttggtacgcccgatgcattgcccaaaccgcttggaccgcgtaaacattgtcacggacccacgcatgcgctaggaaaacgttaaacatttcgacattcagtgggcaactcacaagggtattgttcgggattgttgacaaaaagaccagtaaccggatctaaatcactcaatcccactaatcacacagtcgcaaataaccttgacagaacaaaattgtcttctgaacgaggaccataagttggtcaagtcgaacgcctgaactaattaagaaagcaacaaaggtttcagcataccagattgacttctggcccgcatcttcacaaacacaaaggcaaactttaagaaaaattcaaaatagttgtttaattattcttgcggagctattctaataagctattaactttgacaaattgccacaaaatgagagagcggacaaacattcaagactttatgtatacacgggtcttgatttacgctcgatttaaaaaaaaattggccagtttgtatgctccttttaatttaacaaattaaataattaaacatgaaaattaagtgtgggaaattttttgaggaaaatgattattgacaatcactgagaaacatttcactt

SEQ ID NO: 31675 - DNA, 1417 bp, Heterodera glycines
  misc_feature (130)..(130): n is a, c, g, or t
ggaaacatgatttcaaaattttcaatttttttctagtctaatctactcaaaacggttcagaattcaataaaaataacattcacggtgcgaaaaatggggtttgaaaagtttattggggaaaaaaagactntacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataataccccttgatgggatgcactggttgatccaatcaattaatttaatattttatttgggatggggcgacaaaggacacaaagtggaaaatttggtagatttctgatcacaattgatcaatatccgcgatgcttcgaatgcccgagttgtgatgtattcagagcgagttgttgtccggcttgatgagtgaagagaaccgatgggctagcagagtgaattggttgaagcatgcttaaactgaaaacccttcccctttttataccaaaattttttggttatttaatagcattcaaaatttccacattatctttttatggttttttcatttctaaattattttttatcgttttagttttttcttcccttttatttaagaaaggaaaacttttcataaacaattttaattgcttttacgttcaaccgttttattgtggaataaatttatttattatttggggcgttttattagattatttttagtttttattgcgagaagcatttgcttcgtttttatgaattcattttgttttatttatttattttattttacttttattttatattcctttatttatttaatttaattttaaaaataaaaattttatgaaatgtttattttattttggatttatttttattaatattttgtattttcatgtaaaattcttattattttaatttagttttgtttttattaatagttttatattttttcggatttaatccgacactcccaacagaggaagatttaggtttagttttggtcttccgtcggaagattattcttatgattagaggccatactattggacccagaaaaactgcaaatattaaaatgactattaatggtagtatgaaccaggcaatccataaatttgactttaagaaatttataattttagaaccgaaattcttaatattattgattatttcatcaagggttataccagtttcgggattttgaatagtattattcaaattcgttttttgttcttcctgttgttgtacgtaaaataattttccttttatttctacttcactattacctcctggacatattagcgagcatttttcattgatttcttctatattataagttagttggataatctgttcttt

SEQ ID NO: 31676 - DNA, 625 bp, Heterodera glycines
acatacctgcccaagggggtagtcaagggtgggagtcatgacgtcgaacgtaaggggtcagcgggtgtcgaacgtaagaaatcggcgggggagggtgggtcaaaagaggaaaaaaggagagaaaaaagaaagaggaaggaaaaaggggaaaagcgagaaaaggcagcgtcgaaatcaaggaaagtgccgttaattacgttcgattaaccctgaggactgggttttgtcgaacgtaaaaaaatgaaattaactaatttccattaagaaattttgctaagtgtttcaattcagttacgttagacactctttctttacgttcgacgaattctgctgaagaagattcgtcgaacgtaagaggagtggctgaaaaattcctaaaatttttcctgttttttaaataattaaaaattcctaaattttcttaaaaaattgactcaaatgagcaaaaaatcggtcctttttttgacaaaatttgttaacgaattactagtacactcaaattgtcaaaaaaattttcccggcgttttgtttcttggtttttaaaatccaagctctgaaaatgcttaacgagaaataaaccctcattttttattaagctcagccacactttccacaacaaaaaaaa

SEQ ID NO: 31677 - DNA, 1051 bp, Heterodera glycines
acaaatttagggacctctttgtgggctgatcgcagctccagagaatttaagaagcacgctaaagcttaacgatgtgccgtggtggctatgagagagggtgataatgatatttggaatacaatttagtgagcttttttgcgggctgatcgcagctccagagaatttaagaagcacgctaaagcttaacgatgtgctgcggtggctatgagagagggtgataatgatatttggaatacaaatttagtgacctcttttgtgggctgatcgcagctccagagattttaagaagcatgctaaagcttaacgatgtgccgcggtggctatgagagagggtgataattatatttggaatacaaatttagtgacctcttttgtgggctgatcgcagctccagagaatttaagaagcacgctaaagcttaacgatgtgccgcggtggctatgagagagggtgataatgatatttggaagacaaatttagtgacctcttttgtgggctgatcgcagctccagagattttaagaagcatgctaaagcttaacgatgtgccgcggtggctatgagagagggtgataattatatttggaatacaaatttagtgagcttttttgcgggctgatcgcagctccagagaatttaagaagcacgctaaagcttaacgatgtgccgtggtggctatgagagagggtgataatgatatttggaatacaaatttagtgacctcttttgtgggctgatcgcagctccagagaatttaagaagcacgctaaagcttaacgatgagccgcggtggctatgagagagggtgataattatatttggaagacaaatttagtgacctcttttgtgggcggatcgcagctccagagattttaagaagcatgctaaagcttaacgatgtgccgcggtggctatgagagagggagataatgatatttggaatacaaatttagtgacctcttttgtgggctgatcgcagctccagagaatttaagaagcacgctaaagcttaacgatgtgcccgcggtggctatgagagagggtgataatga

SEQ ID NO: 31678 - DNA, 1034 bp, Heterodera glycines
ttctttttttaatttatttaaaatttaaaattattttcccttaatccgttaactgtaagtttttctcaaattaatttcgctattttcggtttcaattgtttttaaacttacgagaagtgtctcgattctgtttcgccttgtgcgaaatttgagaattggcacacacaatcgaatcgtcatgagtcttgtttctgttgaattataagtgacgccaacgcaactataaatatatttttttcacaaatattatttgagaaaataataattttcataaaattaaagccaaaaaaataataatttttttggcggtaaaaaatgaaaatttaattgtctcaaaatcgtcacttttgcaattacgttaatgtcccaatcaaaaagggaaaataccgtaaaagcttgttgctccggttaatgatgacgcagctttgggtcaatcgtccttggaagtatcgttgatcatacacccggaaaagtgcgagtacgtcgggtttgaatccgtcaattccaggccgggtccaccagattgaactcggacatttctaaaatgtttcaaaaattttgatcggtgggaagaaattaaagtttaatttgaatttactaattttttaataaattttcaatatttcttggtcgctattttacaaagatttccggtccttatctgtggagttaattaatttttgataattagttgaagattactattttatttaattttcacatatatcgaaattacctgtcggaatatagccttctatttcactatttccatcagatgcattgctgctttgatcaactaaatttaaatacccattaatttaccgtacacctgcccgcaaaatattacttttttcaaaataaagcaaccataacactccaaaaatagaatttggttaaaatccgaattaaaaattttacaatttctgcttcattctctatacccctaaatttggattttttcgcccttattacggccttattttggttttttcgcccttaaaaatccgatccatatttaggtcctaggaagaaag

SEQ ID NO: 31679 - DNA, 998 bp, Heterodera glycines
ttgtcgtcccatcccaaataaaatattaaatcccttgattggatcgaccagtgcatcccatcagtcaatgaccgcgtaaaccacctttaaaattatatgtataaaacattaaattatcttcatttatttattgatcttgtcaaaatagcaatgaaaaaattataaattacttctagaaaacttaattaatttttttgaaagtcaaattaatcactttctggtcttttctttttgttttttgaaatgattgatatcttcatttttatggctcgaaaaaaactttcaatttttcattaaaaaaaatagtaaaagcagcgaggcagatgtatttatatgaggtaggttcattttttaaaatattttttaatatatattttataaaaatttatttatattaaattattatgtttattttcattttaaaatatattaggcatgagattgatttgtgatttttaccatggaagcttgctatcagaaattatgtttttttcaaagaatggtcattttttacttttatttgcaaaaatacgttttctaagtacaacttggaaataagtgcaacatatatcatcattttgacaaaaattgcctaaggacaaaacgccaaaaaaccccactaatttaaaaattttgccgagattttcccttgtaaaaactgaagagccgatctcgagctaaaaacttaagttccataaaataaacttggaatcgctagagggggtcaaaatatgggcctatgcaaaatttgaagaaatttaaaaagctagaaaaattttttgaaagggacgaatatttttaaaaacaatgataaaacatatagtgtctaactcagctgtctgttttttcattggcgtattgttcaccattaacttttaatagtgtctaactcatacagtgtctgccgtttcttcacacttattgtttttttaactttcgcttcgaaactttattttttttataatgttaggcaatttttgtcaaaatgatgatatatg

SEQ ID NO: 31680 - DNA, 712 bp, Heterodera glycines
acaaatttcttttatttttcataaataattttattttcatttttctaagatcgtgtcaagcgagagaaggaaattcttcttcagaagatcaaaggcgaaaaagtaaatgcaatgatattaaaataaattttcagttttttatttatagtaaatttgctaaataatcccgaaacattttgatttatttaaaatttataaatcaactattattttaattatttattttattaactataaaatacattggcaccgccggaccccattgaaccattattttttgaaaatttgaattcaaaatggcaaaaataaattgtcatttttggtgcaaaatcgctacaaattcctgttttttcgccccagtgctgaaaatattttgaaaaattcattggagaaaaaaaaaacttttttggcccgatgagcaaaaaaaaataaaataaataaatacaagctcttcgggtgcattacccgaattattaaaatttcttagcaattttccaatggtttctattgtcatttcgccaaaccataaatttttattgactcaaaaatcgcaaaatttagtttggatttaatttattgcattagaaatttttgtttgaaaaataaattggcaatttttattaaaaacacatttgctaatgatttacagttgaccactgaacaaattcttcgtgccgagttcacgcgcgaacgaaatcagctggaaaaggcg

SEQ ID NO: 31681 - DNA, 955 bp, Heterodera glycines
aaattaagaaatacaacaacaaaaaaacagggcatgacaataaattaaaaaattaaattttttcatttgtctttgttaaaaatattgatttatttgatcaaataaatttattaggtatttgatttttatgaattcgatttttggtattatttaataatttaattctgcatcctatttaatgtttaaaaccgcgccaaactcgtacaaaggcaaatcgtgcaatggcttagttaggcctaagctttaggcaaggccaagacttaaaattagaaaaatttattattcatttagcaatattttttgcaaaatcacaattaattaaataaaagttcaaatatttaactatttaaaaaaagtatttcttctatataaataaaatattttttttagttagttcaaaagaaaataaaaaagtttgaaaagggctttagttaaaatatgttttttaagttttggactcatttaaaatttttaaagtttttttatgaaattaaatggtcattacttagaataataataaattttcattgaaaaaagtaataaaaatagaatttaatgttcaagtacactgtaataaataaattcgcaaattttaggggctcaactaaatcattacccacaaattcacaatatttaatatgaaaatgcttttatattttaagaattaacggaagtaaaaattaaataataatataaaaacggctttatttatatgatattttattcttgcaaataatgaaagaactattattaattataattgaagtaatattaaaaaaattacttatcaattgttggatctgcatttttggcttaattcattttttcatttatttatttgtttctctttttttcttcgtttctttgacatttcctatgttgtaatttccctggcccttctgctcctcactcactcataaaagtgaccccttcgtccatccatcggaaaatattc

SEQ ID NO: 31682 - DNA, 1810 bp, Heterodera glycines
agttggcatgtcgtcttgctgtgaagacatttttagctcgcgagttaagctgcggcgactcatcatatcaattggtgttgatcttcgaactttttgcatggcaaatggaaaagcaaagtgccgacaaatggtaatggacacactgggacggcactcagacaatgaaagagcattctcgacgaagaggtgtaaattgctttttgcgtatttaaacaattcttaatgttaataaacccaaacttatttcagtcggatttgctgctgaaggacggcgtttcctcggagagtctttctccggcagagtcttccgcttctcttctgccgcgttatgtgcgcgtgaacaccgtcagaatggccttcacacaagcagttgaactgcttgaacgggacgggtggtgcctttgtcgtttgaagaagcgcattacgccaagcaaatatcgaagattggtgtcaacattggagtcgcctaaaatttacgtggacccgcacatttacgacttgttgatattcccacggggggtggatttgcacaacaacaaattggtcaccgatggaattttggtcctccaagacaaagtatcccactaaaatgttggcacttttcatttgtctgttttccctaggcaagttgtctctccgcctttgtgcttcagcctgagcccggcgcatcggcgatggatgtttgcgcagcgcccggcatgaaaacgactcatttggctgccttaatgcacaaccgcgggtcactttttgatgcacttaagtggacacatttgtttcacattttcagaacgatatgggctttcgatcgcgatcagaaaagggtggcagtgctacgacaaatggtcaagcgaagtggcgcagggattgtgacggcgcaatgtgcggatttcttacgggtcaatttgcttgacgggcgatataaaaaggtattgcatcgatttttacaaagacaggaattttacgccctttttaggtgagatttgttgttgtggatccgccatgttccggctcgggaatggcaaagcggagcgagcatttggacgaatttgaagagcccgatgagcagcgtataaaggcactggccaaccttcaggtaaagccaactgcaaattgggattttgcttttcaatttcgacccgtttcctgagggttcgcgcctcacctcatacttttctttctttttgggtaatgcttcttcggcacgccttccgtctcccctctctgcagcgtctcgtctactccacttgctctgtgcattgggccgaaaatgagggagtcatttcggagattttgtcctcttcaccactcagtgagcatttctcgctggtcgaccctttgcctcaatggcgccaccggggacaattgggccaaagtgggaacgccgaactccgcaaatgtttgagggcgtcaccaaagagggatttgaccaacggattttttgttgcattgtttcaacggagaaattcataaacaaaataactattctaacggatacttttcttttttttcactgtttactctattttccaatattaaattcgaataataatttcctacgcaaatgcctttttcatgtttctccagtcgaataaattatctttttgccaacaattcatgttttaatcatttttatgatacaaaagtgacaaggtgatatgttgtcaaagtgtctccgctcgtcaatttttggctgctttaattgtgcgctccaaaatgtgtcttctgctggcgttttaatgaattcgggtgtcaaattctgtttctgttcgtcctttaaatacgtctttggtcctttcagttcgccatgcgg

SEQ ID NO: 31683 - DNA, 1206 bp, Heterodera glycines
aagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcgcggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaagagcttcgatatcaagaaaccaagtcaagtccagaaaggaatattttaaaacgatttcgttttgttttggcattatgataccgaataactttcggaaattatggaaaccaaattggagaattcgaataattttttgactgcaaatttttttcctttttgaattgggtc

SEQ ID NO: 31684 - DNA, 1357 bp, Heterodera glycines
ctcctcccctatttttccgttttgtcccttcttttatcctcctctttgtttcttttcatccgaccatccatcatttcatctttcaccccgctgtctgttcatctcctcactcacttcctccgtcccaaagcccagcccaagtcgtgccagtccgggctctgtttgctcatcgaacgaacaacccgattggcgactaccgactgaaattgttgcgatggctttttgtccctcttcttttaatgggtttaataagtgcccccccgcgtgtcattcatctgaatgccctccccctttttatttcgtcccccttcccggtgctttgccctccctcccccaaaggtctcaccaaaattgggtcagtcccgtgcgcttttgccctcctcatcgcttcgcctcctccgccggccgacgatcgctttccccacgcccagcccaaatcgtcccaatttgcgctgctctgtgccgacttttccgaatttggaagtgaacgttttccccaggcccagcccaaatcctcccattgtggcgactcggactttttcagaacgtacagacgccgattgtcgacggaattcggatctaaaatgatttttatccaaaagttataatggaccaaccaaatctgtccaaagttccgaaatgccaaccaaacgccgaagggaaggcgaaaattggaagaagaaaaagcaaagaaatgccgttgagaggaaaggaggggcgacccatggacaagctttaactgtttggactctgctaaatttgtgggagatgcaatgatcgtaagggaaatgtaaaaattgaaacggacgaatggacggaattagaattattagccaaatgaatgtggaaaaagggggggggggaagacgcgagggattggcagggccaacttttgggaatgaaaagcaacgactcgtgcgcttagtttagcaaaacatcacagcgaatggagcagggagtatgagaagtgtgagatgattttgggaattattaatggaagtggtggcacgggggcggtaattggagaagtgcggcccaaattggatggattttgacggagggggggggggggtcatgccgcaagaaagcgtggggggacggaacgaatgccgacgaaccaaacgaacggacggacgaatgagcgaattgccccccggggcacaaattcccaccaaaagttgtttaacttatgtttgcacttcacttgcaaattgatctcatttatcagtggtttagcgttcctttttccttttgctctttttttgcattttctttccctctcaaaaaaataaattagcaaaaaaaaatgaattgcgatttatttcggtccggggcgataagcaaattaggcaacaaa

SEQ ID NO: 31685 - DNA, 1292 bp, Heterodera glycines
attttccaatgattgaacattttattttatttatttttgtttccccattattccccttttaattctcttgttttcctttttcattaacttgttaaatccaaaaaatttgattaaattaagttgttaaaagtcaattctcacataaaaaagctttcgatggccaaaagttgagtgccccccccccccaataaatgcgacatttccttttctttttctccttttctttttctccttttctttttctccttttccttttctcttttcctttttttatttttcttttttcttttcctttttctcttttctccttttttccttttttcttttcctttttttcttttccttttttccttttccttttctcctttttcgacacgcaaactcttctctgctggtctgtcttttttgttcttttttctttgatgcgattacatttatttcatttcattttaatcacatggatttcattaattttgatgttttaaaagggaaatgcctttaaatttcttatcacttccaaatttcccatttcccttctgataaaagttccttccgtgcttttctctgatgagcagaaaccaaaccaagcaccccaaagtgaataattaaatgcacaaaacaaatggattaataaggatgcaattaattatttataaataattcgggcagccaaatggacaaaaacggggggggggggggggaattagacaaattaagcaaaaagcgactgatatttgcatggactgacaaatgagtgcggtaaatgggcgagaaaggaatgacggatggatgataataaacaaattggcattcactgaaacattccattcattcgtcagcatttaaaaatgtttttatttaatttaatttataattaacaggcgcaatttattatttgattttattaagaacaaaacaaaaaaacatgctgagtaaagcgcgcatcattgtggaacagagcagttcaaaatttttgtcattttatttataaaatgccacttatgtttctacctctttttaggcaactccttttatttaattttccttttgctaaaattcggatataaaaatctgtcattcataatttaaataatatactaaattagtcatttttaaaaatcaaaaattcatttgtttattgataaaatgtgaaaatgtcgtatgaatgaacccattcatcttcatcttcgtttgacggtctttcgaccattttcagtaatttaatttacataaaacataaattttaccctcccgaacaaaaaaagaaaaagggatggacaataataattggt

SEQ ID NO: 31686 - DNA, 1255 bp, Heterodera glycines
  misc_feature (93)..(93): n is a, c, g, or t
  misc_feature (110)..(110): n is a, c, g, or t
  misc_feature (135)..(135): n is a, c, g, or t
  misc_feature (140)..(140): n is a, c, g, or t
gcatcattttttgggggggggggggcgaagttcgaagcccgggcggtgtacattaattttctttgtattttttgggttaattttcatactttntaataaatttaaatgtntggttttattaataataaatttttntagtntaattaaattattttttgatgaataatgattttcatttaaattatttattatatttaattaaagaatttcagctattattttaaaatttaattgtaaaatttttttcatttcaatttaaataactattcaatcaattattatacctttcataatttgtttttcattaataaaaagtgtattatatgttaaaaaatgaaaaatataacacttcgattttttatctattttgattaaaaacaattccttaattaccataaatgctctatttgaatgcccactttctaatcactgttgtacctcttttaatcacttttgtacctcttctaatcactgttgtacctcttctaatctctgttgtacctcttctaatcgctgttgtacctcttctaatcactgttgaacctcttctaatcactcttctaatcgctgttgtacctctcctaatcactgttgtacctctttttatcacagttgtacctcttctaatcactcttctaatcgctgttgtacctcttctatttactgttgtacctcttctaatcactgttgtacctcttctaatcactgttgtacctcttttaatcactcttctaatcactgttgtacctctcctaatcactgttgtacctctttttatcacagttgtacctcttctaatcgctgttgtacctcttctaatcactgttgtacctcttctaatcgctgttgaacctcttctaatcactgttgtacctcttctaatcgctgttgaacctcttctaatcgctgttgtacctcttctaatcactgttgaacctcttttaatcactcttctaatcactgttgtacctcttctaatcactgttgtacctcttctaatcgctgttgtacctcttctaatcactgttgtacctcttctaatcgctgttgtacctcttctaatcactgttgaacctcttctaatcgctgttgaacctcttctaatcgctgttgtacctcttctaatcactgttgaacctcttttaatcactcttctaatcactgttgtacctcttctaatcactgttgtacctcttctaatcgctgttgtacctcttctaatcactgttgaacctcttctaatcactcttctaat

SEQ ID NO: 31687 - DNA, 1397 bp, Heterodera glycines
ggtggagctacttttgtttttgatgcggaagtattgccttcaagatcacgtttaggatctggtaagttaaaataataatgggaaattttttttctcaataaaaaatattaataaattattatacgtgcttgcaatttttcaaatggaatatttttctatttgctgcaattcaaaaaagttatgggcacagagctataaaactttctagcacattttgttatttgtggtgcatcagtgtgataaattcataaatatcccagtcctcgtcataaaatattgttctaagaatgggaatgtaacatcaagttactaaaagcaatcacagtcgtttctcttttccgcagcgcacagtatcctggtggcagatgatagtcgtagcaaccgtaagtaatgaattatttgattgcattctgtaactctattacctgaatccattcgttatatttctcagtcacaagcggtaagacacttgtccgtaaaaattcaatcgctgttcatattctgctgtatgcgggtggaattccgtagtaatcccgagcagaaaagaaaataagcaattctacacaattctcccaaacaaacgcgccgagaagcaaattccagaacatttagtatcggcgtaattattctgagaatgcggttgtaattcctattactgttgagcagaaaaagagataaccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttgtaatccctattactgttgagcagaaaaagagatagccaattttccaaatttttcccaaacaaacgcgccgagaaacaaattccagaacaattagtatcggcgtaattattctgagaatgcggttgtaatccctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttctcccaaacaaacgcgccgagaaacaaattccagaacaattagtatcggcgtaattgttctgagaatgcggttgtaattcctattactgttgagcagaaaaagagatagccaattttccaaatttttcccaaacaaacgcgccgagaaacaaattccagaacaattagtatcggcgtaattattctgagaatgcggttggaat

SEQ ID NO: 31688 - DNA, 1338 bp, Heterodera glycines
  misc_feature (67)..(67): n is a, c, g, or t
catctgtcagaggtgtggtttatgcattttggcaactaattaacaccaatttaacgctttttctccncatggcacagcatccaattttatttatgggccagtgacgtgctttctgaacaaggaaaatcgtggagtaaatgacgaacgctttccaagcaattagtgattatctgggaaaattcaagccttaactcacaaatcagcacaactaggaaatcctgaattcactttatcttttttgtactttttttggcaaaataagtttgacaaaatggttaatttattttgaagaatttttttatttaaagtccaatttttcggaattcaaaaagtccgctatcccgtactgatgatcccacaataatgttcggtttcttatattaagaatttctgtgccactatttgtaaaaaaaaaattttaaataggatttttaaaaaagcaaaaaaaatttttgaatgcgcttccgcgtccgcttttgcgcattttttctgttcgtgctccttccccgttggcttcaacactttcagattgtctgatcccgagcatttcaacttcgatgcccagggaaacaaccgacacagctattttgacaatcggtgtggagcggaaagtatgaaatttcttcattttggcattttgatttcaaatttggaaaaagaaaaattttaaaaagcaattttatttcgactttgctccattattcccttaaaatcaaaaaagcatttaatgccaaacaacaacaggagaaatgactgccaattatttgggcacattttgcggtggcggcggtggcaccactgagacgacaacggcacaactcaaagtgctgaagaaaaagtggcggaagaagaagaaaaacaaaagtgccagcggtggtgccaaaaagagcggcaaaaacaaaaatattggcattttgtcctcgtcatcgtcgtcggtggagcagcagccggaagagaacggcaccgtcacaacgccacagcagcaacgacacatggcggcagcatcatttgaaatgacagtgactgctaccacggctggtaacactgctgatacggtagtgggggtgcccaaaacgacaccgccagtgttggcaacgtctgagagtgtgccatcgtcgtctgccgcctcggcaacaaaagcgtccgctcccgcaggtggcgatgcctcttttgaacgtgccgacaaagtgggtaccggaactgcagcaacaacaacagtgacagctggcagcaccagtgccgctgcgcgtaaattgccggacgccaccagcagccccgctggaggggaaattcgcttgctgccagccgaggcggaggaggaactgccagctgactttg

SEQ ID NO: 31689 - DNA, 883 bp, Heterodera glycines
ctgtcgccgaatttctgcctaaattttattagtttacttaattagcaatgattgtccgaaacccgttgtttttgtggctctgggaggtgattatggactttttgtccgaaatatccggccattccattgtcgcttttgtcggtgattgtcacgcgtgcagggcagtcacgcacactgcatctccacaactcattttgtttgtgcgtaaatcggaacccttaaaaacgaaaatatttcttgaaaaaattttttctcaccattaaaccaaatgcagacacctcctcttttcgtttctccaagttcgaagtttacgatggcgtgttcttcaaaatcatcgtcgcggtcgttgttgttctcattttgttcacggtgatcagcagatagcgtttcgttttcactgtcattgttatccaaaaacttgcgcttacgacatttttgaagattttcaatttttttacgattcatcatacgtctaaattcgtaaatttatgctgtgttaactaaactcggaaaaaattttagtggtaacactttaaaaactaaatattttataaataaaaagaaatttggggacgaaacgactaattttggcttggggggcgaaacgacgcgggacgaaacgacgcaggacgaaacgacgcgggacgaaacgacgcgggacgaaacgacgcgggacgaaatgacagcgcgccaaaatcagcaattctatcggggaatagagcaccagaatcgatcgaagtcaattgatcaagatcagtgagaaatgttggcgattggcgatgtgcggcgacgcaaattgtccaaagcatcggcatcgtgaaagcccaaatgacgaatgcttttcgcaaaaataggccaaatttcacggaaaaaacatcccaaa

SEQ ID NO: 31690 - DNA, 1038 bp, Heterodera glycines
  misc_feature (41)..(41): n is a, c, g, or t
  misc_feature (47)..(47): n is a, c, g, or t
gttaagagtttatatgtgatacacattttttgttttcgaanccatgnacggaatttaagaaacgctccagcacgggtgaaaaagcatgggtggaatcgatttaaattttttttaaatttgaaattggggccatcccattttccatttgccaccttttctgccaattgcaataccattttccatttttgctacagaatgtgtgtgccgtcctttggtctcacaacggcaccgcactgttcagcgtctttatacgtgacgatggccaacagcaaacagttgtggatgtgatcgacggagcaaatggtgacggaatgatggtggaggaaaagcagaaaaaatggcacacaaaagacggagcaatggcactgatattcacggcaaagcggggaaggcatgcaattatttggcaaaaaaaaaaacaaatattaacaaaaagataaagcggacactacacaaagttttaaatgacataaaaaacaaaaatagactattaaaaataattagattcaaaaataagaattaataactttctcttcatactagttaaattatttattcttagatggaaagatagggggcattaaattaattttgtaaccataagtttaatttacaaattttatctaccatacttcaaaatttaagaagttgagattctacatattctgctgacaagggaacattttattgtaaattcgaatccgcttgacagatggttaattatttagatttttgaaagtaaagtatcattccatcttgcatcttttttcaactatactatttaatagaggaatgaattattgctgatcatgtaaaaaaaattgatttggaaatttttttatgaattttaaaatttaagcattttaccgatttttgatactttgatcactttttttctgatcatttttaaaacgccgaaaatttacaatagcaaatgacaatgctctacaccataaaattggttttaaggtgatcttagcagttatagttaggaatattgccttgtgagcccttattcttaggggatggtatttttga

SEQ ID NO: 31691 - DNA, 1687 bp, Heterodera glycines
ctgcctaaaggagggatcaccagcccggcgggctgtccaagtctaccctccctccgacggcaactacccggtggtcgtgcaacttttaaaagagcgattcggcgacacggacgatttacagcgggcaattcgggcccggcttcttcatttggcaccggcaaaggacaatgtgaacagcttgacgacgatgatcgacgaatttgagcgatgcgtttgccaactcgagcagctcggagcgaacgtggacgacgactcatttgggccattgctggaagccaagttgccagtgcgagtgctcacggaattgcggatcagagaaagcatgatgggatcgaaatggtcagtgcgcgagttcaggagagcggtggcagcgcaagtgcggtgcatgcgatcagctgagtcagcattagcagcaatgaaagacccggaagtacgcactgatcaccgaaccgagcgtgatcagacgggacgaggaggcaaagcaggtcgggagccatttcaaagggcatttatggtacgggacagccaacaaacccgtgcgcagcccaacggaacacgaaaagaagagcagtacgggacgaatgcccgtttcaccgggcgaacagtggcacgcggcaacgagaacggacacacgggtgggaatggaccccgcttcgcgcaaaatgggctccctccaagcttcgggagggggaattgttcgttttgtctggagagcggacatcggccgagtgaatgccgcgcctatccgacgccacaggcacggaggaagcgactaattgaacaaaagcgatgcctgcgttgcctgggctctgatcacacattcgaccagtgccaacgaacggtccgatgtgacgcatgccgaaaggacgatcatcacattggcttatgtgctggaagaaccaaccgggaaaccaatcccggccctccggtgaacccgaacggaaggagaacaaccacgcgatgctgatcagtgggatggaccaacccactcacgttactacatcacgagacgagccgaacagtcgagacatatccgagacgaatgccggggagcaacgggctttcaccgcttttggaagccgagtcccggcccagcaaatgatccgaagagtgaccgcagcagcagaagaaggcgaagacgaatgccaaacaacattgttgtttgatccaggaagccaccttgactgcgccgagactgagctaattcaacatctcggaccgcaacccatcgacaagcggccgcttacagttcaagtgttcggaggaaagaagcagcggattcggtcagcaacttatcgcctacgactcaaacggaccgacggcaaatgggagagcattgaggtgtctgaagtacctcagatctgtacgctaatcagaacagaactcatcgagtcgggagcaacacccgatagcgacccgcgaaccatcacacagacaacgcaacctcaaataatgatcggcattcgaaagttctgggattacgtggtcggatttcggaaaatcgagagtggcgcgcatgtgattgacaccgtgtttggacaagttttgtgcggcgaaggcacccaagcgagcagcggggcaactcccgcggcatcaatcctaacaaccatgcaatgcggaaatatccaccaaactcgaacaaataaacaacaacaaatcggagaagtacgtcgaaatggaagcgaaa

SEQ ID NO: 31692 - DNA, 1430 bp, Heterodera glycines
caggtttttaatagcatcgacccaggcctggaaaaggatgtctatttaaatttattttacaaagcaaaaaaagtataaaaatcatttaattacttaggaacttttctataatatctatttatcaataacaatgtttttaaatttatttgtatttttttgattttttcaaatagcctcggtcccattaagaaacaaattttgagaattatccaggaaatcccattttttcatatttatctgaacctgtattttctggacatgaatctataaaatttcaggcccatgaaaaattcaggttgtcgaaaaacagtctggacctggacctggatgaaaaaaaatctaggccaggatctcggtcaaggtgagctcaactttttacagaaattttaaatcagatgaaaatttcaactgaaaagctatgctaaaaaatgaagttataaaatgaaaatcgaattgcaatcggattttaattggaaaaacaaaaacctcaaaaaatcgactttcaactttttctgaattttttcatcacttttattttataaaacacaaatatgtattaatgttatgccatataatttattttaaattaattttctattctcaagtttcgcgtttcatttcttattatttggattatgtccttggatttcaggacgtccttaggcataaacttgcagccttcggatggataaagatcggatttaagaaaattatgattttgaacatggataatttccactgacaataattcttggtacatggtgctgttttacataactgaaattcagtaccgatttttacaaaaatttcctctcaggcatatttctcctaataaaattttaagctgtcgtttatttatacataaatgacaaaatttgaatgtcttccttaattggttgttaaatgtcaatgtaattaattctgttttatgtggctctgttgtgcaattaattagcgtgctaattagcactactaattagttgaattgctggcgtttgaaataattgaccactagcgctgatggtattgttgccaagagataagttaccaagtccaataagagaagaaaatttcttcaattcaacagcaaatgtctcgcgatagtgcgaactaaaaaaagaaaaaattttattttatggatctaaattgatgtcacaaattcggcattactggaaagtgtttccattaattattgaagtatttagatttaattaaaattataaatggattttttttagattgtttgcttatttaaacgcagtaattaatttattaggtaatttattatttcataaatttatatgaactaatttttaaatgctattcctcctttttatttattaaatttataaaattactgatttttataaacctatttttaggatttttgtcgctgaaaattcgaaatttcgattaaattaaaaatttat

SEQ ID NO: 31693 - DNA, 1758 bp, Heterodera glycines
  misc_feature (751)..(751): n is a, c, g, or t
attttgctgcttttccacttgatcactcgattgggccctccttgtcccttttaaaatgaataaaaataaatatttatttttaatagttataaattattaaattagatattttaaattaattaaaagcatcaaacaaacaaataaatcatcaatttcttgttggttcttttctctaatttttgcttctgcaaattttcgccattgtgatagccctttttggaaccattcctgaattaaaaaatttataaatttattttattattttagtttttaattattatttttttattattattatattaagccttacctcaacttgtttctccgtaaggcccgtttcaatggccaattgtgcacaagcagaagcacttgggcattccgttgtgtcaaatttgcgttccaatttgtccaaaatttcccacgaaaaataaaatggatttaatatttattattattattatcatcttaattaattaggatgacccaaattgttcgcttacatcgtcatcattttgtagtgcaattacttcgtcatcaacagttttttgcacaacagccataattttgtcataaatgtgtggcaattgtgggttttgttggtccctaaatttttgaaaaaaaaatgttcaaggcttaaattcgttgaaaattaaaaaattaaaaaaaatatttagccaaagcccacattgtttttcgtttccgttgtaattgtcgttcttggaaccattcctaaatgaaaattgttgtttanaataattaaaaataaatttttaatatttttttcaatgaaattagtgccccctacttggacttgcttctccataattccagtttccatggccaactgtacacgcgaagcagcacttgggtatttcgttatgccaaatttgcgttccaatttgtccaattggtcggccgaaaagttttgtttttgtgccttaaaattaaaatacaaaaaaaattaaaagccaatcaattcccggactaatctcggctcccggacaaagggacaacttcgggaatggcataaacgaataaaattgaaaagagtcagacaaattaaaatacaaatgtaataattctatttaattgattgtagaaactgcagaaaatctaattttctgaaattcgtttcgtcagcaaattcccgtccattttcattcacttacaacaacatcattttgctgtgaattttgttcttcgacttccactcgggcttttggttgaacagaaatgccaacattttggggaaattgttgtccgcttaattcactcattttttgtgatttttgagaaaaaataataattaaataatttttaatgcttcataatgcatacaatcaatgcataaccattagaaaggcctatacgtgttaaaaaaagtactaaaaattccttaaaaatggtcggcatcgacggagaaaattaaattttttttttccaccagatattgccgtttttcaatttcggataatagaatttttaaaatttaaataaatttttttgagatatccgtaaaaaattggtaaaacaataatttagtaccaagttgtagttgtagttgttggttctgttgtttcttgtcgtttccatcgattacgctgattttggaaccaaatctaaataaaataaaagtgaagaattaatatttaatatttttgttgcaattttaattaggtaatttatacacagtcgcggcaaaaaaatattggatcagaaatttttttacaaaaattgtagtttttatcaaaatgactg

SEQ ID NO: 31694 - DNA, 1103 bp, Heterodera glycines
gcatgcttttagtccaaaaggcggtgcgcttgaactgggacagcacacggggatcacatcagcaaaagtggcgtcccaattgctgtacgcgtcctcgccacttttgcaaacatattggccaattgctgcttcatgcaaagcagctaaattcacagaaacattttaatgtaattaataaatggatttgaaatttatttttcaaaaaatgggaaagaattaaaaagttttcatggaaaactttttagtgattaaaaataatttaaaagactaaaatttcatcctcatccttaaaaaagttttacaataaattttaattggccaaaattaatttatgaagttatcataaattgaatgtaaatttattgtttaattttatttttttaattttcttaaaattaatttaaatttataatttttttaatttgatttaatttttcaaatttcttaccccggcacccctgcggaaaagttgttggcggttccgttgcgaacgtcctgtaaattaatgccgtgccaaattccgagtcctccttgcagcacaagtgcaccgaagcgtaataagtgagcggcggatccgtcggagggcaaagattctgtcccgactcatagacaaagtctaaaaaacatatataatatttttaaatatattaatggcttaatgttgttgcatttttggtggaaaattactggaaaagaaatccagcaatttttcaatttttccgcttgtttcctgtccatcattttccaatcctcttcatttttcggcatttttcaaaattccgatctctattacaatattcttttagcaacgcccaacctttaaattttttaaagtttttgacaaatttattgttttaaaacattggtaatttggactgaattttttttcacccgtaaaatctcgtcactttgtccatagttaaataaattcacagacttacgagtacaataatacattgcttcaacagccacgtaaataactgcacaaaaattgaccaaaaataattttagtcgaaatttttcccatttttaattcgaattgtaaatatgctatttttttcaattcttttaataagaaatgtttccattctgataaataattt

SEQ ID NO: 31695 - DNA, 637 bp, Heterodera glycines
ccctacttatggtataagaaattccagttccgtctcgaagattgacttatttttcggaattttcatcacaacagtcaaattttgccttaaaaagtcaaaaaaatcatgaaaaaatgtaggcttcaaacaacctgtagaacacttttaagtcattttaaggtcatttagagtcagcaaaaaaaaaaagtcatttgacttaaattcccatcccccggtgatgcgacatttgcggcgcagacacttgcggcgcccagtcaaagcgacacttgcggagcagacacttgcggcgaggacattttcggcgccgacatttgcggcgcgacacttgcggcgccgaaagatgcggcgcccagtcaaaatgacatttgcggcgcagaattaaatggccccaaaaatattccaacatttatttaagttaataaaattgttattttaagtttattttttaataatgactagtttaacaataattcttgcaacttaatcacaaagataaaggttaatcggttgccgttgtaacatattcagaaaacgtttcactttgccccacccagcattttcaaagtataaatgggatattgtaataaaaatatttttacaaggtttattatcgtcattaaaaaagaggaagagcacc

SEQ ID NO: 31696 - DNA, 698 bp, Heterodera glycines
gtcttgacctggttttaagccaatcttttcgcgaatgttttcacacctgcttaattccttttttaattgcgtgaagtttatgcttcttttcacgtttttgttgatcagtgcattcatcattctgatcgtgacgaattgaatcaaccaaatttaattttttttgatattttgacgaaaaattgcgttttgattagttttttattattctgttttgtcatttttccattcagtgccaaatatttcagcaaaatttggccgaaattttttacaaatttgaatgataaagttcaatttatgaataataagtagggttcgagccccgcccccgtcacccccgcccccgccgggggcgggacaggttttttgggctcacccccgtccccgagcccgggacatcgaaataggaccagaatcgatatctaggaagggtaagatgagtagggtaagggaaagatgagagaaaaagaaagataaaaggaagggaaattatgagaggaatagaaagatgagaggatgggaatctcactgagaggaagagaatgataagtaggaagggaaagtatgagaggtagagaaggataagatgaagggaaactatgacaggatcagaactgatatcaggactggaagagctatgatatgaagagaaatatgagaggaagtgcaaagatgtaaggaagagaatgataacaggaagg

SEQ ID NO: 31697 - DNA, 1512 bp, Heterodera glycines
aaaagcggagggtgacgcgacgaggaggaggacgccttctctgtcgtcgcccccacaaatttgcctctaaatttatttttttttgaatgcccaaattaaatggatgggcttcgcgagggacagacatagacaggtggggtagggtgttggctgctgctggccttggggacggacggagtgtgaatgaatgaatgtttaggggatggaataaaaatgaattaatgggtcggacgagcgggggcaaaacggggggaggggaggggaaccaccttctttagcgatgatgagatgcttgcttatgctctccacttttattaggtctcgtgcaagcggaaatttttgatttttttaccatacaaaacattaaggtacagtatatatgtacttgtagattttttaatcccaatggagaggcaaaagaaatgaagcatgcttaaataataatccaatgcaaaaaaagcagctaaaaacaaaacacgtaaacaacgctgtcgtagtgtagtagtactgtaaaaagtgagtacgatatttaaaatttaaaaaaacggccggagggaatttattattatataaaaaaaaaaaatattgtttattttatttaataaaaaagggttatcacacataaaaaagaaaaaaccggcaaaaaaaaagcaaaaacagccggagggaatttttcaaagatgcaaaacatttgaaaacaataaaaagtgagacaaagaaaattagggagagggggggaggaggaagaacaaagatgggtaagagaagtcgccgaagggcgaaggaagtcgaagaatcgcccaatttgttaataaatcaatttggggcagaaaccaaacacaaacagaaaatatataaaacaaatcgtaaatcaaaaagaaaatgagaagatataattggatgtataaaaatggggggaaatggggaccatatccataaatagaagaagcccaatacatagacaaatgataattaataatggaatgtatgtaattgacaccgactaatccaattttagttccaacagttttgtgatggatgatctgattaattgttagaaaaaaaatatgaaaaagaacatttatggattaaaaaaaggtgttgaatggcacaattgagaatcattaccagaagatttttgtctggagagaattaaaaaatcaattagtttggcctaagtgttaaagggatcattaatttaattcacaatcattagcctccctaatgaagatggaataagcggtgcaatcaatgcatgccgaacgaagagcagagagatagcccataatatatcatgtgtacatatacatttgtttctgacgctgacaaatgagcttagttcattctcattggttaaaaaatggctaattaaattatttgggcggaatgccacaaacaaaaaaaacagcgaacaatacaaaaatgaaaagaaaaatgggcttttaaattttttttatgacattgctatatggggtgagtagtgagtcgatttgtgtgtgttgtccaggggaa

SEQ ID NO: 31698 - DNA, 1866 bp, Heterodera glycines
aattggaacaaacccaggggccaaccgaaaaggggacactttcgatggaaattgaaaaagggtcggaatttgcgggagagtctgtcgggagaagcagattcagtgatgccgtgtatataaatggatttccatgggaaattgaagcagaaataagaaaaaagaccgaagacactgatgagaagaaatatttggggttttacttattgtgcgatgcaaaagaaggtacaattttaataaatattaaaaatataatcattattaaaataggaggaccatggaactgcgttttttctgcaacctttcgaattgtgtcagaaaagaccgaagcggagaattccattgggacattgtgtgactgtgttattaaccagtcacgtttctgttggggattcggatttttcattacttttgctgtgagtaataatttaacatatttacttaattgatataattatggttaatcaaggaattgatgggctcgaacaagagcttttacaacaaagcagaggacaaattggcattggccattgatgtcataactgttgatgagccaaaaattgagaaattcgtttccgatcccaacaaatccaacggcacactttcaatggaaattgaaaaagtgtcggaatttgcgcgtgaaataattggaagtgaacgtaaaagtgaaactgtgcacatcaaaggattgccatggaaaatatgggcaggaattattacgaaaaatggaagcactgacaaaaatgagaaatggttgggcattttctttttgtgcgatgctccaaaagaaggtgcaaaattactaataattaatatatatattaacaacaattaattaattgatattgagcagaaaattggagttgcaaatgttcggcaaactttcgaattgtctctctaaagagcggagtgtcggattttaaattagaattaaatgacgatgtttttgacaataaagggaacaacaggggatactttaattttatttcaattgctgtgagtgacaattaaacattcccttaattgaccaattatggggtaattaagcaactgatggaccccagcaaaggcttttacgaccaaagcgaggacaaagtgacattggccattgatgtcacagtgaaagaagcaaaacggaggacgaaacataaatgcccaatatgatttggggaaaaatgcccattgaatatcatccatcctatgatgaacctgtttttttatttattaatttttcttgattatactttcaaaactggtgatatatgaattaattaattgtcggagctgttttagtagactctcattttttttggacttggatttattgcattaattttgttaggatttacgtaaacatttttttaaactttttttttttaaattgaaaccattcctaattgactgatcattttttccttttatttaagcagaattttttgggaccagaaatttgggaaccgggaagtttgggcttattaaattaaaaattgaaaaactattactaattacgctatgatttcattctttaataatccaagctgcgcttaaaaatttatatttactacaaaattaaattcaaatccaaatcaaattattaattgttcctcatcttttttgggtcatttctttgtcgtaatattaaataaatattgtggacgaatttttgggaaaattttttgtttcttaggggaatattttctgaaattttggtcaatctttaggggtatatttaaaaacaattttttggacaggttcttagggagtgtgtttttcaattttattgcatttttgctatgaaatttctggaaaaaggccaaaatacttgctaaaactcgaaaaaagccaaaatagatgctattgaccgaaaat

SEQ ID NO: 31699 - DNA, 1211 bp, Heterodera glycines
gggggggggaaggcccaccacgaggccgcgaagcggccgagtgagtaccttcggtgcaggaaaatattaaggaagagagttcattatttatttgttttttgcaaaattaattcataaatattttttagaacgtgctctgaaacacacaaaactttatttacaggttagtttaggcactcagatgctttcactatcaaaaagggagatgaataaaaatctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcacaaactgctctgaaacgcaccaaattttatttacaagttattttaggcactcagatgctttcactatcaaaaagggagaagaataaaaatctaaaaatttttaattgctttttaaatat

SEQ ID NO: 31700 - DNA, 1030 bp, Heterodera glycines
tttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggaatatttaaaaagcaattaaaaaattttaaaaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaatttaaaaatgagaattcatccgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctattaaaaatttaaaaatgagaattcatgcgggattttctggaaataagcttaatagggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggggcgatttgaaagaaaatagcaagcccccggttcgatgcagttttggtaacccaaaaagaatccaaacatttaacaatctataaaaaattaaaaa

SEQ ID NO: 31701 - DNA, 926 bp, Heterodera glycines
aaaatgcgcctttttatttgatttttacaattgtatttagttaccgaaaatgcgccttttcatttgacattttacaattgtatttagttaccgaaaatgcgcatttttaattgacttttacaattgtaatttgttatcgaaaaatacgccttttcatttgatattttacaattgtatttggttaccgaaaatgcgccttttcatttgacattttacaattgtatttagttaccgaaaatgcgccttttcatttgacattttacaattgtatttagtgacgtgaaaatgcgccttttcatttgacattttacaattgtatttagttaccgaaaatgcgcatttttaattgacttttacaattgtatttagttaccgaaaatgcgcatttttaattgacttttacaattgtaatttgttatcgaaaaatacgcctttccatttgatattttacaattgtatttagtgacgtgaaaatgcgccttttcatttgacattttacaattgtatttagttaccgaaaatgtgcatttttaattgacttttacaattgtaatttgttatcgaaaaatacgccttttcatttgatattttacaattgtatttggttaccgaaaatgcgccttttcatttgatattttacaattgtatttagttaccgaaaatgcgcctttttatttgatttttacaattgtatttagttaccgaaaatgcgcttttcatttgatattttacaattgtatttagttaccgaaaatgtgcatttttaattgacttttacaattgtaatttgttatcgaaaaatccgcatttttaattgacttttacaattgtaatttgttatcgaaaatacgcctttccatttgatattttacaattgtatttggttaccgaaaatgcgccttttcatttgacattttacaattgta

SEQ ID NO: 31702 - DNA, 984 bp, Heterodera glycines
aagacaaaaccttaaagcaataggcgattggaataaatggacaaaaaagcaaagtcaagaacttatcctacctaatttcatggtggcaacgaggcatttgactcccttaagagagccttccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactcc

SEQ ID NO: 31703 - DNA, 1446 bp, Heterodera glycines
ataaaaataaataatgatggacattttttttacaacctttttgtgcataaaaggtcaaaaaactataaataacatgaatttcgcaaataaaaatccgggtcgttttgtctaacatacaataaatccctccgtctaatttattcaattaattttgataaacgtggtcgtttatatgatataacgtccggaacatgaattcgggagggagatttatttcccgtgaaaatgaacaatcaaagtaaactcttttggtaaatttcgaagcacattctctcgcgaaaatatgaaatgtgtttctgcgtaaaagtgatcggtgctctgcgcgaggcgtattctgcgaacaaacagctgaacatgccgcagtcggaaaagttggactggctgggaatatcctgcaaaaaaatttgagggatattatttaaattccgccggagtgaatcccataattcaaccatttttatattattacaactgaccttccgacattccatcatccatccttcagaatcgaatggcctctttcgcttgtcaagggattcttgttccagataatccctagaaattgttgttttcaagaagtaaaattggcaataaacctcaaattatgcagacatttttcattggtccccatcaaagagtcgtaatagtccagccttttctgtctgaagtcaattatctaaattaccattgaagttttaccattctctaactttcaattgctttcttaccgccatgcaccaatgattgggcaaatggatgggtatgatgagcatttcgtgcgcgaaaatgtcgatctttcgagtccatcgtttgacaccggtaaaaccatttttttgtagattttggtagaagaaagtgttaaacgtgaacacctataaataaatggtaaaaaatttggaaggctcaaatggacctttgggaggttgggatcgctgttgttccgttcgaccaccaagttcaaaaagaaattgatgactaaattacgaacaattaacaatcaatataaagcaattttaaataaataaacagcaccttcgtcgttcaaccactccaaattggagagggtcagcaagtctttccgcctgatttttgcatcgaaaccacttacgaatacctcttcaagggacatcgagcggttccaaataattttgacgatttgtttgtcggcattttttaattctgaaattaaatagtcttgcccaaggaagtggtcggaatacactaaacccgggaattcctccttcgggggcactctccgctcgagtactaatccttcgagttggaggcgcacgcgtcggttctcttcctcggtgagttccctgttgtgacgtgacttttctctcagacggagctctttttccaaactctgcgcctctttttttacggttttcaatttcctcattgaatctctttccacgccataactgttgaaccgaccgtaacaag

SEQ ID NO: 31704 - DNA, 1664 bp, Heterodera glycines
ttcttcccattttatccgattgcgtccgcccattcaaattatccccattatgcttcaaatttgtccacactggtcactgtgctcatcgtttctccttccaatggcgatgaccaattcaaaagcacacaatttgtccatatttattcatatatttctcccccccccccctccgatgggcttttcttctttttgctctccgtttctcccccgttcaatctccaattattttcatccaattttccaattggtcagtttgtccgacgttttttcttctgtcaaatgaccatttgaaatgagcacttaattttcattcatttctcccctccggcggcttttttcatttctcttttttgtccccgaccccctttggttttaacacattcaaaacttgttctttttaaattaccgtccattaggcaaaagatgcagagtttttctaattggaaaaattggcccaaatttacgcaaatttaataccccacaaaattcattatcttttaaatcacttaaagagcgaagaatttaattaattctttttaaatagatcgaaaaaaacaaattttgcaacaattgcaatggcatcgcgtgcccatttattcaagcagtgtatgtggcgaagaggcgggtgatgttagcctttcagtcgcacaaccatccgccgccggaagaggcgggcaaccaagtggcggcgcgacgaaactgtttgccgcaacgcaatcagtagcagcaggtgcttaatgtttccatgctttgggaggggtcggccagccaacccgagacagtcacgggaggaagcatatgctgggtaaagccctgcgcaggacttttagggataatcccgcgggatcccgtccagcaaaatttagaaaaaaatttaaatttttgggatttttaattgttacttcaggaaaagaccatcgtcggcgtgggcgagtgcgagacgttcgcagaaaaacgccaatttaccgacttttgtaatgaggtcggtttgggactaatgtcgagagttgtggaaccaaggcaaaaaaaaagaaaaaacgaacggcacgaaatttaaattaaatttcagcactgtctgtaccgacacggcagcaacgaaatgcggacggcacattgcgcatttattctttcacttgcaaagaatggtgcacttaaaattcttaaaattttccccctgcggcgcctatcggcaccgccggccccccaaaactcctattttttttcttaaaattagcccaagatcgcaaattttggtcattttttggacagaacttgttaaaaaattgcattaaattttcaaaaaatttccccgcggcgcctatcgacaccgccggacactcttccctcacctatacccaaaaaattaaaaaaattaaaattgattttcggaaatgtataaatttctcatttctaagccggagttgcgcagaaaaatagttggcggtgagtaatgcttggttttgttgaataaaaatgcatttaaagttttggaagcgtgtttaaaaaatgtccttatttttgaccctaaaatcttatttttgaccagcgatgttcttatttcgggaaattttcaagggtaaccctgatgtagttacatagcttacccttactcatcttgtttgtaagtttttagtttttttaaaaaaccttttctctccttttcc

SEQ ID NO: 31705 - DNA, 1262 bp, Heterodera glycines
ttttatgtcttttgatatttgacgtttacaggattctttaggggtcgaagcatgcatgcagaaaaaacaccactttttgttcatttctctgtaaaataataacgattataaaaataaaaaattaaaaagaaaatacctttcaaatagacaaataaacgattcaatgattatttgagcaaacgacgacaatctacctttgaccaaataagtcgtaataatctcgtcaaagtctatttcacacctcataagccacccttgataagaagaaggagctcgaaattttccttccccttcctgatagaaatagatgaaaatacgcggttttttcttatccgtagatacaatttgtaccagtccgttaatgtatcggtaaaatttggtaaccgggcagtgaattcgtcttgaagcatgtttaaaaaaatcccacgaaagacgataatcaccatcacggatcagaaaagagaaaagatttttacgaaatcgtccgctcttaggaatgttcgaaaaagggtggttattgtccttatgaacagcaatactatacggactagcatttatcattcgttttttgaggtctttacgagttttattccaataaaatgactcataaacgtcaggtatgtgattggtgacgcaaaattaaaataccttttcgagctcctctcggaaatattcagtgaacggacccattctaaaaatctttccatacatatatccagtaaataaaaaataaaaaatgatcacacaatttattagaagtttaaaacataatcatttttttattaaaaacgtgtaaataattttttaaaaacaaatgggaacgatcgaaattcttccaaagctttctcattctcagaaatgcttttggtgcatatatcctttagcgaagggaggcctatgttgagaagtttccacgcttcttgcatttcactgaaaatattaatttattacaccttaaacccgaaacctaccggtcgacaatgctaaagaagccataaacaattaggatgaccggcgaaactagccattcacgaatactgaacaaatttacaatcgttttggaccgtagtttaacacggtacagagggcttagatagaactgaaacatattataacggtgttcaccttctcgaaaaaagaaatggtaactgatacgtcgtcaatatatacaacaccgttaagatatagattataactccctatagtgtccttaacattacaacaacacattcgcacatttctttcataaatcagaaacgaaa

SEQ ID NO: 31706 - DNA, 834 bp, Heterodera glycines
ctctagagtcctcaacccaccaacatttcaatcactgggcactcaacccaccaacattctcaatcactgggactcaacccaccaacatttcaatcactgggactcaacccaccaacatttcaatcactggtactcaacccaagagcattacaatcactggcactcaacccaccaacatttcaatcactggtactcaacccaccagcattacaatcactgggactcaacccaccaacatttcaatcactgggactcaacccaccaacatttcaatcactgggactcaacccaccaacatttcaatcactggcactcaacccaccaacatttcaatcactgggactcaacccaccagcattacaatcactgggactcaacccaacagcattccaatcactgggactcaacccaccaacatttcaatcactgggactcaacccaccaacatttcaatcactgggactcaacccaccaacatttcaatcactgggactcaacccaccagcattacaatcactgggactcaacccaccaacatttcaatcactgggactcaacccaccagcatttcaatcactggaactcaaccccaccagcattccaatcactggggactcaacccaccagcatttcaatcactggggactcaacccaccaacatttcaatcactggcactcaacccaccagaattcaatcactgggactcaaaccaccaacatttcaatcactggaactcaacccaaaatattttcaatcactgggactccacccaccagaattcaatcagtgcgactcaaccccacagcatttaaatcactgggactcaaaccacc

SEQ ID NO: 31707 - DNA, 1260 bp, Heterodera glycines
ttccccccaataaccttttcatacccccatttttcgcaccgtgaatgttattttttattgaattctgaaccggtttggagtagattagactagaaaaaattgaaaattttgaaatcatgtttcccactcccctctcccaggggtattattttgtagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttttcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtatattagactaaaaaaatatgagtgatcaaactttcactaaaaagttaagcctaaactttttcccaaagttaaaaagaaattaatattttattcacctccattattgatagaaaaagcatcagagtgcctaaactaacatgtaaataaaatttggtgcgtttcacatccctttctgaaaaaatatttatgaattaattttgcaaattaaataaaaacgaaagac

SEQ ID NO: 31708 - DNA, 1412 bp, Heterodera glycines
  misc_feature (35)..(35): n is a, c, g, or t
tctcgccccataaattaataattgaacctaaattntggagttaaatgcacatatgaaaaagttttattttccacctcaattggcatgtgagcaattttcctctttcgaatgccattctaaaaagtattaaaaaaaataaaacatttgggtagaaatccagaaaaaaaatttgaaaggcttttttctcttctaaattggattttccttgctgcatatatattaaagaataatggagaagtgagagtggcactggcggtgccgggggggggggacacgtaatgttttgtcagatttatgaactacagattttgacaaatattgtccgtttttatggacatttggaacccgcggtgccgaaatttttaatgagagattgttaagaaaaatagaaaaatttcatccttccctgctaacaattttgacatgaaccaacggaaaaaagactaaaacctagagcactagacatttaaagcctactaaaaagtaaaaaataattatattaatttcaaaaaagaaattaaatttttaaatttagagaaaccaaaattaggaattaaaaaagtctcgtcttcgcgataacccgagacctggacgaaaaaactaagaattttctcgcgttgggaccgttactcatgatcaccaggggaaattcccggttttttcccgggtttcccagccaaaaagtcccggttttgcccaaaattcccggtcccgtactaccctactataaatctgaacgaaatgctgatgttttttggcattttgcccaaatttctttataaataaaataaatgccaaactatgtctcttttattaaccaattttaagcagctaaaattggaattaggtcattttcccatttttaggtctaattaggtcattttcccatttttaggtctaattttggtcgtttttagaccaataaaataagttttaaaaaaaaaattcattttaaggcacaaaaaagtgcttacatcagagaatggcacgacaaatatttggcggacatggaaaaggtgttgggacagaagcgagctcagccgcgaaatctattgacagagcaaaagtataaaagtctaatggaaaaagtgaaggtaaagaaagaaaagggaaaagcaaaaaaaggaaataaataaaaatataaataatttagagacaaaaaattaataaagcataaaaacaaaatgaaaatttaaaaggcaaaaaatagaattgaaaaagggacaaaaaataaataattagaataatcaaaaggaaataaataaaggaatttaaatattaatcaaaaaataataaaaacaataaaattaattaaaattttagttggccgaaagcattcgaagaatgaatggccaagtgccgaagaagcatttaaatggaataatgaaaaagtacagaatttggaaaaataa

SEQ ID NO: 31709 - DNA, 1705 bp, Heterodera glycines
aaaaaattgaaatttttgaaattcatgtttcccccactccctttctccccaggggtatttttttgtaaattcttttttccccccattaaacttgtcaacccccattttttcgcccgtgaatgttatttttattgaattctgagcccgttttgagtagattagactagaaaaattgaaaattttgaaatcatgtttcccactcccttctcccaggggtattattttgtaaagtctttttttcccccaataaactggtcaaaccccatttttcgcaccgtgaatgttatttttattgaattctgacccgttttgagtagattagactagaaaaaattgaaaaatttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattaaactaaaaaaaattgaaaattttgaaatcatgtttcccactcccttctcccaggggtattattttgtaaagtctttttttcccaaaaaaattttcaaaccccatttttcgcaccgtgaatggtattttttatatgaattctgaaccggttttgagaaattaaaataaaaaaaaattgaaaatttttgaaaacctgtttcccactcccttctccccggggtaatatttttggaaaagtttttttttttccaaaaaaaattttcaaaaccccatttttttccaccccgggggaaagtgtttttttttttgaattttctaaacccggttttggagaaaaaaaaaaaataaaaaaaaaattaaaaaatttttaaaaattttttttccccccccccctttccccagggggtatttttttttaaaaaggtttttttttccccaaaaaaaatttttaaaacccccttttttccccccccggaaaaggttttttttttttaaaatttcttaaacgcttttttggaaaaaaaaaaaaaaaaaaaaaaaaaataaaaaaattttattaaaaaactttttctcccccccccccccct

SEQ ID NO: 31710 - DNA, 1155 bp, Heterodera glycines
tagagtccgacctggacctggatccaggcctggatttttcctggatccaggtccaggtcattttttgacaacctggatttttcctggacctggattttcctggatttttgtccaggaaatccaggtccaggtcaatttggaaatccaggtccaggtccaggcttgaaaaacctggatttcctggataaattttttttccatcttttatggcgaaatgttttaaaatgttgtgtaaattcaaaaaatttaatttttttttaaattttacacatgttaatgaaaattctttttgttttttaggcattaatgaattctttaatttggaatatagggttgttcgaaaaaaataaaaatggcaaagttgggatttggaatgttggaggaaattatcaaatcagttcccaaaactttctaaactggccaacaaatttctttcaactcccgccacaagttgtcgctcccacaaatcaattacaaatattaatttatgttattgaatgatcatttgaacgattaatccaggtccaggtccaacatggagtccaggtccaggcatttttcaaaatgtcgatctctactattctcaatcccagattcgaattcgaacaaaagttgcaattaaaatttgcgataagcattgtgactttttcatttgggtaatagtttggtttgccccccccctttttcaaaaaaataaaaatttaaaaaaaccgtgtaagacaattttttatggggttttcgaggtcgctgataactaatctgatacccattcgaccaatttcgaacctcggacccgaattcgagcaaaaaccgaaaactaatttttcaccaaaattcacttaaaaagttgtcttacacgattttttgaaaattattattttttttttgaaaaaggaggggggagaacaaaccggtacttgtttggtttacgggatacttttaccatacatttttaaatgcatgtaaatgtgttttagaaattaatgtaccttcatttcttcagggggtgcatattcgatattcagttattgcaaattgttactcaaaatggcctcttttctccgttttttggcctgccgtcacttttctatgtcgtccgttttgcgcaaagaggcggaacaacttaccaatgaacacatcgacaaaattcggcag

SEQ ID NO: 31711 - DNA, 1670 bp, Heterodera glycines
accaagtattatgttgtccacataaatgtctctctctatttctcttacttttttgtccttgtatttggacaaatgaagtttgattgtcaaagagagatgagctggcgaacaaatgactccaaacgtgactctcgtaaaccgatactccacgaggggagaatcttctacatatgggtctctgacccacaaaaatcgcatcgcatctctgtcttttggatgtaccaaaatttgatgaaatgccttagcgatgtcacaagtcaacagcattggcttaattcgaattcgaattaatatacctgccaaatcgttatagtcattttctcccttttctaacacttggctgagggtgagacctcctctgcatctagcggacgcattatacacaattcgaaccttagtatgttcactcgtttcctttaccactgggtgatgtggtaaataatgaactttatttccaaccaaatacctttcttcaataggtaatggctcacattcttcaataaacccggtttcgacttgttccattttgatttcatggatttgtcgaagcaaatccggtgtttttctaagtctgcccaaatttgacattaactgtctaaaagccatatcataatttgttggcaattgagcagccaattcttcatcccataacaattccgtttgatacctatccccattgaatgatattttatcaatcattctttgtctcacgttttgcttatctgaattgagatcagacataccgacatgttctagaccattccagtccataatcattttattgaaatcattctgactcagttggtcgctattcagttcccattctactgaaccttcgttactgtagtctgatacttgaccaataatccatgaatatcattaccacacttttggtttacagtatggtgaatgactgatgatgatatgtcggattgagatccgtttaatgacttaaagaattgaacctttccttgtccactcaaaaattgaccaatatttgagtcattgatatacagtcccgattgtaattcctctaagacactaatgttcaaacgattataataatcgtttccaataattaaatcaggctcaccatatacctctggtaccttcaattttgttttccgtaattgctcctgagagagctgattgagttcaatcaccggaattttcttcaaaattttatcaagggctcgacatttcatcaaaatgtcaaagttgccctttttaaggccaaactcataaattggagattcgaatttacccaattcgacattcgataaacctgagagttcaaacctttgattaccaattggcttcaaacccaaaatttgagccaatttggtcgaaatgtatgtcttttgacttccatcgtccataaaaaccaaaatcctttccctttgccttggattttctggattataaatggtaacatatttacatttcagcaaagataatttcgttgttttacttgtaacatacgaagtgaccgacgttatttccttttcaacttcttcagactctgagaagtcttgagccgtatttatcttcgaccgaactggtgaattttctgaactactattcctcctatctttgggtttatctttggatctacacaatgagatgtgatgacccgcccgattgcaaatgttgcacttatatccttttaa

SEQ ID NO: 31712 - DNA, 910 bp, Heterodera glycines
ctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgtttatcaattgggcactaatagagcatttttattgtattatccctctattcagtgatttatcaattaaggcactaatagagcatttttattgtattatccctctattcagtgatttatcaattaaggcactaatagagtatttttattgtattatccctctattcagtgatttatcaattaaggcactaatagagcatttttattgtattatccctctattcagtgatttatcaattaaggcactaatagagtatttttattgtattatccctctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgatttatcaattaaggcactaatagagcatttttattgtattatccctctattcagtgatttatcaattgggcactaatagagaatttttattgtattatccctc

SEQ ID NO: 31713 - DNA, 1737 bp, Heterodera glycines
ctaattgcaaatcaatagcttagaaaaagcttctaaaaatcttaagctttcgaatgaaatcaataatgttaaataacatagttagagattgaaataactagggagtgtaattatatggatataaaatcgcgaaatatggccataaaatatggaccaaaaatcgcaaaatatggacataaaatggcaaaaatcgcgaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgcgcaatcattttaaaagaaaaaaaacataaaagctaaaattttcaacaacaaaagcgaaattttcgcttttttgcttatttttgacataatttactaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaaggagcagctgataattggattcgagggcgaattgaggcgcttaatttggcacagactgacgcgctttttccaattgaattgtggaatgtagtggacagagtagcagaagggcttggaagaacaaacaattcgcttgaagtgtggtgggatgtggccattttttcatgtcctttattcagggttggcattcaatttggaatgtgcaccttagggggaaccaacggccgagttcatttgctcggaaaatgatcgaggaagatgaaatgtggagaattcgtgttgcagattatcagattgcaccggctgacggcattttttaaacatgaataagattagcttaatacattcgtcaagaccaaaacttggaagcacttgtgcaggattttttcaatcgtgatccgatccaatttcttcgcgcttgcgcttatcatctgcacttttaaacatttataggattttagcattgtcgttttacacaattttgtcgttattttcgatatcaatttgaagttttcaaatgttagaattggcaaagttaaaattttgttcattgtcgaaatcggtcactgtcgtaatcagccactgtcggaaatgtcggaaaacagtaaaataaatgaaaatagttcactgtcgaaatcggtcactgtcgaaatccactgtcgaaatcggtcactgtcgaaatcagccactgtcgaaatgttacagcacccatgacaaacatagacaaaatcaacgctcgcatcgatacaattcaaatgctacaacttcatgtaactacacgcagccggaccaccaatacgcagcttgcgccacatttcctttttgatttcgatttttgattttttattagattttttaattgaattaatgaatcaaataaacaattttactgcttcgaaactctatgagaaactagcgttagcggatgctgaatttgatgcttggctcactgaattaggtttgttgcatgccagacgcacatgtcctcaatgccatggcggaatgggacgttgtgaaccgaaccgtaacgagcgttacggagtctggagatgcaaaaatgcgcagtgccgtcgcacgaaaaatcggatttcttgtcg

SEQ ID NO: 31714 - DNA, 1207 bp, Heterodera glycines
ttatgatctctgaggaaatgcattactgacgaaatcccaagtacgataataataattatttgttacatttctttatttaattcatttgctaaaattttgttgtgttgggatcaaagggatggcatctgcaaaatttgttttaacaaatttcccagtaattaggttggcgtctctagtgaaaatggtaattgccagccacagaaaactaacgacaccttaagccaatggcaaacctaataaagtctccattttcatcagatataaatctttttcatgaaaataaatgtttaataataatgaaaatattttttacattaagaaaaattttaatgagaataaatatttattgtgaaagcaattataggaaaaaaataaatattttttttacaccgaaaaaacatttaaaacccgaaaaaactcctccttttttatataaattcctggcgcagcgtttttatgtacacaaaaaaacgtactttttttataaaacaagtttaacaaaatttaatttctttacagaataaacgccctttaaaatggattttcaaaactactccatggtcaatttggtgaggaaatttgagcataatttccggatttaaataatttaatttttcaaatttaatattatataaaattataaatttaaggcatttaatcgtttcggtgttggcacctttttaatggaattgtttttgtcaaattcgtgccgttggctcattacgcttcctggcttaatgtttaattctgcacttttgtacacaaccatacgcgaaaagttaaatttaaattatcccgagcccgatacccgggcccggttttttgaaaatcaaatacccggtacccgacccggtaagtccgggtacccgggtaccaaaaatacactggtaagaatgggggtcagggtcaaattgttaagcaaatttggaagaaaaaaaaaatttaaaaaacgaaattaatataattctttctcatagcaatctcttttaaacattttttaaattgttgaaaactgttattttatcataagtcaaaaaacgctcaaaatttttttaataaaaataattttaattttttaacacttaagttttaaaaaatcatgttttttacaatatcccataagaaattttgatgaatttaaccttatattcccttaaaaattaaacattttggtataaattctgtaagtaaattgactcaaaatcac

SEQ ID NO: 31715 - DNA, 1293 bp, Heterodera glycines
  misc_feature (1224)..(1224): n is a, c, g, or t
gataactaaatttgctagaaaaatcataaaatctacaaaaatgtgttggctgatgatttcttctcctctgaaccgcccaaattggcatcggcaagcgaatgggccctcaaagtttcaatgagaggagctgaaaaatgaatttaaaaaaggaattaaaaatattgaaaaagagagaaagaaaaaaaagaaagtatatttataaatgcacttgtaaaaagcaaatcgccaagtgctgccattagtccattccttacagattttggatggtccttaaaaaaacggattttataaaaaaaaaactattttttaaataatttcaccttgggattttcccaatccgtatatttgttgagaatggcttgaaaaatttcggtgcgatgaaagtcgaaaatatttcgcaccaaagttcttgaaagaatagcccgtcataatacatatatacaatatatcacttatccatggtaaaaattttaagtgccagtcaaatatactgtgtactgacagtatgcccaaaaccatttcgttcattcacctcaatattttgtccctcttctccacactgatgccattctccaggtcatccttcgccaacagatggtgtgccggattaagcacagtgccgaccataaggtcaatttcacggaacaatgtgccgtattgggggttgaacagcacacgcggatgatttggcacaatctgtttttaattttataattaattaaataaaattagaaattttaaatattggcccacctgtccgtcaacaattggtgcaaatgcgctcaaaaatgttggcgatgctgaagcaacatggcgcgcagctgtgctcacattctgttcactgtgctccttaatatatatatatattatttaaaaataaaaaatgtttttaaataattaaaatttgtgcctgaatacaacgaagaacttgtaaagattcgtccaaaaaactgctggaagatgaacgatggatgtggaaacacttaacaaaacaataacattgggacaattttacattaattgatttaattaatttaatttaaaattatttatgtctcccaatttgtacaccttcaactcctcggccagcctcatgaactgagtctgcgcagtgtgtgccatggcccatggcgacatggcacttccgtccagcaaaattgcacgatgaaaaagccgattctttggctgggtaatgggcgagcccatcaaaagcctcaaatttanaaataataataataaataaaaaatgtttttaaatgtttacgtgacgagtgcagcgccggattccagcct

SEQ ID NO: 31716 - DNA, 1346 bp, Heterodera glycines
atatttagcctaccccccttggtgtttgcacattttcatatttgcatgccatgagatcttttagatgttgtaacgaagatttcgtggagggtgtgccggctgcggagaaggaacgaaagaagccatgcgacccgccattttgtggatgcttgacggtcaattaaaatttcttgacagtaaactatttatcaaatctaatttaatactaaattaacaaaacgcagccggttgggacttattgtgcttgaacgttggtaatacaatgtgcactgtaatgcttcttgccggtgacgagccttataaaagatatttgggggtgagttgaaaagcaaagccaaaaacacacaatatgattttgtttttaattttagcacatagcccgatgcaaaggtttagtaatttaaaaaaggggaattttaaaattttcacacaaaaattcttgaaattctaggcgtggacaacttattggaagggtaagtgcattaaaataaaattattcattaatgcacaaatgttgagcattttttcattcaaaaatttgaattaagttggaccgatgtgtgtaacgggacaaaagcttctaagttttacgatgtttgttaaacatatttaattaaattttgagaaattaatttaaataaaaattgaactattttttggggaataaaatattttggaaaattgactagggacaattgccgaaatgttcaactattactagtgctgttctcgagaccaaaaatttcccgagactcgagaccgagagtcgtcgaccagagaccgagagtcgacctagagacctcgagaccgagaccaaaaaaaacccgagaccctagacttttttcaaaaaattttcttattcgcttaaaaatcgttaaaaattttttgcgcatatcttaacaaatttttttttattttaattcaattaggtaccataatcaatcaaaaaacgcaattttttcgcggtttttagtcaattttaaaaacaaagggaattttggagctgcggtataatgttgaaaattagaagaaaaaagtaactactcgaaggggaaatgatacaacgcaaaagtaaaagacttaaaccaagagcataacccactagaccacgtattcaaataagtaaatgtagcaaaaagtttccaaaaatacattaattttaaatttacaaaaagcccgtgctgagtcgatccaaaaaaaaactcagtgattgacaaaacggtctcgagtctcgaaaatcgagaccgggactttaaaaccagagatcgagactcgagaccgagaccaaaaaaaccccgagacttttctcgagtcgagactagagaccgagactctcgatcagcact

SEQ ID NO: 31717 - DNA, 1466 bp, Heterodera glycines
  misc_feature (77)..(77): n is a, c, g, or t
  misc_feature (97)..(97): n is a, c, g, or t
atttggtgcgtttcagagcagtttctgaaaaaatatttatgaattgattttgctaaaaaaataaaatagtgaagctntaaaaattaataaaaaattntaaattcagaattactggagttagcatcatagcagtgcttttccttgtctttttgatgccctcgcaaaatctggttcgcttctgatcagtttataaaaaaaaagttaagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcgtctgccttttgatagaaaaagcaggagagatcctctatttaacttcataagtaacatttggtgcgtttcggagctgaatctgaaaaaatacttatgaattaatttcgcaaaaaatgggtgagtaatgcaaaagtctagaatttcgatatattttaaaaacttcaagcgtaagcggtctctcacgttaagtgagtccttttcaatggagagggccggcttttttgtgtgcgcttgtgtcggtttttgtgctcttggttcgttgtcgctttttggcggcgggtcctgggcttttccggcccgtgtcggctggtgtcggcgctctttggcctttcttttcgtcttcctttgtgctggcgttgcgtccgtggttttcgtttgcagtttgttcttcgtccggcctttttctctccggtcggtctgttggttctctccttcgcctctcgttttccttaaaggtttctttttctccttgctcgtttgtgggcagtccctgaaatgtttttagatctaagcaaaaattaaaaacaataataa

SEQ ID NO: 31718 - DNA, 1091 bp, Heterodera glycines
aagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaaaacaaataaataatgaa

SEQ ID NO: 31719 - DNA, 1214 bp, Heterodera glycines
ttggttgttcgcgtcacaaatgtcgcattggggctctcgcataaacacatgctccaccaatttacagtagaagtcttggccgtattggccgcaagtggcggtggcgcggatttcggcatgagtggccaagttgaaaatggacgggaacagtcccttctctgatagaaccaaaacagcataatcttatcaaagggggagggcgcctgccgaagattctcctcactcccccctccccccccccccccacaaatcgcaccgatcattcagacaaacccttttcacaactcaccgcctttgccgacagaaaactcgcgaaaaggataagccaattgagaggcggaagagcgaactgattggtcatttttgtccggcgtcaattcgttgttggaggaatcaattcgaatgatttcttcggcaaatgaaaaatgccaaattaagagaaaaaggggcagcacggaaagggagaaacatcgccttggggtccctgcgggggacatccgacgaacgaactgaagaacaataacaatggaaatgatctcaaaatggcatatttattacaggatacaatttagtgccatggcaatccaacaaatgcccttggggttggactgtcggatacctccgttcccaaatccaacaaaatcccgaaattcatcgtggaggggtcggccccggttaacctaatgacctcttttgagaatggtacaccctttgtttgacaacggacagagcgatgcatctgtgaagagtttgtttgttttggcgaaagaaggaaattcattcatcggaccaaagagaaaaagacaccccgggggaggggagagaatgtggccaaatgatcaaagggggggggggagaatgaaggatgttgatttgcattttgtaaatgatggcatttaagaagagggaggacgggggacaaatcgtaatgttgcaaatgaaaggggaatattatatttaaagggggggggcaaaggacagcaaaaagtgacgggggaaggaaaagccaaaagggaaaccaaacaaacaaactgagagagagcgaaaggggagggagagaaggaaatttgataaattaaaaacaattaatgggggaaaccacaattataattataaggcaccgacgcaacccaaagaacgcaacgcaataattataataataataataatctgttgggttggaaactgtcggaggaaatgacggcaacggacga

SEQ ID NO: 31720 - DNA, 1536 bp, Heterodera glycines
tgtacatttcatcatttcgggaatgccaaatgagccaaagaaagaaaccgttcctaaaaaatggacacaatgataatgagagagatttgttaaataaagggcaggaggcaatgctcgacaatgtcggccttttggctgttggatgactcacgcgctcggtaaatgtccgcgttccaatgggacacaatcgcatcgaacagtttgggccgcatataaagcgcggcgagcagcacagactcgtaacactcgggctccaattgggggtcctttgtcggaatgatcggcacgagtttcagaatttggtggtgccgttcgaattcgttgacgtaaaactcccactccaccttatgtgttgaacaaacctaaaaaatatatattacgattgggtgttaaaatatttatgagtgattgtcaaaaaacctgtggcaaaaaattgacagccaaatcgtaggccttttgctccatcaaatggttgaccagccgtttgccaacctccagcactgaattttcgcgtagcatttcgctgtttctgaccgctcgttcccacgcctcctcaaagagtccattgtccattagccaggcaatgcgttcgtcgatggagcagggaattgcctgggaaagaattgttttaaaatttggaaaaacgaagtctgatgggccacctcaatcacttcacgggaacccatcagaaagaaaatattgtcgggagaaagcgaacacaaagcaaagcggggcaaaacgcacaggtcgacggtgcgcatttcgatggtatcctccgaaatgagcacaaagtcctgcacagagagcggccgcaacagcaaaagttgggcagagaacggcttcgatcgaacctaaaactatttttacatttttcatgtaatttttatacattttcatgtaatttttaaagacttttaaaaagggaatattaggtggcaataaactttcatcgtttagaatattaatgattacactagggacaaagttttgtcctttttttaaattttggtcctcatccttgaaaatgatatgaaccctccccttttctcgcctggttcgatgggtccgtttctgctgacgattgctcttggttggcccttatgccaaatacgaccaattcgtatttattttcaattatttggtgcatatttttaacggaatttggaggcgaattcgaaggcaaaatttgagtggtttgttggtcgtataaatcgtcgacacttggcaaagtgaaggaaaggccggcaatggaaaagccaggaattgtgaatttgtgcaaaatttggccatgtttaacgggcaaatcaatgggagggcccgcggcactgttctgagattaagcaaaaggccaaaagattaattgtgtaaagaaaacaacacacaccgagtgtcttctgagcccgttctgaacagcgcaaacgcaaagcgaatttgcccagccaatcgcaatggtcgactcgtccaacctttttcgagaattcaaccaatttagcaataacttattacaaaagcagcagtaagagcattcctttggat

SEQ ID NO: 31721 - DNA, 1475 bp, Heterodera glycines
  misc_feature (1467)..(1467): n is a, c, g, or t
ttgtttgctgttttaactcatctttcctcaattggaaatattgtgttagcaacaacagcagcaccactttcatttgccatttcacttcatttcatccaaaataaccaattcaaagtatctaaattaattaattagtcgtttaattgccttttcaattctttggcatggtccgcgatcggctgaacgaacttcaaaaggtcaatcggaggagggattgttaattaagtgaattaagcgaaagtgaacgaatatgtcaaggggagggaaaataagccaaatttagcctaatatttgtaccttttcgtttgaccaaatgaatgcttttcccttttgccaaggcttttcccaatggacgcccttcgccctctccaatccccgtccatttgctaaacgttcaatcgctccaatcctctggcgatccttcgctcgatcgcatcacacaaatgcgacaatccgtggaggaaatcgaacggcgcattcggacgatggtggaagtgcaggaaacaattctgggacaaacgatggtcagatcggaggaaaaggtcaaaaaggggaggaaaagcaaagggacaccaaaaagggggcaaaaaaatattaaaaataaatgctataaatattagccgaaaaacaattatggggggggggggggtgtaaagagtgaaaaagtcgagagttaagactttaaccgaatgactttttcaagtcgagattctagaccgtaatgctaggaaaaggattctggaattaatgctttcaaaaagcaattccgacttcacaaattgagcagaatcagttggacacactaatcgatgagattcgccagcggagtgcgaaactccgcccgaaattgcgtcatttgtgccgcgacttggaaacgcaagggacggcgcacgacgcgtttaggcgaatgcggaaaattcacaggtggaatggcggaaggaactgatcagtgtgggattgatttgatcagaaagaaaagtcaattgtagtgagcaactgatcagaagactcaacgaagtcttggaaatgttcgcgtcggcgcaggaggactaccgacagcgcgtgaacagtgagttggccacggcactcactcattggcattatgccctaaactcggtccccccccctcctctccccttcataatttgtcttttgaagggcgcgtccgacgtcagttggaattggccggggaacgcatcagcgcggacgaagtgactcatttgttggccgacaattccgaggacattttcttccgtcgaatttctcccatttctttcgctgctcagtccgcgttggtccgtccctttctctcttttgctaatttgttttttcgttctgtttccattaggaggatgcctcctctcgccacgttgaactgctccaactcgagaggaccatcggcgaactgaacgactgtttccaggacatgctccaattggtccactcgcaggtccatttggggggggngggggggg

SEQ ID NO: 31722 - DNA, 1340 bp, Heterodera glycines
  misc_feature (95)..(95): n is a, c, g, or t
tgaggcgccgtgtgccattcattgatttgcttttaacctactcatataagtaagaagatcgtttgcgcctctaaacgaggcgctttcccgagatntagttcgagcgatttacggcgggggaaattgcgaaaaagctgtgacgatggaacatttttatccggaagttgtttttgatgaaaattggaaagctaattgagtgaaatgtttaagatatttatttatttgttcagtgcagcgcaacagaaaacttaaatgttatgataattgctaaattaagtggtgtgaatatgtataagcaattgtttcaaatgttcttgggaagttttttttactaagagaatcattgtttcaaaatcggtgaagagaaagaaggccacggaatttaaacaaaaagacattttcctaaatgacagcccaatggtcaaaatttgtaacttggtttttgaaattttgccaaaagaggaaaatggcatagggaaattggaaaaaatgggggttggggatttggttgggaccaatgggatgacggattagtattattattttttaaatagctggaaagcccatcagtgatcaaaaaagcggagaatggccagggatggggaaggggcagtcccccaaaaagccattggctaatgccatcgccctttggccaaggcattgttggcaaggagagagcgaaatgaactgcaaaataaaacatttttgcgcttttaaacataaaaatcaaaaaatcaaatttaagcaaaaattaatcaattttcactgaatgcggagcgatccgccggaaatctgcttaccgtattttctctttttatcaccccgggaggattatttttcagactcctcagaaaggggggggggggggataatttgagacggcgggataatggagacggggtgataaaaagagaaaatacggtaattaattaagaaagactaattctgtgttgctgacacatttgcccgtccaacaccgatatatacatattattagattttaactttttgcatgaactaaatgatcattaaacacatggccaagagaaaatggaaggggggggggggataataaatattagtagggctgaaaattttagtacgaaaaatcgcgaaatggtatttaaatataaaaaaaaacccaaaatatttattaaataggtaaataaaaatttttattaacgattttttagtggaaaagagcaaaccaaaaggtaaaaattgaatctatttttgtataaacgaatattttaaatatttctataagttgattctttgagaatgtattttcagacggtcccccgcgtcgctcttcccgactccaccccacccccctcccc

SEQ ID NO: 31723 - DNA, 1477 bp, Heterodera glycines
catcaaaggcaccatatttttgaaattaaatggcttttttacagctttatataaaaattgccaatttttatggatttttgatctttaatacattgggcaaaaattgtgctaaaattattgtctgccttagccagaattaattttcgaaaaatatttgaaaaacgacagggcttggtttgaataaatcataagttgaatggatcaaaaaatttcccatattatgctacctcctcatggatcagtctgtaaacaaagttattttaatttcatttttaattgataaaaaacaaagtgatcagtgcaatattttataattttttctttaacatctttttaactttatagaaagatttattctaattttgcactttataaaaccaaatatttcagtttatttttgtttttttattgtttgaaaatttcttttttgataaaattttgaaaattgaaaattttgtcgaattgtttggcctttgtcgcacaattggttattcgcaaaaactggttccttgagtatttttgttcataacttttgggcagttttttgttaaaaattttcatttaattattttttatattgtataacgccctttttgattggtttttatataacgacatcaccttttaaacaacccctgacatattatttattttcgttaaaaattcaagaaaacaaatttagtattttaaagacgttaagcctgaggacacacacacccgtcgacctcaatccacgtcatattggttgggatgtaaagcattgttgaagcagatcaggacaaaaactcaaattaaacagaattacagaaatttaaaaaaaaggaaaaaagctacaaaatttggcgcaaaacttggtgatagaatgatttgagatgacatgcccatagccttaaggccttttgctccattctaccgcccattcatttacattggacatctgcagcacaatcggtccttgtccacagctttgtccattcgattgtcctccgatcaaattgccatccttttcttgctttgtccacaattttttggccgttgtccacctcacccccccccgtccccaattcccccttacaaccctttcacatataagttgctgttttctgttttgcatttttccagtgaataagagacagtgcagaaaacggagattagtaagaccaacacattattcgagacacagcgcgagaagagaaagagagaaggagagagattgcttgcatttactccactccttcatctcttcccactcccccacccatcaagtacacagcaaagaaagggggatgggtttaacgcaagggaaaggcaaaatgaaatgaagtgaagagataagtcctaacaaaaaaatagcaaaaaaaaaaattttttaccgcacaaaccccgaccccggacaaacaccggcaaggtgtgaaaacacatgttttcacaccggacaaacaccggacaccgaccggtctttaactactaagcatca

SEQ ID NO: 31724 - DNA, 1508 bp, Heterodera glycines
cctccttcactccggcacggaattccaaaccgtcaatgttctgacgaatggcaaaacaaagtgagaaatgaacaaaatttattcattaaataaaaaaaaattaaaatccttaaaccaaaaaaatggaaaaaaggttttttttagaaaattagaatgaagaaaaagtttggatctgctaccttaattcaggtttatttattttttattttgaataaagagattaatgctatggtatatgaatccaaagcactaaagcttatgttacttatggtcgtgttcattttaaaggtcacctgagtgaagcatcgccgaagcagccctttgtccgccaccaaacgaatgaaatgatgcgcggaagtcggcttaatgggataaagtcaaattcacaacaaaagccgagaatgggaagaacgcaagaaccattatgctttcgtggaaaagtgcgttggccagcacaaaaaagggctcgggattccttctgaagtaatttatgtcgaagatcgcctgcggatttgggatgtcgtactgcttcaagttgtcgtagagaccggtgccttgacaagaattgcttggattggacgccgatgcctcgaaagcgaaccgggcgtccgaaagtccgggatgccggctgacgtggacactccggcaccgaccatgaacacaatctcgggtcgttcttcgcggatgaacgccgcaacgccctccaagtccaaagatggcaatttttgctgtggacgcgtcgccacgtcatctgcgaagtgattcctacgccagcagttataattagtcagttttctaatagacaatttgatactgaaacgcacctgagaccaaactgttgatgacgctctcgaagctggtcacaaattggctgtacaagctcggctgtgaagcgctgcccgcctcacttggcactccctcaacatttggcacctccgcttcattttgcactttctcttccgatccttttggcacttcctctttgtttggcattcctttttcattggatccttccgcttcgcttttgtcattacaaatgctctcttctttagacgtcgactcactcaccgaagaacaatgtccttcggtttttccatcattttcttttgtattctccataattatttagtctttttcttttaatatttttcttaatttatttgttaattattacaatttaataaaagctaatatgtagcaaaaaatatgtactggttaaacaaattaacaatttattttcaaattgggacaataaatatttttatgtaaaagaacaaaagaaaaacaacaagcacggaggaaagatgggagtcagcgattcattcattattcactttcagaaagaaatatcaaaaaggcggtgagagagaccattgtgggcggtcgaaggaatcatcgaacagtccctcttgaaccaattaaataacaaattgccattaaatacctgaagaggcgacggggggagggcacatttaagtaaagtgggaagcttattaaggggaaccgaa

SEQ ID NO: 31725 - DNA, 1317 bp, Heterodera glycines
ttttttctaaaacccaaatcaaaaaatgcctgcttgagggggctaagtgaaagtgttttctaaaaaacaaaaaaaattccaagcctctatctgcaataggaaaggctgtaggttcgtggactttttcagtaccactttgtcccagttcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacggagaccacttccaaaacatagtttttcgagctctatcgactggtatttttttcggaaaaatttcgattttttcccggaaatagaaaaaatttttggcctgagcgggacatttgagtcccgggcccataactcgtcaggggttggttttatcaaaaaaacgccttagggcaaaattgtagagctttttaagctctatcgaatggtgtgccatatggccggaaattttcaaaatttttcgagctaggccccctagaaattttcggaaattttttttcggacgaaaatgggggtgaaaaatatttttctggggtaaaataaggtgctgagtacgaatatgatgtatattttaagtctcataatttcggcaattttttaaaaattctttatttctgttgctgctgcctctgttaccgggcaattgccaattcgcttacttcgcttcgatttcattcccccccaacccttctcttccctgctgattcccttccttatccccccccccattcgcccaattcgtcgtccttcacttttctgcaaaatgaatgtgccattatttgaaaggggggacgggtgggcatggcatggacaggtgctactgaattggcataagtaatgcactgagtgccatttttggatgccaatgccaacattttctgcttgctctccggccttaattgagtaataaaacgaaccctcaagcaattcccaccgctctttgacttggcatagaattaatttcgttggcatatcgcaacaattggacatgccaatgctttcggtatatttttcatttacatatttgaacattctaagaaaggcttgccaaatcactgctctttgctccctttccaaaagggggaatccatcgcaatttgttttttggctattttggccaaactgttgagcctttccctccattcctcttcctcccttacccccccccccctccctctccttctctcgtactccctttc

SEQ ID NO: 31726 - DNA, 1193 bp, Heterodera glycines
ataaaattccaagaaattccgaaccgcataaaaaagaactcaatgttgaaaaactcctcaacagaaagcaggacgagacaaaagaaagtcgaatttttgtactggagactgtcaaaacattgggtttattgtataattttcttagggttttgccccatgggtcgtcgtccgatttgaacctgttgaacacaatggagcgtgttctttaacgtcgaattcggctgatctctccagtccaacccacacagcgtttggtacacaatgtggtcggcctgttgaagctgtttcaaagtgcctaataaaggcaaaccaaagcgaatggaaaggcaacatcacagaatacggtaccttcgttgatgtgtgttactgtaatgtcattgatcggtgtaatattatagccgagattgaacccaaaaacgaccctaaaatgatggggacgaaaatgagttaaagccagaaaacaaaaatatcaaaatgcaagagataatttttaattctgtcgaaccgattgatgaagtgacactcgttgggcagcagtcgtgccaactcttccagtttcagccatgggatgtcctccaacgacgggtctttggtaaacaccgctgccacgtatgaataggaacgccggtcgccctgcacaccaacggatttgatgggtaaaacaatggcacaaagtttgtcgtcgaatgcctcgacatattccttgacgcgctgttgcgtttcgtcgaaatgttcttcctggaaagaaaattcaattgaaattgaaaacttctttcgactttgaagggttcgtcggcgcaaatgatgcgaatggccaacccgggcccggggaacggatgtctgttgacgatgtgctcgggcagtcccaacgatcggcccaactcgcgcacttcatccttgtgaaactcttgcaaaggctccacaacccggccctaaaatatcaaaaaaaggataaattgttgaatcgccgaaaatctcaccaaatctctcagttcgcgaaccaaagcgctgtcgttgtgatgcgttttgattacatccgcacaaccgctggccaattgagaggcactttcaatctgacaaagagaagaaatcggataaataaaaagcgaaatgttcaccaaatcgggacggagtgttccctgcaccaaaaaaatgttgtccacattaaggtccaaactgaatggagacattta

SEQ ID NO: 31727 - DNA, 2034 bp, Heterodera glycines
taatccaaattcaacattgttggtgtcattcgaaagctcttcacatgctctattagccttacaaaaagcgaatagattttcaagcctggaaaaaattttattaagaaaaaacttcaaaatttcgactttttcgcaattttcatgtataacttttttggtaattgtctaatcgtgaaacaatagcttagaaaaagcttctaaacacatcacattaagcgttcgaatgataccaacaatgttggatttggttgatagagaaaaaagttatagccaaaaaagttctggggcccaatcgtgtcggcccaactgaggtaaaccgagcagttaaaaaaagagtaatggaaagggtgggaggcctcgtcagtacggctcttcagaaatgttttacgtgagttaagttttcagatcaccatgaaggagtgatctgatctgttggtgtaaaagactttgttgatcagaatcaaaagttggcttagcagaaatttttcagaattttttctctacataaaattgagttttggtcaattaaactttttgcttccatatttttgcaccgccaaaaattggatcaatttggttgcggcactataactttttgatggcttgactaatcgggatacttttttatttttttaaaaggcaaatattaggggtttcttttggcagaggggagagtttcattcaaacattgatctcttggagagccggtttaaattaaaaaaaaattttcttccatacttttgcacctgactgtatgtctgaattggtttacctcttttcccaattctttttcaaattgacagcagcgaatttttgatcgatgcagaaaatttcaatgctgaatttttatttatagaagaacaaaaattgagtggtcggaacaatttagaggagctttgcttccacagtaggggatttattgttaaatgaatcttattttaacataaaattcgaacagcaaaagatggcgaagataaaaaaaatcggcagatcggagaaattcatgccaatcctattgatgtatgctctaattaatgaaacgtttggaattattcttgtactgatcagaaatagctaaatacagaacataacatataataaattcgattaaaatttttatggaataaaaatgcttaattcttgttataattttttgaaatgagtgggttgggaccgcaaatgtcggaaaatgacctttaagaaatgggccgcaaatgtcggttttttcttcaattttttcaatgttattccttttcgatggaaagttcaatttaagcccggtgggaggggaccagagcgtttgggcccgcgtttttgggccccggggtcgtttgggcccccgtttttgggccccgtggtcgtttgggcccccgtttttgggccccggggtcgtttgggcccccgtctttgggccccgtggtcgtttgggcccccgtttttgggccccggggtcgtttgggcccccatttttgggcccccgtttttgggcccccatttttgggccccggggtcgtttgggcccccgtttttgggccccggggtcgtttgggcccccgtttttgggccccggggtcgtttgggcccccgtttttgggccccggggtcgtttgggcccccgtttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtgcattctgatttggacatttttcagaaatgactaacccaattgcaaccaaaaaacaaaaagtaaaattgtcttacgaaggccacctttacaccttcgctaaaatgagttctgatgggatgacaaaattttggagatgcgagttcaaaaaatcaatttcacattattttggagtttctccggggaatttctcgcaactatcgaatgaatccgtgaattt

SEQ ID NO: 31728 - DNA, 1101 bp, Heterodera glycines
tagaacttatttgcgcattttgttcgtgaaagtcttactgttgtaatttcattgggggaaacagaacatctatgtggaaatacttcatttattttcagtcgtacgctttatgtaaagcacttagacaacacaatcaccgaagaggaattgaaagttcgctatggcaaattcggacacattttggtactttcctttatcgttttttaaaggataacattttcctctttaggacattgaagtgaaaaatcggaatacaatggcaccatatgcgttcattcaattcacaaagtgaccattttggttttacttgttgaaaattcttttcactttagcattgagtccgtggcaaatgccattaaggcgtttaaccaacaatttgaggaatgcggcggagctcgtcacaaaaaggtcccttctgtgtctgcaccttaattaacttaagggtttttaaactcaaaattgtattcccaatttctgttctttttaccaaacttttcacgtaaatgcaattctttactttttcaaaaacgagttcagttttccaatctacattggtggggcaacactattgtcacttcacgactttggattggccgactgccgcccaactgtggcgagcagtatttgatgagcaaaatgcgggttgtgctcacccagccggacgatgtaacccaagtgatttatgacgccggtttcaacgaggccattgtgatgttcgttggccacgaatccactcaaattgccttcaacaaagtcaaaaaccgaaacatgtaagtgaacattttcgcgaaaatgcttcctcgacatacgttaaaaggggggtgggtcggaaattttttgcgaaagggtgtcggttgccgatgacctttttggcgccgccgggataattttttgaagctttgggtgggatttgttaacagattttcaccaaaaatggccactttttacgatttgagccatttttttaaagttgagatttttgagggttgggaaattttttggactttttaatgaatttgttaagaaaatttccaaaatttgcgaccccccccacacctcgtgaaggcccccccccccctaaaaaatatatgttccccgaaa

SEQ ID NO: 31729 - DNA, 853 bp, Heterodera glycines
  misc_feature (50)..(50): n is a, c, g, or t
  misc_feature (56)..(56): n is a, c, g, or t
  misc_feature (197)..(198): n is a, c, g, or t
  misc_feature (213)..(213): n is a, c, g, or t
  misc_feature (220)..(220): n is a, c, g, or t
  misc_feature (231)..(232): n is a, c, g, or t
  misc_feature (274)..(274): n is a, c, g, or t
  misc_feature (283)..(283): n is a, c, g, or t
  misc_feature (285)..(286): n is a, c, g, or t
  misc_feature (313)..(313): n is a, c, g, or t
  misc_feature (365)..(365): n is a, c, g, or t
cggggggactgccccgaaaacaaaaaaatcgatttcttcagggggccggngggggnacgcaaacaacgagggggactttttacccaacgcagaacgaaaggacaggcgagagggaagcaaggccggaaggagccggacgccccagaaagctggccgcagcggaacggggggacagccccgaaaacaaaaaaagcganncgcgcaagggcccgnccggggnacgcaaacacnnagggggagcaaaaagccaacgcagaaccaaaggacaggccanagggaagcnanncccgaaggaggcgggcgccccacaaancggggcgcagcggcgcggggggaccgccccgaaaacaaaaaaaacgagcaanccaaggggccgcacggggaacacaaacaaccaaggggagcaaaaagccaacgcagaagcaaaggacaggcaacagggaagcgaaacccgaaggaaacgggcgaccccagaaagcggggcgcaacggagcggggggaccgccccgaaaacaaaaaaagcgaccctttcaagaggccgaagggggaacacaaacaagaacggggagcaaaaaaccaacgcagaaaaaaagaacaggccagagggaagccaccccggaaggacacggacaccccacaaaacggggagcaacggaccggggggaccgccccgaaaacaaaaaaagcgaacgacacaagaggccggcagggagacacaaacaaaaatggggagcaacaaaccaacgcagaaacaaagaacagggcaaaaggggaagcaaaacccgaaggaggccggcccccccagaaaaacgggggcgcatcgggccggggggaaggcccccaaaaacaaaaa

SEQ ID NO: 31730 - DNA, 1014 bp, Heterodera glycines
atgattattagtgggggatgcaaattaaatgtaagaaacattttaagttcgtacataaaagaaaattcagaaatatataagaaatacgggtaatagaaagctggtgccccccccccccatttttgttcggaaaccaactaaaagttataactgcttagataaaatggtaatttgaatcattttttactaagactcaaattcgactttttgtttgagttcgggcccgggttcggaattggtcgaaatagatgccggattctggtcggcgactcctaaaacccttgaaagcaagacttttgaaaacaaaaaatattttcaaaaatgggtggggcaccagcttcattattactgaaatatgcacaaaaactcaaatatgtagaaaataggtaaaattgtaaaaaaacattttccgttttgctgaaatacttagaaagcgtgaataaggcaccaaatgtcatatgttttatgggcgcccctacaaagtgtccaagcctcgaaatgtccaagcctcgaaatgtccaagccacgaaatgtccaagcctcgaaatgtccataagggtaaaaaacacgaaatgtccaaaagtctaaaaagcacataaaaacccggaaacggatctaatttagggtttttggagtcgctgagtacgaatatgacatttacattgccccttgtctatcccttgatccacccgaacatgaaataagttcaagaattattttaaatgtgtgctgtactgacgactttagatttttctattcatttggaccaaatgattcgtaataagcttgaaagtctacaaaaaagtcgagagaagcgttaatttcagacatttcaaacacaaatgaggatgccgtgaatttgggagtggagcttggcgacccgaatgccgtgataattttcgacaacgttgacagactttgaacgaggctgaagtcttaataatgaactttgagcgcggaaaaacatattttgggggacattgcctgtggctgaatggtatgtttgaagcgaca

SEQ ID NO: 31731 - DNA, 1663 bp, Heterodera glycines
gaagaaaaaattttttaatttgaaaattatgttaataaataggaaaaaagttgatttttaggggggggtatttttcaattttcttgtatttttattgcaatttttttcaaaaaagccaaaatatgtgcaaaatatgtggcaaattccaaaataagtgctaacatattttatgtgacaaaacgccaaaatatgtgtttttatgtttttataagtcgttttaaatcaaaaatgttcggagataatgctatttttgggcttctctcgccataactaattttgccgcaaaaaaaatatgtaaaaacataaaaatccgggccagaatgatcagcgagcatgaaaactcgaggaaacttgtttttgaacatttttttgatcaccatcttattccatttgtacacattgtttaaaccactgtgaaataaatgctttttcagcttttaatacactccatgcgaattcaaaatgggctattgagtattggcgtaattatggtcttcctgtttcaaccggccaaggtttagcaaatttggcggatgttcagcaatctgttacttcattttctccaattcagacatcttcattcataacaacggacaagaaagcgcaggtgtccggcattcgcattgaacctgagcagggcgcgggcggattcgtcggatatgcgtaggtcattaatgtcgatgtaagatctaacaaaaagtttcgcagggataagggcgtcagcatcgttgagccggacatggatgtgcgcgttgtgctgtttggcatccacctggacgaaattgaccttgtcggcttcacatccaccgacaattgctccgacgcggcggtgctcatcgatcgaaatgaatttgctatccaatcggaaagacgtgtcgtggtcatctatcactttgcaaggttttttggcgccatgattgaatttgttaaacccataaaactttaagcaattcattatacaaattgtgcgtgcgccaaaagccccatcctgattatccacacgagcttcccattcatttggttggttggtttttaaataactatcatatcgctccctttgcttgcagacggatgaagctcactgttgggtgtctacgaatataccgcctcgcaaatactacttctcaatgcctcttcaaattgtcatcattgcagtgctgctcgtcctttctggtctcttctcgggtctcaaccttgggctgatgtcacttactccacaagagttgactctcatcaaaaattcgggttggtgagaaaatttttgtggaataccatggatttattgtttgtctgcttgttgatagttcttggttgttgtttttttcgagaaatgatgttcctttctgtttaggttcaccaaaagagcggaagtatgctcagaccatcctgccagtgcgcaagtccggcaaccggttgctgtgctcgttgctcatcggaaatgtttgcgtcaactctgccatctcaattctcttcgacgatttgaccagtggcaccgttgcattgatcgtttcatcgaccggcattgttgttttcggcgaaatcttcccgcaggcgctgtgtgtgaagaaagggttggctgtgggtgcctgtaccatatgggtcactcggttcttcatgatgttcccttttattggatgttttttttgggatactgtttgtaagc

SEQ ID NO: 31732 - DNA, 1375 bp, Heterodera glycines
acccccccccctttccacctgtgctaaaagttcgtgtttctccatttcttctctttccaattgcgcatgcaattcccttttttgggcaagcaatgcgagtgcatcgggtggaaaccttaaggatgggtaagctttgttcaccatcatttttcgattgttgtttttgcagtaaacttccaaaaaatcgcagattttaaaaataactttccaccccaccactcattgcgcacttttccctttccaaagctccgaattgtcttcgcgtcgcctccaattcgcgcgttcgttcctccaacattttcctctggtcgtaaaataatgaaatgaacatttatcaaacatgtgttacataagtttgcaacaaaagaaaaaatgtctatgataagcagagcagacaaatgagcgagttataaaaacatccctaacaaatatctaattttggggggggggggtcggcaattggaaaacccatttaagactcataacacctatttatccatttccgcacttattaattgcaagcacatgcagccggacttagttacctatgttaaaaagcagcatttatttgggagggggcgtttcgggactttatcctatttaaatagttaatttgtgactaaaacctttaaattcaactctacgtaggaatgaaatttattgtagcaattgtttattcactcaccaactttccctgctgtgccttctcgtcattttcgtctccgtttatcattttcgttgactccgcctaacatatatcatcaatttgacaaaaaatgcctaacattataaaaaaaaatgattattgaaacgaaaattaaaaaacaagacttgcgaagaaacagcagacactatataagtcagacactacattaaaaattattgaaaataaaagtgaacaatgcgccaatgaaaaacagacagctgaggttagacactatatgttttatcattgtttttaattaaattttgtatgcttgtaacttggtcaatagaaaaccaaaagaaatttttttgtgctcattttgaagggaaaattctaaagaacattcctaatttaatcaaaagttttaaaaaaattgtttattagcaaaaaaatgaatagtgttattttatatgttagagacatggaaatagtgcgtcaaaatgagagaaaaagaaaaaactttgtccttgaaaaaaaatttttcctattgaccaattttcttgaaattttctatagacctatattttgaccccctctagcgattccaagtttattttatggaacttaagtttttaactcgagatcggctcttcagtttttacaagggaaaatctcggcaaaatttttaaattagtggggttttttggcgttttgtctgtgcgcactttt

SEQ ID NO: 31733 - DNA, 1220 bp, Heterodera glycines
cgcattgcggagctttttcgcttaatagtagggttgcgttttaccggtaccgatactggccggtaattaccggtttttttggtaccggtactggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttagccggagaccccttcgcaaaattggaaaattggccgctgattattcaaaaaaccgcatgtctctatgacttatagcggctgaggtatgggcacttcaattttgacgtagtgtaaaatgcactattttcttaagaaatacagtactttttataggcaccgaaataaaagtcgacgtatcgcagcgggcctaaatcgtagacccactattccaaaggcaatcggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtatgtcctgaatttgaaaaaaaaaacttggtcaacctgaatatacatatacttctgaacaattctaatgctaaaaaacaggtactcacgcgaaaactgaataaaaattttgtatttggaaaattttgtccaaaaatttttacgttggaaaattaccggtttttaccggtaccggtaccggtaccggttgaaaaagttggtaccggtaccggtaccggtttttgcagtaccggtcagtaccggtaccggtttttttgcaattaccgattaccgctcaactcta

SEQ ID NO: 31734 - DNA, 944 bp, Heterodera glycines
attaaaaaaaatttgccgcgacgatttctgccggccactttttgtcctgctccgccctacaacagcccctttcccgagaaagcttatgttgcatagtttcttgtttttttatttctttactatttttgtcttttattggggacggatattccattataaaatcttggccctgcccattaataattctgtcttgcaaattcagagcatccgaggcagatttggtccttttggtgattgacccttgccaatctttcggtgattcggaaaacgatcaattgcccaccgcttcattgctctctgaattcggctttgacccttccacgcagcgattgattgtcgtggtgaataagttggatttggtgagggaccgaagtgatcgatttcgcattgagaaaagtgagaaaaagggagcggtaggaggggcactcaccacagaagagtgatcaaattgtttctggacttggggggaggcgtacgccgtgtactcctccaccccgccccaatggtcgatgttccctgtagtgcgactgattggcacaaaactctttacaatcatttcatacaaaaagaaatggaaaagggttgatgacaattttgctagggataaagccaaataattcggagagtagaaacttagttgaaattgttaacaggtttgccaaaaatgacctctgcgacccttcacacctccctcttttacaccggctccctttgtgctgatgggtccccattttggcccccttttcattatgctttagttttaaacagtgatgggtcgctaactttggcatggacgagctgtgtgaaggaaaatggattggacgaactgttggggacgatggggagggcatgttcggaggaggaatgcggaacgggaaaagggggcgaagtgtttctgagcagagagagacacgtccactgcttggaaagagcagtgactcatt

SEQ ID NO: 31735 - DNA, 1197 bp, Heterodera glycines
attaaatgctactgtcggccccttaaactcattaaattcaaaatgacaaataaataaataaaacaggataacccgaatcaagtgaactgaacttccaaatgcgaaagataaagtgtagttcacagattgtccaaaatcgcgcttcggtctcacattcaaatgcatgaaccggtaagtgcctcgaaccagaagagtgtttgaaagaagggtagccctttcctctcttgcacaaatatgaacacgcaaatgttgctcattttccaacaaaaggtttatgctgggcgcggatgtgccattgcgaaaaggaattctttccgcgtaatcaaactcaagcactttaagggttaatccactaagcaaaaaaaaaactttgtactcagactttaatgaaagggtttacgggatgtatgatccaatttgccaatcgaagaccaaaaaatcatttgttgtagtgccatcctgataaaattgctccagaaatggtcgaacacccgcattccgacccgttccctcattgttcattggtataatttgttgttgttggggggtgacgccctggctatggacatctgtagcaatgcgctcaaagtgttgtctatgggtgagtgttatccctgtcggagggggaaaagcagcaggaatgggtgtctgagcaaaaaccggatgtggaaatggccctgtaagcggatgcgcaaattgattcatcaatggaagaggcaagaattgggacggcattgacattggattgatgaatgggttaagaagaaatggcatttgtggcacttgcgacggtaacagcaatggtggtggtggtcgtggtggaaaaggcaggtatggttggtggtgtaccggcaacggaaatgtcaaaccatcataccacgcaggctgaaaccgggtaagaaatgtacatttattcttaaaacgaaaagattacaaaatttgtttgtccattaactgcaaacggtgctctaatttcagtgaggttctaaatatatttttaaacaggaaacattgctgtgacaacttgccctcggattcgacattgagtgcgttgtgaaaaaaaaaataaaatacaaaagctaaaatggattctttttttaatctgcataaagtgacttatgcaataggcattattgccttttattacgcaaaaatagttggccttttgcaataaaaaaaatcgctaatcatttaaca

SEQ ID NO: 31736 - DNA, 911 bp, Heterodera glycines
atgccgaaaccaccgctgatttggttggcatttttctttctttttttatatttcttttgtgccaaaacattattggagtgagattccggtgcgggacgggatccggattttacggggtcctagtccgcaatcccgcattattttcagaaaaccttcaaaaacgccaaatgaatagttaaattttaatgctaattgtaagcattaaactcatagcacgcttctataagcctaaaataatgttagaattacgtctttcttgttttttttgctcgaccaaagttagaaaaaatttaagcacatgcttcaaactcttgccggtcccaattaattaattaggtgcaattaaaattccatttggagtcaaaaaaaaaactatttacgaattttaattcatttgttaggtgttggcattgaaccgctgcttggatctgagctcaccctatttgtccaacttgtttttctccgggcgtcgtacctcgttttggatcatcggctgttcactgtacgcactgtactgggccttattctgtaagccggcggtgtacagtagcctttactttggctggttcttctacccatttgttggctaccgtaacacaaatcttgaggaggtgaacaaaatgtgtatctatctgtttttatcatttgaaagaagcaatatgcataggtattcgaaatatggtatgaactcaaagaactgtatgtaccgtacaccttgttaaatgaagcccgttcttacagtatgaaaacttgttgcatgttgtgcacaattgcctggtctcaattctgtgcccgctcatctatctgatttttgtgggaaaacttttttacaatgtccgcaaaactcgtcaacagtttggcactgtgctttcggatatcagcgcagtgcagatacgggtaaggatggttgg

SEQ ID NO: 31737 - DNA, 1249 bp, Heterodera glycines
aaagtttattagttcatttcctctctcaataaaatcttaaaaataaaacaatatattttaaatgtttaaaaatatctttttggctttgtccttcgcaattatttttatttaaacatataaacaatatagtacaaaagaagtataaaattactaaaaaaattaacaaaatccaatgagacaattcagggaaaaccctatagagtttgtctttttcaaataaaaaaagacaaaaattaaaattactttttacgaaaatctgaaaaaaaaacaattttttcaaattgtagtttatatataataaattttatttttgaagcatatatttaaccgatacatttaattgattaacgtcatcattaaatttatagaatcgccttcattaataaaaaaatgaatttatattattatatttattatttctttaactgtttttgtttcttttaatgaattatattcaaattataacttttagaatgtttcaaaaacgtttggattattttttgattttttacacatttattttactgctgataatttcagtgcaagaagaaaatgaagtacaaataacttatgctggcgacgtaaccccacctggaaattattaaattgttgtttgggataacctaacaaaaagttcggacaaaatgttttttttatacttcaaaaaataacaaaaaaggtaaaatttattaaattttaaaataattaaacataacattaaggatcgtatataatggggtacttttattagcatacaatactcttggactcgaattagaaaatattgggattctaaatctaaaaaattctcatccaaaattggtgccggtctttacagaatcggtccgtagcgttcgcattgaaatagttttttagggttttaaaaataaaatttctttaagtatatttaaatcaattaagaatcggatactcaacgcgaatacacaaagctatgaaaatgtggatgtgatattatcattttcaaatatgagaatggaattgttttggagaatttaagcgattgtttcgttcatttttattcagttcaaacaaataatgatggcgaatttgagatcaaaatatccatcaatgtcaatgacaatttaaatgttcacatatttccacttgacaaacaaatggtaaattaaattttaattatttacaaaaaataaataaattttaattttaagaatttgattccatccacaaacgaaccaggcataattctacaaaacaaaatgaaaagaga

SEQ ID NO: 31738 - DNA, 1200 bp, Heterodera glycines
  misc_feature (1190)..(1190): n is a, c, g, or t
caaaatgagcaaagaatgcaaatattgtggtgtggtttgggatttgcgtaataatacccaaaatggaagagaggacttaaacaaaaaatatatttctcagtaatgaaattattatttagggtcacaaatgcaatgagcgatggtgcgaaaattgtcaaattttccacgaattcaaacgggggtgtttcattcgaccgctggagttaagcccaaagaacgaagcacgggtgtggagattagtcattttcgaccttgaggcaatgcagcacgaaccagtggatccacaaatccctgagcgacggaaacattaagtcaactttgtcaccgcaaaagttgcttgtcctgactgcatttcaaatggacaatggaaagaaagtttgctcggaaaaaatgcaatattttgatcaaaaacggaaacagattactcgaaatgaaagtaataaatatatttttaataatatttaaatttacaatttttaggtaaaaagtcggaagaaattaaatccaaatatatcattccgagattcttggaatttggttcctggtccattagcctcaatggtcccaatgtttggcttagatgttcaagacaagccgttctttccacatttggcaaacaggccggaaaattacggctgtcaaatatttccgacgaaatcaaactatttggccgatgggatgaatcctgagaagcgtaaagaatttgacatttggtatgatcaaaaccgaaaccagccatttctacttgatgaagcattggccaggtattttttatatattttttgaaatacctaactaaattttcagtattgtaaaaatgacgtggatattttgatggcgggccttattgccttcagaactgaatttttggagatgagtaaacgaccggctgatccggacggcaaggcaaattgagcagcttacagaactccacacaacggaattgacccgctcaaacattgcataacaattgcctcagcatgcatgcggcatttccgaactaatcatttaaagcctggtcacttggctcttgttccggaaaaaggatacgatagttgcggtgacaatcagagtgatttggcaatgagttttatgcagtggtacgccgaaaaatatgctgttcggattcaaaatgctttttcggcagaaggagagaaaaggggagttgagggggggatgctgagcaaaangttaatctca

SEQ ID NO: 31739 - DNA, 1112 bp, Heterodera glycines
tataacattcctcgtatgaacgcctgtgagctcagctttgacattcattcgtcaaaccaagtcagttgattttaataataaaaattagcgaattattttattcaaataaatcactattaataacgaggcatcctccgtcggtgggctgttctatccggcttgtatgcgtctctaattataacattcctcgtatgaacacctgtgaactctgctttgacattctttcgtcaaactttgttaattgctttaatattaaaaattagcgaattatcttatccaaatttaccactattaatactgaggcatccaccgtgggttgttctatacggcttgtatgcgtctctaattataacattcctcgtatgaacacctgtgaactctgctttgacattctttcgtcaaactttgtcaattgctttaatattaaaaattagcgaattatcttatccaaatttaccactattaatactgaggcatccaccgtgggttgttctatacggcttgtatgcgtctctaattataacattcctcgtatgaacacctgtgaactctgctttgacattctttcgtcaaactttgtcaattgctttaatattaaaaattagcgaattatcttatccaaatttaccactattaataacgaggcatccaccgtgggtctgctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaatactgaggcatccaccgtgggttgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggtctgctgttctatacggcttgtatgcgtctctaattataacattcctcgtatgaacacctgtgaactctgctttgacattctttcgtcaaactttgtcagttgctt

SEQ ID NO: 31740 - DNA, 1416 bp, Heterodera glycines
  misc_feature (111)..(111): n is a, c, g, or t
  misc_feature (190)..(190): n is a, c, g, or t
  misc_feature (219)..(219): n is a, c, g, or t
  misc_feature (241)..(241): n is a, c, g, or t
  misc_feature (300)..(300): n is a, c, g, or t
gggggggggggattcctttttaggattttaagacaaataaatttattaattacccatcgcttcaatgagtcgattcttaaattagaaaaaaattacaaaatatgtggaatnaataataaataaatgagggtcaaagtcaatgaggtcgaaataccaaatcacttagaaatttgttacattctaactttcnccgtcttacagattaccctagtgaacttntaagttttattttaaattgttntaaagaatttgtttttattagttctttatcgagttgattccacaattttgttaccctcncagcaaagggaatgaattttttgcccagtttgtattttgtgttaaatctataaaaggggatgttaaagcgtgtggatggattaaaaatagaaaatagtttcagatctgttcggccataagcaattttattataattgcctcgtaccaatcttgcacaactgttattagttgacttgtcgtagacctatttctaacaaaaccaaattggtattccgaaattttattgttttttaggagaaagttgtaaatattttggctaagaattctttccataaccctgcaaagtgagcatgttatagaaataggcctataattttcaggattgaatttgtccccttttttgaaaagaggaaaaactattgattccttccagatatctggaagagaaccagaatctaatgaaatcctgaataggtcagtaataacagttgctaatgaagaatggcagtttttcaatattttatagctaatattatccggggaggtcccgtttttattcggaagttttttcaaaagtttttgtgtctcgatgatgttaaagtctatatctgatataaagcattgattaacaaaagtattgcccaagtttaggtagcctgggtcaacatcagaattattaaacgaatttgcaaataagttggcaaataattcacatttttcatcaccatcatgatagcatttgttttcaaagattaaattcggtatttcaaagggattaacatcgtatttttgtaggtatttaaaaatggaattttttccctttgaaatagcctttttctcaatttgcgagtgaaatttatttgtttgtatttttatgtgtaaactaatgctatcataaagtgctttttttgttgggtcagttttacattgcctatacagtctggctttctctttgatggaggccaataaatgcgttggatatttaggggtcaaatcttttttggtaattttttccattggaataaactcgtttaaggtttctagcaatgtattattaaaggcgttgtatttttcgttcacactaaaatgctcgttagataaagcgctaattctagaagaaaccataatattaaaaagagaaacattcgacggaaaaaaccgtcgagtgtaaaagaa

SEQ ID NO: 31741 - DNA, 1649 bp, Heterodera glycines
atattcgggtttatatatgggagttggactgggagggaaaattctagaacacacctgaaaggaatggaaaatggggaaacttcgggaatattaatcacaaagatcacaagggaacattcgagaatcttcttccggtcctccacaggacttcctcatttctttcctccgggcggtcctccaagcggtcctccgggctgtcctccgagcgatcctccgggctgtcccccaatttccacgcgttcagtcgccagcggcgacactccgggcggagacgaaagttcacgacgcagaaccgagattttgaggcgcaacgactgcatgaatgctgccgcctggcgatgttccagcgcgtcgcggtcggctctttcctgttcgttggccttcagcacttcgcccaatttgcgcgtccactccacgtacatttgtccgatttgcgccccctgagcgatgacttcgtcgattgctgccacggcgcgttttccacgttgttgcaattcctcagccatgctcaaatgattgtctcgctcgcggtcgatgcgtgccccgatttcgctgagtccattcagcacggcatttgtctccattggcacttggagacccggtcgggctgccgccttcttttccgccacactgatggctgccgccttgggtttttccattgcggccatcaattcttggcgtgctcttttcttcgatgcgcgaaatgcgccctcagctgatgcccgtccaccagcgaccattgaggcagcaacgcctccagctctggccgcacgtgcctgtccaccacctttgactggcagttgaatgatcggaggtgccgagcattccatagttgcttccgcgcgtttggcaaatgctgccgccttctttcgatccatctccgcttttaccagggcattggtctttgggcagcgagcctcgtcgccagacaaatggccaagcaatccgcatttgttgcaacgcgatttctgcgcattcagcgggcctactatgcgcgctcgcttcacgaatggtccctcagctgccgccactcgtttggtcttcggtgcctccataggtccctgaattcgaggctttttgacctcttggacaaccggcgatggtgcggcactggctaccgctgcttcgagtgctgccgccgcttcttcctcatcgtcgtcgtcttcctcctccgactcactctccgaaatgtcgattcggagcgcttcgtcgtcactttcttcatcaatttttacgaaacggacgacttgttgtttctgctgctgctgctgttgttgttgttgctgttgttgatggtgttgctgtgctgctgaacgaattcttcgctttcatccaagaacttttcaatatccatgttcggtaggagttccgttgatataaggggcaggaataaggaaatgtaagtgactttttgcccatttccctcctccttatatagctgccgccagagggcagaggacacaattttgtgtccctgattcatgccataggcgcacaaaaacggatgactcatgttcgttcccttcattcggaaggaagcatctccatcaacagcactcatcggcccatgattctccgcctctttctcgcttcccgggtgcacatctccgccgaagccgtgcagaaagacctgattcatcggcgcttct

SEQ ID NO: 31742 - DNA, 1610 bp, Heterodera glycines
ccccccccaatgtgtccgtccctattgttctcccctattctcatctgccgagtgctgtgccgtgcattctccgagcaatttaatgtgtgtgtgacgacgcccgcgacgaacaagtgcaagtgcggcggagcagcagctcccaccctccggggagaaacacgaaaaaatgtaacggggaggtgagaggaaagaatgggaggagaagggtcgaaacggtttaatgccccccactcctctctctctccctattcatccgcccccccccccccccgggggacactcgtgtgagaagagaccgtccgttagactgtcccccatgcacctccccggcggggccaaccaatgccccccatggaaaggcattttcttgtcaagtggggggggggcagagcgaatgaatgggatgaattagcggaagcaatgaatgaatggatgcaattggatgtacttcttcttgttcttgttcttcttcttcagctgatgatgtgatgatggaagggatcaattgaagtgcttttttcgcggggcggggtaaaaatggtaagggacgagaggagagagagagaaacatggacaatttttgaataaatgctcaatgaatgggcggggagaagcggctcggcattataatttggcaacgaattttttgcaaaaatgggaatcaaattttcgggaaaaatggcacttaattgtttgggccctaattagttttgcgcccgtcaatttttaagaatgccatagctccttttttacgagaatggggtagcgagaagcggcgcggcattatttggggctgctcgacaaataggttccggtatacaaatccatccacgatgccacttcaggtaacaatccattcttggtatcgctatacacggacattttttctcaactcgatactcggaacccacatcgagaaactaattaggccaatcacgaaatatgaatctaaagattagggccggcctaatttttccatcaattttgcctatgatatttttttaggataattccccccagcaggaaaatagtgttttccactaataacccgaatacaaaattttgggaattggatttgcgaagaaaaacccaagagcttggacaattcccgcccctctccattctcgaaatttcccagccaaaaaaacggcaaattctcaatgcataatttaggaataatataataattgattgattgatcccggcggaagaaagcaagaaaaacgaacaccccccgcagcagaggagcacacaatcggccgaccggtgcttttctgctgctcctctcttttcttcccattcatttgtgccccggggggacgccgattttggggcccaatcgccgacgccgccgctttttggcggaagaattcttttgaagcggcgccggcgccatcccccggggggacgacggaccaaccaaagcaaaggtgaaactgctgggggaagagaagagttggacaacgacgaaaacggaggacagtgtgtaaggaaatgtgattatgcaaattgatgatggatgcgatggcaaaagggcggcccaagcagcggcgatgggttaaaattgaaaaattttgggggatgggggcccggggcgggggggggggggg

SEQ ID NO: 31743 - DNA, 910 bp, Heterodera glycines
  misc_feature (39)..(39): n is a, c, g, or t
  misc_feature (46)..(48): n is a, c, g, or t
cttaactaaccgcaaaaggcttcgttaagagtttgttgngccgggnnnacgatatctttaatgtcctggaaaaaaccaaccccccccccaggagtgcctcaaaaaaacaaaaacaaaaaagcatcaaatcattctatcctttcaatttaatttacatattcactatatttagttaatggatttaaaaccaaatccggatggtaatttcaaccagagcattaggacttttttctaattgatattttaataaatttaaaaaacaatttttttgtgaagtcgaacgggaaggggggggggagtgaggcaaaaaatttttttttgtctcattcagcaatcataagctgcacatttatttgttcaaaagcatacatatactcgttaagctaagcaaataatcacattaaaatttccaatttcaatccatcatatgaaacaagagaaggcatccataaaaacattaaaaaatttccttaaaacatcaaaataaattgtcaacatacagtcagtcaggtgcataaaatttccattttgagattcgcgcggtattttgcgctattctgacaatttgcgacaatcggtgcaaatttaatttttcggtgcaaatttttaattttttttaaagtttaagccaattacaattcatgcttcttctaacatcatcatcatcagcaacacaaaaccattattaaatcgctcacattttggaaaatgttaccatcaaataaattcttcaatttcaaaattcggattaaaatgcatttgttgacaacagtttttgtgccatcaattttgtccatttatctcctcatttcttcaccaggtgagttttgtgaacaaaaaatattaaaacccgcagttttttctagaatttttttttgcagagtttcaattcttgatttctacatattcc

SEQ ID NO: 31744 - DNA, 1697 bp, Heterodera glycines
  misc_feature (961)..(961): n is a, c, g, or t
ttgatttgatggcattggtgggcaattggctgccgactgaaattaaaaatgccaaaaattgggaattgccaattaaagcaaatttcgaattaaaaaaaactttgcatttcttccatttgaccaccacccaaatgaacacataaaaaacaattgcgataaaattggccatcagcatgaaagagaagaagatgggcttaaactcgaacaggaaaatgtcgctaattgtgcctgtctggggccatttggggtggcaaaaggcaatttgggcgtatttgaggctcatcaaagtgccgaaaaacagcgaaacaagcacaaaagtgccgaggtaaacagtgcgattcacttttgcatgccttaattttgaaattgcattttatatttaatgccaattcttaattcatttaatcaatttattaatgttgcaattcggcaccatttttcaaatgccaattggatgagtctgtccagcccggttagtgcgattaatgccaaactcgcactgcagccgaccaacggaacgacaaggaatttgaacgcagtgaaataagggacgaaattgcggccggagagggaaacgcaaaggaaaaactaatgaccaaattggtggacagtctcaaaaagagcagtcaatgccaacagaaagctcgaagtgccacgaagagagctgcgaaagggaaagccaagctcaagaacagaaaagtgaaaatggaaacattggaacagataattaaacgaaatcaaattaagcgtaatttagggacaataagcggggaaaagtaatcggaaacattatgccaaggcttagagcctttttgagtaagcttttgcctgtatttgaaggtgatcaaaaggatgccaatgttcatcaaaatgccggggacgacgatagcattgagcagcgatgccgtgaagatgagcattggggaatggccagagtctttgtattggacccacagctganaaagcattggctaacgtaattgaagaaccaattaaactttacctgataatatgaataatttttattaagtccttcaatttgcccattcatttgggattttcagaatttaataatgcgataaaaaattaaatgattaccttttacgccaaatagatacctaattgctgcaatttccgcgagtttacattgaatttttaattactacaattagcattaatgagataagcgttaaagtaatcttcagcaggtgttttatattttttaattactttttttctgtgccgtttccgctagttaaagtcaatggcatggtaatgggcgataaatttaatgatgtgattgatatccttttatctaattcattattttcacggttcataatttgagcaattgcaataattattttgtacaaaattaggtttttcttgaaaaagattataattgaaatagttacagacagattcatttaaaaaataataataattttgatatgaattaagcatgtgcaatgaatggacaaaattgaaaatgttttctaattataaaaaattaaatcaaaaacctttccagatagaaataaaattgatttaatttaactaaaacttttgaaattagaataacaaaatttttaagtggaaattcgctgactcatttaaatgcctcaattttttgcacaaaacaaaaagcaatcaacaaagccatttgaattttggtgggaaattataattaaattgtc

SEQ ID NO: 31745 - DNA, 1431 bp, Heterodera glycines
  misc_feature (1348)..(1348): n is a, c, g, or t
  misc_feature (1391)..(1391): n is a, c, g, or t
  misc_feature (1399)..(1399): n is a, c, g, or t
cttttattattgttaattgtaacaattctaacccccccccccccctcgcctccccaaggtttgggtttttaattagttttatggactaattattttaacaaatgtaaatttgaaaaatcgttggacaaatatccccccccccgttttccccaccacgcaaatggcaccgccaaaacgtcgttttgttccatcggaaagcgcttcttcatcatcatcagttgggcgtagtaacgcttcgccacacaaatggactccacgtcgttgccgcagcgggcgaccaactgaaaaaattgggcaaagcaattgaaattgcaaaatctaagctaggggatggatgggtcttggaccgggcactaattgtcggtctggcttaagacctggcattaatagtcgagagtagtgggcaagttacaaattgttgggaaagggtcttgaacccggtattaattatttgatcatcgctcgctaccgttcgcattttctccagctcatccaacgccgcgtcgtgttggctcgggtcggcttggtagtgctcggcaatatactaaatgagaatgtgccaatgtgggaaaaagtgatccggcacagaaatggatcaatcagtccaatccgatcagtcctaaccagtctgatcagcttcttctactgatcagtcagtgcaaaaatgccaacaaatcaccgatttgatgcgcggacggagtttgtccggaaagggctgactgggcactttcatctccggcgccaccatcggaacacgcggaattccctccatcccttcgggcaaaaatcaaatcaaagcaaaattgggcagagataaatttttatttttattaattatttaggaagatggaaaaatggacaaaagaaataaatttgcgtgcaattgcatcagaatttgttaggcaaaaaaataatatttaaccgatttggctaatcaaaaatttatgggaaaaaagtgctgatcattaaaataagtaattcaaatttagacgagaaatcaaaattgtacataagtaaaactcatcaaacacagagttgccctcaattaggacaacggtggcaaggccaatgacagttttatgatacaatgacgtaattaacggtaattaatgtaatcaaatgtaaaagccaaaaacacagctgttcattctggtagtttattttgtgatacatatataaatattctgttggacaaatattttatgggatttaaaagttagaaaattctatcgaaaaagaaaagggatacaaaatttttatgtaaagtaaaatttgaatggtaatgaatacaatttgtaataaataaaagaaagcgcacgcaattgggaccagcattttgcgcaattanaatcgaacatttgtcattttaattattaataattgccccattngcgacgancgacagtcaaacggaaaaaatgatgctgaaat

SEQ ID NO: 31746 - DNA, 1374 bp, Heterodera glycines
gtgcacccatttggacaatgcttggccagcagaatttgttgaatttggcacatcaaaatcagcatcaatcgcagcgggcgacagaccaaatgatttgattgaaatcaattggttgagatcggtgagaattgtcggcgaaatgagactacgcaaattgtccaaatgatcaccacgggaaaagcgcaaacagcgaatgttttcagaaaaaattggccaaatttcacgaacaaaaacatcccaaatccgctggccattcgtagagtgtgatgatggaatccacaactgtaaatcgatgcctcttttgtcgaaaatttggtgattggaacgaagaaaagcgatgacggagtgatcgatgtaactgtgaaaatgggatgaatgcttttattgcgatagctctgatttttaattaccacatccgaaggcgcttaaaacggattttgctgggcaacggacggtccggcaacggaaattccacaaatttgtcatccatccgcacagatagtttcggtcctggtcctttgtccttgcgaattacgatttgtctccaaattgtcaattcgcttttgccatcgaaatgtttatccaccaacgcatcgaaacgtggcgaaagaagtgccaatttgaggccaagttgaggacggtcaaaggatgggaaaatgtccatccaaacgtcgttgcaaatccaactgaaatgggaaaacagtttagtcaaataaacgacgaatttgtgacttttaaaattcattaccgtcggttcatttttggcagcaattagcacaattttggccgagttccgaatgatttcaaacaaaagagcagaataataattcgttggaagctttatttttttaatgagtcaaagcggaaaacaaaagatttttatagtcatgaaaagggaattggtgaatattttttgcatatgaatagagagagccctgatttttttagatttttcctattttttacggattgtacttgatgaaagaaacacgaaaatcacattttattaaaacaatttttgaagtttttgccttcaatggggttggacaatgtttaaatgggaaacgaaagattattgacaaaaacggaaggggcggaaacattttggcataaaatgaccgattggaagaggaagaaaaagggaacgcaacagaggaggaccaccaaagaggagaatattttgcaaaatgatgactagggatgggaatttaagtcaaatgacttttttgctgactctaaatgaccttaaaatgacttcaaaagcgatttttagtccatattttatggccatatttcgcgatttatatccatatttttaccatccctagctcatgaaaaaattcaactatctaaccgattaaaatggaaaatcat

SEQ ID NO: 31747 - DNA, 911 bp, Heterodera glycines
aatcgcaaaatatgcacaaaaaaacatgaaaattatggcagcctgatcattattattaatttgttacacatttcttggataaacaaattccataaattccatgtgaagtgttttgttaccgattcggcagttattattacgctgtgtaagactatttggtccaaatacaaattccttttaaaagttattcatgcaaggaccaactgaataatatccataaaaacatcaacaaaaacatttattattgttatgtggcgaagtgctgaagtgattgatggtggcaatttttgtaccattccaatgccgggggggggggggggcaaaaaatcggacaaggcaaatgccgtaattgtaaatgatgatgaagttgtcaaaaaaacgcaaacaactacagcatcaggagcaaagtcaatcgttggtcaacccaaggccattgaacaaatggaaggcaacccattggttaagtaagtacaaaaggacaccgagtaaatatttgtaaataggagcagcgaaataaattattaaatgaaatgctattacggccttactttatttaattaattgctaaccatggatttgtaaataaacatctttaatttcaaatttcaattaaaatattggaattttcttttgtgtgtgtttaaaaaatgctcttattattcagttaccactggtggatatcaacaagattagctatggataagttaaaataacatatgcgcttttctttgattgaatctattttatgtgctatattttctttggggatttgcccgcgttgctttaaacccctctcccctccctcttcaaatgtttaattttgcatatggacaaaatggaatgttcccgccccttctgtgcatctcctctttggctgacgttggacattgcctcgggcgttacccctatat

SEQ ID NO: 31748 - DNA, 1492 bp, Heterodera glycines
atggaaattgtcaattctgttcgagaagcattgccactctttcaaaatccgttgccgaacaaagtcatcggattcagaagcattgcgatcgagtaaaaattgaattgaatttgtaaatgattgtgtgccattacactttcgcattattttcagcttcatcaaccaaaatgtgctcacttttctcggccgttttcaccgtttctttgcttcatgtgaaacaacattgcacatcaacaaagaaaaaagcattaaaggtcgcaaggccattattgatggtcgcattttgaagttcgttgtgctcaccatttggccaatgttcaaggacaccattcgtgtgatgtctttcaacaccaacaccttccgtcaaatgcgcaaattggccccgtccattctcgacgattgtccatcccttcgcgttgttgctttcgatggcaccattttgcccaaattgccgccttatgacagtgccagtgcgtcgaatgacaaaacggtggccaaatggctgttcacgcctcgtcccgacaatttgcggaaggttctcattatcgagaactcatcggttgagaactcagcggttgaccaatggttggcaacattggaacaaatcaaagcggtgattattaatcgactactcatatttcttttctttttttatttgtcttctttgtaggcattttcctctgcttcttctcctgtttctttcgtcatttctgttaactctaactctgagtcgtcctcttcactttcttcatttgtgccatttgaactgaccaaccaattgactggggagaaattggcactgtcacattatggaaatggtattatgcttgtccgttgtccaattggcgaaggcagtgatttggaagaggagattgaacaattgatagacggacgaaaaaacaaaattgagatttccatcacaaaggactgtgtcgacaatgggtgatcaatttaattaattcaatttgatttaatttgtttttgtttttgaagtcttctcaaggatttgcccgggccgagtggtgatcactgatcagaaacagcagaaatgaattgattggttgattgatgcgattatgtgacctaaatgttgagcgttgttatttaattgttgttgtatttgatttttgttcattcacaaatcaataaattagggcttaccattattttcatacatgaaaaaaggggccaattttgccaaaggatccatccggggccaatcagaattacgaacgacaaacggctcccggacaatcggacagtggacaatcggacagtggacaatcggacagttggacaatcggacagtgaggacaatcggacagaggtggacaatcggacagtggacaatccgacagtcaaatatacaaatagataagaaaatgccggtcgccgaaagggaccgatttgggcatatcaagaaaaaaaaggaaaataggcaaatcaggggaggagtttttgcgaatgacctagaaaatgtaaatgatgtgaa

SEQ ID NO: 31749 - DNA, 922 bp, Heterodera glycines
  misc_feature (851)..(851): n is a, c, g, or t
  misc_feature (874)..(874): n is a, c, g, or t
  misc_feature (882)..(882): n is a, c, g, or t
attatagaaaaaaacttttctcaaataattaaagagtgcgagctcattttacaagcaaaaattgacattaataattaaaataattaataacaattgctcattattcaagcctctattaaaatttacaatgcttcaataataattaaataagaagaagataagatgaaaccaattatttaaacgaaaatctttttgcttcttcaatatttaataaatataaaaaatatgcaagataaagtttattatattttatgggaaaagataaaaattattcactgcgattattttcatgtataaacaaaataaaattttgtattcgtgaacgaaataatagttttttataaaagaatttgtttgtaaacttttcgataatattaaagaacaacattatgccgaaataaaaacttatttttaaatttgttaattttttatgtaattttatttgaacaactttatgaacgcaaacataaaaccacgatttgacctggaccgaccaagataatagaatgattaattatatcaaaaaaaagaaatacatgattattttttcataatgtgctgtaaggcgcaatttacttatccgttcaatctctttcccacaccatttatccccgctttccccatctttattccgttccttaagtccaactatttaatcgggagaattctcttgataaggagtcagttgagagggcagttaaagttctctacttccaaatccaagttatattatttttaaactaaattttacttaaatttatttcttgaaattttatttttaatgttaaaaaaattttcattatcaatatactgtgtatttttgggtaatgaattcaaaacctttcaaatgnaaaaaatcctttattattatttntaatcaanaaagcatttttacgaaatggtaaatagattattactaatt

SEQ ID NO: 31750 - DNA, 1320 bp, Heterodera glycines
  misc_feature (1315)..(1315): n is a, c, g, or t
gcgcaacaacgaaacgatcacccaaagattcccggccatactgtaaaaaataaataaatttaaattcaattttttatcgataaaaatttgttaaaaaacgtacccaacggcaaagattggaataaaataggcaattagcacaatttgaccccacaaattttcgatcattcctttgtttattcttaaagataaaaaaatttattgcttttatttcaagaaaataattaattaaattgaaaatgagcataaattattggataaaacagaaaaaaatataatctcgggactcctccctcacacggaaatgaaaaaaagggaattgatatgaaattaattgtgttaacatgtaaagatagaatttcaatcctacaaaacggcttatataattccagcttctaaataaaaaaaaaattaaaaaaaataataataagctaagtccggcccttgggagggagttgatcgagaaacggggtggacatttcaagaaatggattgattgtccatcaaagtttaggtttcaggggggaatgccagggacgaagccagggatgaggcaaacaacgtcgaggattcgctgtcggaactatataaattgtggaaatggatgtttcgaatgtcagagtgatctcaaaaaatctggcatctgggaatctgggtcggcgggtagagagagggcctcggagtgccaactctaatttcgtcaaaaattttgtgaattttagcgcataatattttgaatgtttttttaaatttttaattagaataatgtaacgaaatggcaaaaaatgaatgatttaaagacactcttatcaagcggatgacagctttgtgcgcccaatccgttgagggggaaccggaaatttatatgtgtggcacgcaaggattatgagaatttgatggtcaattggcgagcgcgagacggcgccaatgccgacgattcccgacttagaaaaaggtcagaaattcacacgcggggaagcaaaagaagtgacaatggcacataatgcaattttttgattcataatgaagtggtggatgccattttatacaatttataaggaaaaaatttgcaaaaaatatggcaaaattaattttttttaaaaatatcttaaagtaacaaaaagacggaagtattagtgaggatttattgtaattataatataaaaattggttggctaataaatggataaattattttttgggaaaaatggagaattgcgattagaaaaagtaataatgaaaaaaataaattatatacaaaacataatttctaatttaatgtaaatagcatagtaaaagttagttcaaaaagtgntttta

SEQ ID NO: 31751 - DNA, 1149 bp, Heterodera glycines
  misc_feature (40)..(40): n is a, c, g, or t
gatttgatttttatgtaattaaatgtaatgccattaattnacgtagatgaaaagagaaggaaagggaaaaaaaaatcgacttaaaatgtgttagacgagtctatttgatcggactgacaatctcaaatttgggttatgattgatcagaattccattggtctagtcagattggcaaaatgtattaaaaatgtacttatactcaaaatttggttctcatttgatctgatcggcaaaaatgtatttcatttgaaaacaaattggctaataaatttgttaaaatccgaaattggggaacaatgtttaattctgatggacctgatcaatcaaagtgccctttttgatgatgttaaaattacattgaacgtcgattgggagaagagaaaaagaaattgcattgatcgaaatttggatgagttcttttcattttaaacccgaattttgatcaccgaatttatactgatatgagagaagaagagagagtgatcagggaaaaaaaaactgatcagcccgaaaaaaattggccaatttttaattgttaatattgatcagaattggggaagggcaccggaccaggaaatttaattgagaacgaaatttgcgtgcccaaaattcgccccaaagttgaaatctaaccaggggagaacaggaagaatagggacagcttctcgacttggggcgggcagattcagggagtgctgggtgaagtgggccaaagtgatcggagcagagatgcgttcgaattgagtggggcgggcgggctggagtgatcggaatttgggatgctggaaaagggaaattgggattgctcaaaagggctcaagcgcagggagggagctccaggtctaaacctggcgatgtttcgtcggcaatgttcggcacaggcgcagactttttggtggaggcaaaggggaagagattttgagttttcaaataggctaaagcagagttcaattttctattaaattctaatttcaatctttcaaatgcttaagagagaaaagggggggggtgggcatatccgaacggcatcacaatcgaaatgagcagagtaaatgagaagggggggggggggggggaggggcagtagccactttctctttggctggtgctaacgcaacaatttaatggcgatgaagcggagagatatgg

SEQ ID NO: 31752 - DNA, 465 bp, Heterodera glycines
  misc_feature (438)..(439): n is a, c, g, or t
aattatgattttttgttcaatttagattaggcaatcggaattgatcaaaataattgagggattcgtgatcggggaccccaaaaacaccagagaataaatttttatgactatcacaaaaaattttttgcaaaacaaaagggtccccccttttgaaaaaattttcaaaaaggcccactttccatatagcgccggtaatttaataataagccctttttagacaaaaaaaatgcgaaattcgaaaatttgaacttacgattttttgttcgaattcgggtcagaggttcgaaattagtcgtgtcatattcgtggtcagcgaccccaaaaaccccatggctacattttttatgtcttttaacaacaaaaaatccaacccgcaaaagtcttaaatctcgcgcttacgatcaacaattaacatccgatatgccattctatcatatnngcagatactatatatgtatacaatga

SEQ ID NO: 31753 - DNA, 1362 bp, Heterodera glycines
catccaaaacattaaaaatgtaaattattttttcataatttatctaaaagcatgaaatctgagttgaattttcataaaattccttattttaaaatagccaatcacaggaaatgaacgatttgctaagttttgtcataagatttttaagaattttatttatacattaaataaatctataaaacttcgcataataattacaaaatttgtaatatttttcacgaaataattattattaaaaatccagaaaataaatcatttcaattgcagagattttgaaatattttctaaatcttttttagactgagtcattgcataaaaatgaaaggatgcttattaacttctttatttgtatttttgatcagcagcttaattagtattaattatgttggatcagaaaagaaaaaaatggaacaaaaaacatttgaagaaatatttggagaaaaatgggaggaaaaaagaaccgaagaacagaaaagaagagaaataattggaaaattcaataaaataaaagaaaaaatcaagcaaaaaggaaaaaaatattcaaaaagagaatgggaaaaaattgaaagaaaaatagcgaaaaaattgggcacaaatcgcaaatatatttatgaatggaccaaagaattgggattaaatcaaaagaattgctacaaatcaaaaactgatgaagaaaaactcgaaattgtacagaaattcattgaaatgtcaaatgaatttaaggaaaaaggaagaacatattcgaaaaaagaatggaacaaaaattatgaagaaatttgtaataaaattggagttggccttagaataattaaaaaatggaagaatcaatttggcattagccgaaaatttataacggaaaaagaaaaaacggagaaaatgaaaatttattggcaaataaaaggagaaaacccgaaaatgagtgacaaggaaattggaaaaatattgaaaattcatcaaaatagcattttcaattggaagaaacaatttggaaaagaaataatggaggaatgaaaaaacggatgattctaagaaaataaatgacaaattttgcctaaaaatgactgatgaaagtgtgatttaatggaactaaaagaatttctttaatttgtaacaattaatgttgagtagtgaacagggcttggcgtaattatggattacggaaattacagcattttttgaaatatttatcgcaatacttggcatttattttggtgcttttggataaaatttttacaaacaggcgaaaattttttctaattaaattaacgtcatcaaaattatggattattaacaattttaatcaaattttttactaaacattatagaaaatctgcccaattatgcattttattatcaatttaa

SEQ ID NO: 31754 - DNA, 1073 bp, Heterodera glycines
cttttcccctgtcatttaatatgtatgatggattcatgctttacgacgtcatgaaaattatgtgcacttttttccgttttaccgccacttttttttaattccgttttatttaccgcgcatttattatatttttaatatttaaatataatttttctgcttttgttaatgatagtaaatgtgtgccaacatttaaaaattaaaaaataaataaataaattcgtttttatgaagtagaaaggaatggatacaaaatggaaatagtgtactcaattattaccaatatgaaatttaatttcatttcatttttctttaattgtataaaaatttaaaattctcggcaagattaatatagagttagagaagggataaaaaaatgactgaataagccagagcttgttgtatctggggatttatcctaaatttgtggaggatttttagtgtcaaatgaggatttgtatggctccaatcaggatttcaaaattttgagaaacgaactctggtataaaattgccttaaaattcccaatttctgcggagtttgaatttgggtgtcggacggatccgaatttttactttattaaacacaactgggatttttggttttccatttgcaaagctggaaaatcgattattttttggcttggcaaccgccggcggcgggtcgtaaaatggcggcacggacggaaaataaggctttagccctttgtcagcggcagcagttaaatgcgagtgcgttcatctgtgtccacacatatttatgtgtgtatacattgtgtatggccatgccaattttggtcattgcattttccgtccgttttccccattctcgtttcccgtgtgtgagaataaagagggagagaagcgaaaaattaaaaaaatatttctgccggagttcaaaaaatttaatgacaaaataatttacagggccccgaagtcaattttctatgaaatttatatgctaattttatttttcatttttaagatatgaatattatatgtaaaacaaattaatctgcaccatcatatattttccctgtacgaagtacatcaaatagtatgaggagattaaagtac

SEQ ID NO: 31755 - DNA, 1411 bp, Heterodera glycines
  misc_feature (96)..(96): n is a, c, g, or t
  misc_feature (297)..(297): n is a, c, g, or t
taaaagttttcgtaagtttaagaaagatgataaatttttttatcatgcaattcgttaatacaataggtaatgtttattgatgaacaataaataaanaaacggagggactattttaagtttatgggaaacactccaaaaaggcaaagaaaaaatttaattcattttttaatttgaaaaatgaaataattttttatcggaaataaatttgttaaaattttattactatataaaaaaatatttattatcatttttcgcaaatgattgtgttcaaaaggtcggcattaaacaaaaaatcgnggcagcgaaatgagtcaaagaaatgaatgcgacagaaacaattccattgagaaagtgccaacgccgaaaagatcgaatgcctaaaaatggaaatttatttaaggatcggcaaatcgaagtgggtaatgaccatgctctttttcaaccatttatttaaaaaatcgtttttaccgcattgaccatggaatatttttaaaaggcattatgattattttgaaaattccggcaattaattgtctagataaaaattaaataatgaaatttcttataaaatttattaattctttcaaatacgtttttcaacacagaaaaaaatttctatttaaaattttggaattcatattaaacaattaagaagaaaaaaacaacaaatatgttttgtttttttaacgatgcttttcatatcaatctttcataaggaagtacaaagtaataaaattttgacgggggcgcaattcattattctttttcagtgttttccgatgaaaaatgtcggattgagtgaccagcgatcagaaagcaacagcccgattaacctaccgttttactgctataaaaccaatgcccgatcggttttatggcagcaaaacggcaggttaattagagggcgggggcaccagcgcaattaaaccactaattgtttgtttattgtctgccgtcccgcgacatttcctccctccctctaaagtgcaacatattatgggaaattgtcattaaatgaagaaagaattcagcgctttgaattcattccttttgaaattgataaagcgattaatctttttaaaattaaatttggcatatgataattaattcactttgtctgccaatgttggcattcgcatttctaattttgttcacttcttcatctgcttcatcaatgtcagctaagcagcttcattcttttcccaaagtcaccacaattcaaatttccacggaggagggatatcgggtaaataaattcaatcttttttaattatttaaaatgattgaaaaaacacttattcgttaattgggtttagatttatgaacattggacaacacaagcatttgcctctgttctgtcagtatttttgcaagaaatgttcgtttctgttatttgtgctctttttaatgg

SEQ ID NO: 31756 - DNA, 1411 bp, Heterodera glycines
  misc_feature (101)..(101): n is a, c, g, or t
tcaaaataaataaataaatactgtgcaattttatccgagtcattttgtgtcgtcactttttaaatcttaataatacctcggaaaatttagaactgctaatntaaaatttattatttttgttatactttctttttgtgagcagttcaataattgtcgccatacagtttatcattggatcatttatgattattcgggctgccaaaatcatgtacaaaaagcggtcacatttagtgaaatatctatgaaatatttacaaaactgaaatatgtactaaacgtaataaaaattttaaaatggttcttttttggtaaaaaattctttgtaaagggtgaaaatttcgaacttttggatttttgaggcatttaattaagattttcataaaaaattttgctaaaaagattcttaatatgtgcaaaagatgtataaaaagtaaataaaagttacaacccttctgcttcacattagtcctcaaattatgtttttatcgaaaaataaaattctatgcaggttagttgggtttcactacagcactcacaacaaacacaggccttacgctgaataatttgtattatttttctcaacaaaaatttttgctttttagaatatattaatttgttcttgagaattctttcgcttcatttgtagttttgtacacagtaaacacactttctaattgtcattaatggaacttaattattcaaaactgggccaagaagatgcctatttaagctgcaattatcaaaaataaaataattttcttcggttttcccaaaaatggcatattttgccccttttccccccatttgtcttttccatttaatttttattttccaattgctcggccccgttttctgtgctaatgtttatttgaaaaagcaatacggtgagaacgagttccgtattgagtcatggggcaaaacgaactgttcactgaacggaattgacattgcgcagcttggaattggccgaccatgtgaagaatggccagattttggtaaaaagacaattaaaaaataattagccatttataattaacaaaaaaataaataacactttataaatgatttttaagcaaccattttctgtgatggcaaaatacttgaggtaataattaagaattattaattaattacgtttacgtaatttattaggcagtgaattattggggcgagcgaatgcttttcatgcgcgactcaaagcatttcgttgaccgtcctctgctgaaagatgccaaaaaagtggtcgatgaatttaaaaccatttttgatgtgacggaatggaataaattcgtggtcagcgaaatgaacgaagcgcaagtggacaaattggccaaatttgtccaacaaaattttggaatggccgacggtgcactgattgagtaaaatttagaagattaaaaatgaaaataaat

SEQ ID NO: 31757 - DNA, 1088 bp, Heterodera glycines
ggaatggcaaagacgatggccagagagagggacggaggaaggcatcggatggcaatttggggacgaattgggccaaaaatgaggacgaaaatgccctgctttttggaggtaaagcattaggaaaagggcacattctctttgacaatggcaccgttcattcatttattttgggttatcgtcaacgatgtcaatgacaatgcacctcgtttcggacacattctgtacttggtgggttaatgagctgatttcgtattttgctaatgatttttcttaattctctccccgatcacttttcccaatttgtttctttctccgatcacttcctaatttggtccctttttcctcgtctgatcgctttccctgtcccttcttcttccctcttccatcccattctttccttttccgcttcagtccctcaatcggtcgactcccgtcggttcggtggttttccgagttcgaattgaggacccggatttggctgaaaatgcacgaaattggttctcattgagtggagaaggagttgaagaggcggagagattattttccatcgacaaatggacgggcgaaatgacactgatcagagaattgacaggggaaaaggttttctgattaaagttggcaagtaactaatttttggcatcttgtgatttgccagattagtgcgcttcgattcggcatcactgcacaagacgaaaaatggcacgtgcagagcataatgacagtacaaattgttgaagacgaaaacgaacagcggacgaacagaatgccaacagaagcgaggacttttgaatttttcgctttcggggagggaggcgatcaaagaacagaagcggaacttgcacagacagaacagttgggccgagtcccgggccaatgctatgccatgccaacgattggatgggcatggactaaacacgaggggacggaaacggcactgatcgctgatcggcgactgttcaaattgttggagagaggcgaaggaacggcggagagagaggcgagtcgaaatagatcagtaaaaacgtcttggcactcaaaaagcgcaaaaatgttgcccatcagttcaggttgctcttttctgtgccgat

SEQ ID NO: 31758 - DNA, 954 bp, Heterodera glycines
aagggggggggggttgggtccgaaattttaatataaaatttatacaattccacgttttatcacaaggacaaaaatgtgttgggccaccaatcttatttttgccccttttgcaggccgttcaacatcactaagcagcagcacccgcagcccaaaaatgttgaaatgctttgatgaatataagaatactttttattattccaagtgtttcgtttcgctttttttgtgggatttctttttatgttttcttcgcatttttgtgtgttttggtgaataacaaacaaagaattacaaacctcggacccgaattcgaacaagtataaaatttatttttcaccaaagtccacctttattgtccaaaatcgattcgaatgcatggataggccatgaatccctattttctattccattcagtatatttgaatcgattttggacaataaaggtgggttttggtaaaaattaatggtaatagtttagatggtgccacacctttttgacaaaaatttcttgaagtttttaaaagtcgtgcaaacagttatgtggggttttcggggatgctgatactgaaaatgacacccgttttggccaattccgaaccccggacttggattcgaacaaaaatttgaaaattcaaaattcatttttatgttcgtatcattacagaatgaccattctttgatgttgcaatgtttgcgaataaacttagattgtttttaattgatttttgaatagaagtgagaatttcgaaagttttgaatttcaactttttgttcgaattcgggtccgggattcgaatttgatcaaaatgaatcttagattcgttatctgcgacccttaaaaccccataaaacgtgttttcacgacaaattcacctttccctatattgatcctaaatttaaagcggtacaaccaaaactgaacattcttttaccaaccgtaccacaaaaaattacaat

SEQ ID NO: 31759 - DNA, 1350 bp, Heterodera glycines
tataacaaattgaggaactggcgagcgctgtttttggtagttcagccggtagagcaaaggtccgcaaagctaaatccgaacccttacatagtttttcccaaaagcttttccaatcaacattaaaatgattaatgggcaaaaggaagagacttttgtccggcaaagaaatgccacggagttgggagggcttgccattaagacctttgactatcaccaatccttgttagtccattccactttccaccccaaatctttcacggctacaaaagcattaaaattttctaaaaatggtcaaaaccttacgcctcgggagtgaatcgaacccacgccttctccatccagtgaaatgacggaaaatttaaaatgccacaaaacacagatttacaaagcaagcaaattcatgcgaggcattcaactgtcggaaagcgacaaaggaaaggcattggccgtaaaagtcgtctccacgggagttatcaatcgaaccatccatttggccaagcctacggtgatgatcaagcacgagatgaaaatgttggagtttatgaaccagcacgaggacgaaaacccgattgaagagcattcggttgtgaaattgtacggtggcggagaggtggagaacggaagtgcattcgcgatgatttacataatggagtttggtgacagcacattggacaagtatttggagcagtgggacgagaaaattggaggcttaaatttcaaggaaggcaagccgtttgagagtgcttgggccacaaaaatcaagaatgaagcgcaagagttactgcctaaactcgccgacacattgctcaaattccacaaaagtgagccaattaagcacatttcttatcggccaatctcgacacatgacagcattttttaaccttttctaatcttttaaaaatcacaaaagctcttaacactaacggtgcctctgtcggcatcagcggaccattttctttccaaaaaatgaaaataatccagaaaaaattatgaaaaaagtgcataaaactaaaacaaattttctgttttaatatggaagaaataattttttaagcccactctttagaaacaattgatatccgccgctagggaaattggaaaaatttctaattttgttaatggcttcaacaccaaaattttaaaattttgtattatttcggtcaattttgaaaaaaaaatattttgcctcgcgcctcgccagagagaattaaaaaaaggatatgaaaggcgataaaaaacattttataatcgggagttcgggtgttgtgcagcatttcgcctcttttcagaagcagtccatttgcacctgaagccagacaattggattttcgtaaaatctgaaaataagtg

SEQ ID NO: 31760 - DNA, 1656 bp, Heterodera glycines
  misc_feature (81)..(81): n is a, c, g, or t
agtcatgaagtggttgcgtgggttaagcgaattttgcgtgtcaaaaagactggacacagcggcacgttggacccaaagtanatatagtacaattttgtttatgaatggaaaaaatgtttattatccatagtaaacccctatttgcaatttattttttttctatgataggtttccggtgttctcgttgtgtgcgtcgaccgcaccactcgtctggcaaagtctcaacaaaatgctggcaaagaatacgtcgccattttcaaactgcacaacccagttgaatctgtgaagaccatacgccaggcattggataaggtgtctgaattacataaaaagtctaatgttttcaaatatttttgactttagctgactggtgcgctgttccaacgcccgccgctcatttccgccgtaaagcgtcagctgcgcattcgtacggtgtacgaatgcaaactcatcgagtacagtccatcccagcaaatgggcgtttattggatgagctgcgaggcgggcacttatgtgcgtactcacattgtccatctcggtctgatgctgggagtcggggcgcaaatgcaagaattgcgacgtgtacggtcgggagtgactggggaaaatgaccacatcgtcacattgcacgacattatggacgcacagtatttgtacgaccagcacaaagacgaaagttatttgcggagaataattcgtccgttggaggcacttttggttcagcacaaacgcatcgtggtgaaggacagttcggtgagtttgattgcaatcgaaagaattcaacgattgtttaaggtaaatgctatttgctatggtgccaaaatattgatacccggcatacttcgttatgagaatggaattgagataaacgaagagattgtgattgtgaccaccaaaggggaagctgtttgcatcggtgggctaattactcaaatggttgtgctactgaccaaatgaatgtttagcgattgccctgatgaccacttcgacgatagcgatcactgatcacggagtggtggcaaagattaaacgtgtcattatggaacgcgacacttatgcggtgagttaaaccggttgagacgggagtatttctaatttgtgattgcccatgatttcggtttggtggtggtactgagaaaattccccctttttgcttcgtgtgcgaaaaaaattttgcgctctataataaacaaaatttttgggaatgaaggagagggaccgtttgtgcgttaggcgttggaagagggtgcaaacagaaaaagctaaattttcaacaaaaattaaacatttaacttttaagcgcaaatggggactcggcccggtggcgtcaaagaaaaaggcgatgatcaaagatggtttgctggacaaacatgggaagccgaacgagagcactccaaagggatacgtgcccggaatgatggactattccctatcaaaagtgaaggcatgtcacaactcgctattacacatttatatttagacattgccacttttcagcaaattttaaaattcataagaacaccaattggtatcctttggccttcccttttccatgaaagagagctataaaaaatgatgaatgatattaatagacactcggattcctatgcaaaaacttttgttataggccattcatccaatctccatactttaaaa

SEQ ID NO: 31761 - DNA, 372 bp, Heterodera glycines
aagctaagcccacacccattgaaaatcgtacgagttgccattgaccccttttttcttttcttcagttgaccaattctaacaatctttgtaccattcgaaagcttaccataccagaagctgtttctaagctattgcttggtgattagtcatccatttaccaaaaaaattataacgcgagaaaagtgccaaaaagtcgaaaattttaacttttttcttacagttttttttacatgttggagaaaatcattatgatttttatagaataatagagcttgaaagggctttaaaatgacaccagatttatagaatttccgcaccttttttcgtttcggagtcattcctaaaattcgaatctttgagggatttctataa

SEQ ID NO: 31762 - DNA, 1126 bp, Heterodera glycines
  misc_feature (1100)..(1100): n is a, c, g, or t
tctcagcccagtccaacacaaatgttaattggttttcattcaattctcagattcgatgtgatcatgccccccgaactgattagcatggacgaagtcgaatttgaaggactgcatgaactgctcgatgacgtgttgagcgaagaggggatcatgtgagtgacaaacgaacaatctgtggatgatatagccgaacttgcatggacccttttggttcaggcctgggttttacctgggtcaggttcataacagtcacttaaaatttcatggctttttttcgaacatacagggcaaagtcagcatgaaatccgaatcaaaatattagctttagtggacaaatacgcttaattccttggcattctgtcaatgtttatttgggttccaccgattcgctgacccacaaaatgtccaagtctcgaatttgagttttttattattcagatgggcctaaggttaggcaaagggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgcccaccgattttgccatgttttttccattttccatggctctgttccatctccatctgtccttcccgttcagtttgttctcgtcccgttcccattacacggcgtgcgattgcaccggcaatttgcccgcgtggttggacctgctgaagaccaagggcaccttcaacgcgcacatccgttgggtgtcgcccaaatcggacatcgcccccagaaaacttgtgcagatgacgcgttccatccgatgacaatcatcccccgcggggcattttacgtcatagaaattgtggctgggatttttaagaattatctgatttcacccctgaatttcagtgccaaaaatcctgggaatcttttttcgtgtccgatttgtcccaatttggcatttccaaagatttatcaacaaaaatgcaaggatttgctaatttttagctgtttaaaattttggtcctgtaaatcccagcagtcccttcagattaatcccaacgngtttcatccctcacaaacattcacaa

SEQ ID NO: 31763 - DNA, 1255 bp, Heterodera glycines
  misc_feature (74)..(74): n is a, c, g, or t
cgatgttattgcatatgcgaaattgggaaattttcattaatataaatgtagatttatgcgtaaattgtttcatntaaattatgaaaggagtgcagaaaatattttcattttccaatttttgtcaaaaaagttaatttttttattttcaaagaaaaaataataattattattaaaaatgtgccactgcttcttcatttttgcaatcggagcagctcttttgacgaaagttcgtttttctattaaataattttaggaatcgcagccctttttcattttattttttggacatttagtagtaaatttaattgatagcattcatttgtcggtaatacgttttgtttgttatttcggctaagatccccagggttttcggaaatctttggcgcttcgtcggaactgagtcgggcattgtttttcatccgcttttaacttcacttggcattggcacatttcagtgccaagctcagcaaacaatgcccggcaactccgtgatcgatttcaccactccgtcgacgcccgttgccaaccaaacactgatcaaaatcgccattttaaccgcacaaaattccactgattttgggttgccaagaaagaactctgcgctgcgcgattcgggcggcgccattccaatggcattggagcagctgtgggcggaccaaatcctgccaaaaaacgtcaatttctcgtgagtaacttttaattcaaattgccaagtgtaatttccttagttcatcaagtcaaatattgattagaaaagcatctttcaaatattttaccatcgaaaatattctttcgaagtgccataaatcagggatggaattccgaggcaccgaaaaacttacattatttgatatttttttggacagttacagccttttttttttgcggcgcgctttatccaaagaaaatttggggaactggggggaggggtcagacggttccgaaaagcgccgctgggaaaattttagtcatttttaatgcgatttgtgaactggtctttagaaaaaataaccaaatttagcgattttgagcaaatttttaagaaaattaaggattttcaggtccggcggtgccgataggcgccgccgggaaaatttaaaaaaatttcaatgcaatttattaacagaaattgtacaaaaagtgctaattttatgaaaaaaaattccgaaaattccgacattttatcaaaaatttcggaagtcggaattccgaggccccaaaaattttcggaactcggaattccgtgccatccctg

SEQ ID NO: 31764 - DNA, 868 bp, Heterodera glycines
ggggactgtaattatttcaacaaaattcaaatgtcttatatttgtacgtttccatcagggtcgctgaccatggacacataatttgttttggatcatttttatttaaaaaaaataaagaattgaaggtatcgcgtgagcttttttttcaccgggtccgctaaagtaaaaaagtgccaaaaacagtccaaaacaaatcctgacggataacagacagaattgcgctaaaaaggggtaaaccaaaaggattaaatttttctaaaccaagagggctaaaaaacgttcacgttttttactggtcccataaaaatgattttaagttgtactcggggattttctggcgtgcttgaacacgataagtgacatacatttacatacaatttgaatcacacgttaaataagggggggggggggggggggtcggcgcctaattctacgaagggggtaaagccatgtaaatcgacgaccttttttttctttttttttgcttttcaaaaactttttttttgcggcgcgcttttttcaaaaaatttaattaattaccattgtagagagcaagatttattgtacattaaacaaaaaatatttaaaaaaatggtaaaaacaaaaagggggagcaattcggtgatttgaaaaattggacgcttaaaatgcagtatacctaaccctgggaatcacaccctggccgggtctcgggaattttgcatggaattttcaaactgacatagtctgtattcttgaatcaaattcaggcagattaggtaatattgtttggttatgaccgtcaatcacatcagtttcatggaagagtatggcgaaaatcaaaaatccgacataatgtccttcaaaaagttctaagttagaatttttt

SEQ ID NO: 31765 - DNA, 1502 bp, Heterodera glycines
accatcaaccagagactgggccaaggtcagcaagcgtacttgcaaatgtgccgccaaatcgggctcggagaaaccggagagcacttctggattcctccgcagttcctcgttaagagcaaggaagagctgatagactatgtctatcctaacttccaacaactccttggcaatgacaaggagctgctcaatcgtttgattctcgctccacacattgacacgtgcgacgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccatttaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggacaaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacttcagcgcggacgactgagtcccggggaccgatttctcactttttcttgcagtttagggcccctaactttttttctaaaacccgaatcaaaaagtgcccgctgagagggcactccccacaactgtcctctacatgctggtattttttatttttttattagagccaccccctggcctgcacgcttggctaattgaagtgtgctcaagaatgtacacttcagtaccaggcgaataactcgcccaggggttgctttgaccgaaa

SEQ ID NO: 31766 - DNA, 962 bp, Heterodera glycines
tttttgccttaagccaaatagtcaaaatttttttaatattttttcggaaataataattattaatttccataataatatttgtattgttttatatttttttatttcttttttatcagaaattttgtatagaattaattttttttcttgaaattttaaaattttttattacttttttgttttccaaaacatcttttttcacgtcgctcttttctaaagacttaaggagaaagggtacggcgtccggcggtgccgataggcgccgccgggaaaatttttgaaaatttggttagatctgttaacagattttgtccaaaatatgctaaatttttgcgattttgagccaatttttttaataaggtttatgactttttgggccctgtgatgccgataggcagcgctaaattttggaattaagctctactttcttgaaacttaacgaaacttttttattttgtaggctaatagaaaacacttagacctatctaatgatatcaagaattaaaaatttagttgcttttgagcaaagttatatcaaaattttcatttgatggttttttgactaacgtcatagcaccatttggacgggtagagagagagagagagagaaaacgggagaaagaagagggacagaaggagcgagagagatggagagagagagaaaacgggagaaagaaaagagacagaaggagcgagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagagagaaaacgggagaaagaaaagagacagaaggagcgagagagatggagagagaggg

SEQ ID NO: 31767 - DNA, 1369 bp, Heterodera glycines
aaatttctttgaatattatactatcgtgctttttgctccttttcagtttattataaaaaaattcacttcccttcgaaatcgtaggcagaatgctcatttgaggctacgcaaatataaattaatatttgctgtcgccaaaagcgacacaaatttcttggaaattttcatttattttttaatccttttcatcgatcaattttgcattcgctcgctcgttaattatgagtcatcttctctcttcctcatatttttatggatttttttctatttgtttgtgcacatttttcacgtgcctggccccgcccccattgatttgtgagggtataaaagcccggcccattctccattttcctgacttcttgcttcttgcttctcacttcttgattcacttcatcttgtgagatttctacaagcacttctgcttgatcagcattaagtcgggacagttttctgtccaagcatttgcattaaattgtaattgtgcaattgaattgaataaagattaagaaagagtcttagtcttttctctatctgtaaaagggacacccaggagccctttaatacagaccattaagccattgacccccgttgggtcacaaaaggcttatcaaaggaaaggagaaggatttctccttccaaattgtcccttcagtaaaggagaggaatttcctcctttaattcgtccctttggacattcagtgaatttctgtcttttggacagaaattcgctttgcttaaaagactccccccttctgctgggagagtctgcttccccttctgccgggaagtgcaaatttttgtggctttttgcccacaaaattggagccccgtaggggtcggcttccagtcgtaagcctaccctccaacaaacgccaatccaaagcgcaaccgtagcgcttggatcaaacgcacaacccaaaggggtttattgcgttttcatcaagcgtaagagcaatgagtgagctcttgcgtatctccattgcaccaatggtggtgcgtctcaagatgtacattgagacagcccaagaaaacttgggcaaagagctgacggaccaaagtgtccgtgcagacttaattgcagagagacaaaatctctgcaaaaccatttctcttcttgagaaatacaatggaaaatgggaagccattttcctgagagtgaagggacaagctcttcaagatgaagagcaaaattacagagacttcaaaccagaaggcaaggccttcatgcattgggtcgaccaagcccgagggcttgtcgacaccattgaaggggatttaggcctctcggagctgggggatgcaattccccagccaaatcagccagcacaaatgtgcagcaggcaccagtggtgcatcagcgtcatgatgt

SEQ ID NO: 31768 - DNA, 1023 bp, Heterodera glycines
attctccggcatttcaatcactggggactcaatccacctacattccaatcaacgggactcaatccaccacattccaatcaacgtgactcaatccaccaacattccaatcaacgtgactcaatccaccaacattccaatcaacgggactcaatccaccacattcaagtcactgggactcaattctcccgaattcaaatcactggactcaatctcatcaatccttcagcaacacaattaccgggactcagttctccgacatttcaatcaccggaactcaacctcagcaacggaatacagaactatttaaaagtaatccagaaaatgaaatataacccataataaatcaaaacactatggtgtataattattgcccccaccccataaattcaaattaaaactgacctgtttaaaactttccacctaaatttgatcccgcaagtggcacgtcaatatcccaattgcatataaatattccactcgagcacaggcaaaacatgagatgtagcatttatattgctttttctatccatcaaaggttttttctttcattttttattactacaatcagattcttttcatatataagcaaggaaaagtacaaaaaacttttttaagtaacaaacctttttcattcaaacaaattctaatgcattttttaaccaaacaattctccattatcgtttacataagcaaaacaaaagctttcacatcaaaatcaaatcaattaacaaaaacaaaatttagacaaaaaaataatgataaacagcaaaaccacaaattttttcttacacacaaaaacagaaccttcatataccggattttccactcaaacaaacaaaaaatgtgctaattcttttgttaaatattttatacaataaaaaatgggttataaataaggaagggatgcgagagaaatttcccattatctctcccttccatttcttttctcttatttcttttactttccacttattctctctttttgtccactccctccttctccccacacacaagcacgcgtcc

SEQ ID NO: 31769 - DNA, 1506 bp, Heterodera glycines
accaaaaatcttccaaaatatggaaaaattcgatttttctgaaaaaaattcagaactcccttctgaaaaagtattttataaaaataatatactcaaaaaaatccgcaattttttgctctattttataaattttaatttagcttattatcacttttttgaaaaaagttatagaaataaaagtgattttggcattcgggaccaaaggggtgtgaccatgatttctgagtggaaaatttttttcaccaaaaatcttccaaaaatatgattttaggggttatttcgccgctgatcacgaatatgtaatcagattttactttagacatggttaagacctcagaatccctgtgtgatttgggattctgaggagtgggagcgcccgtcctgaggccgcgaagcggccgaatgtcccccaaaaaattaaaaaacgggcgcgaagcgctcgtcctgaggccgcaaagcggccgaacgtctcccaaaaaattaaaaaacgggcgcgaagcgccagtctgaggccgcgaagcggccgaatgtcccccaaaaaattaaaaaacgggcgcgaagcgctcgtcctgaggccgcaaagcggccgaacgtctcccaaataatttaaaaaacgggcgcgaagcgcccgtcctgaggccgcgaagcggccgaatgtccccaaaaaattaaaaaacgggcgcgaagcgcccgtctataaaaataatatactcaaaaaaatttcggcattttccgtttttcgcgaataactcgctgggagttaagcggagcgggttggcgccgcttgtgcatttgtgtagtttttaaagctgcatccgatggcgttttcagattttgaaaattttcaaaatttttcgagctaggccccctcgaaaatttttcgtttttgaattttatctttttttgcagatttttcccaggaaaacggagaccactttcaagcaaccgttttttgagctctatcgattggtggcatttttgaaaaaatttcaaaattttccggaaatagaaaaattttttggcctgagcgggacatttcagtcccgggctcataactcgtcaggggttgattttagcgaaaaattgtcttagagcatttttgtagagaattttaagctctatctaatgtgctttatccggtatttttatctttaatataaaaaaagatataaaataaaaatgaatttttaaatgcaaacccaaaggggggaccccatggatttgcatttcatgagaaacttttttgctcctaaaattgccaaaaaatacttttctgggctaatttgaggtgctgaacacgaatatgcactttatattgcgttttggattttttggagggtggtaaaaaaattttgaaaattcaataatttttggcccttgaaaattcaacctaaattttaaaaattcataactcgcctcaaaatggtccaattcagctcatttaaagcataaaaaatagcaaagaaggcgggagaattttatgagatttatttgaaatttatacca

SEQ ID NO: 31770 - DNA, 1327 bp, Heterodera glycines
tttattggaaagtaaaattattattttttttatttaagacaaactaatgacccatttcttttgtttgcttaggctaattttttgataaatttttgcagtttttaagcgacaaattaattttaggctaatatttctgcagctatctaaataaaactgacgcattaatgctgtatttaatcagaattttttgtctcattattatcaaaatggcgtcatttattttgtttattattttgattattacgaaaggtatgaaattggtttaaattaatttaataaaaaataaaataaaaaatttaatttagctaataactcaatgggacaggattctggtactaatggtaacacgatcatatgaaatattaagaaaatggaataacactaattatcaaataaaaaattcatttaaatttcatttttttctatgaaaattttcatttaaattaaaacgaattgaaacattttaataattattaaaaaataaaaaataatgaaatattaaaaaaatatatattcaataatatatgaataaacaaaggtatttaaataatttaatattttgttccttataataaattttgacatcaattaaaataaaaatcttttcgattgaatcattatttttaaataattaacctaataaaattgatcagttgttcctaattaacagatgtccaattaacgttggtcaacggttgtccatacaaaatttatgttgccggtgcggtgcaagtgaatttgacggtcaatgaaagacaaacaaaaaatgtgccgtcagtgagcacagcgcaacgattatgggccaacactgactgtgacagcgaagtaaggaataattgctcaagagtcgagttctcgactctcttggtcaattcccgattttaaatattaagacaaatttcgggcccaggttcattctctctatttgaaaaattgtcggtctcgacaataatcatcattattggaaaattgttggtcttatttttaggggaattctcggtattggacaaattgtcagtctcaaggtaattctcattcttgggcattatcagtatcaatattgggacaattctctgtatcaactcttgagacaattacctgtcttggaataattgtcggtcttttttttggcaattctcggtctgggttaattgtcgatctcgagaataattctctttcttgaacattatcggtccgagaggtcaatgccaattttcgtatccgtctcgagtcttggaaattttcaattgtggaatagcatcagaaatcgttttacttacaagcaccattaagatgcgtgccgggaaatttcgacagtggctgattt

SEQ ID NO: 31771 - DNA, 984 bp, Heterodera glycines
aaaacggttcagaaattcaataaaaaataacattcccgggtgcgaaaaaatggggtttgaaaagtttattggggaaaaaaagacttaccaaaataatacccctgggagaagggagtgggaaacatgatttcaaaattttcaattttttttagtctaatttactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattgggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttaaagggtaatctactcaaaacggttcagaattcgataaaa

SEQ ID NO: 31772 - DNA, 1076 bp, Heterodera glycines
tttctagatgtatacaaacaccctttaaaaaggtcaagaatttaactaaacaaagtgaagatcagctcgttaaattgaatattacatactcgtatagaaaattctgaaattttcatatatgctctattttattacaaatttccttctgtctttattggatttttactggcaaaactgatgttaaataggttttatttttattaattgcagcttttcgtattagaacgcgtttaaaaataaattagaaccgggaatcttgtcaactgtaaatgccataaaatcgatttatttttcatttccacaacaaattgatcgcaattgcaacaaagttataaaatttgcaatacaagtgagaaaattttgatttttcgctaaattttactaataaatataattgacaattctcgacctatttttagaaacatacactaattacagtgtcattattttggttcccacatttaccttaattatccacatcctcaacaaaagaaaaaacacaattttgtccacagtgtagttctgcggcaatatgtagtttaaacctgagccattagtcatttaaaggttggctttatttttcattatttttcgtaatacggtctatcttttctgcagtaatcaacattcgattgttccattttctagatgtatacaaccaccctttaaaaaggtcaagaatttaaataaacaaagtgaagatcagctcgttaaattgaatattacatactcgtatagaaaattctgaaattttcatatatgctctaatttattacaaatttccttctgtctttattggatttttaccggcaaaactgatgttaaataggttttatttttattaattgcagcttttcgtattagaacgcgtttaaaaataaattagaaccgggaatcttgtcaactgtaaatgccttaaaatcgatttatttttcatttccacaacaaattgatcgcaattgcaacaaagttataaaatttgcaatacaagtgagaaaattttgatttttcgctaaattttactaataaatataatagacaattctcgacctatttttagaaacatacactaatta

SEQ ID NO: 31773 - DNA, 1953 bp, Heterodera glycines
ctgaaaaaggagttcaaaagcgactttgaagaactgatcttctttataaaatgcaaaaacagccatttaaatttaaatttactaagcatttctttgatgcaaacgcccgccgtttacgatgccaaccaaatgcgtgccgcattgtccggctccaatgagtgagtacatttacaattgaattgggataaagcgcatgggaaagaacttcaaaaaggaacgccagtagctcaacaggtttaagtgatagattacggtataaacgccataatgaccacaggagaaacttagctatttgttttggctaaatttaatgttcatataagccatcgaattgatggtggattctggttacagtttacctcatggcttaccgtatatacatttcattacggtgttaccgtagggcggtgctaatcgaaattttggcgacgcgcacaaaccgacaaattacggcgctgaagcaggcgtatgagcagttggacagaaggcatcagcacaatcagctggaggaggacatcaaagcgaagacgaagggctccttccaaaatctgttggtgtctttgctcagctgctctcgcgaagaaagtgcgcccgcaagcattgtattggcacacgacgtaattagtggcaatgaattaacatatacatattaagtggcaaattagaatgaattaataaaataattacaattaacatataataaacaaaacatatcacacggctaattacatggattggaaaaaaataaaattattaattagtatattcaatatcacatatatttaattatatttataggtaaaaaacaaaatatagaataaataataattattattttggtggtgataatttccatatatttttctcttctgcaggaggccatgaaactgttcagagagggcgagggccgacggggcgttaacgccgtggtgttcaaccaggtgttggccactcgcagcttcgcccaggcaaacaaaacttaacaaagcctttgccattaccagacaataattaattaaaataaaatataatcaattatttatagttgaaaatgtttcacagttttaacaatttgattgcaaataatttgttaaaaatttcagcttcgggaaactttcgagttttaccgacaagccgcgcaccacgagattgaggagggaattaagcaagaattcagcgttcacaacgaaacggggtaatgggagaaggggcgggaaccaattagtgatgatattgtacacgagaggagacagtctaattaggctaattggatccaatgtttataaatatttggatttttaatgtcatttgctgttaatgctttcattttcagtttcttggcactaatcaaatatgtccgcaacgcttctgtgttttttgcggatttattgttcaattcgatgaaaggtaaatttaataattaatggataaatcaatatctattaatcagaacaatttacttatttaactgcattaattatttattaatctctctgctttttcagggctcggcacacgcgactcggatttgattcgtctggtcatttctcggtctgagattgacctggctgacatcaaagtgctttcaaatttaaattctgttaattgaatgttcaagaaatcaaaagccttaattaattcttatttatggatttaacaataatatttgtcatcccattaagcacgcttttcacacgttgcacaagaagagcctggaggagtcgatcaaaggggacaccagcggagcttaccgagacgcacttttggcattggtcaagggcaacacggagcagtgatggagcagcggcagaagggattttgcaagagattaggatagattaaaagagataaacatgtaaatccaaaaagaacctatggaattttataaataaaatttgaatattttcattttgctaaatgcaccggagtctttcataaaaccagtgcaaacta

SEQ ID NO: 31774 - DNA, 1421 bp, Heterodera glycines
ttgatcaaatccctaatcagggggtcaaagcttccaagccacttaaaataaattaattagatgttttttagagataataaaataaaataggtaaataaaatttatacaattaagaaatttcagtgccttattttcgttgtttagttttgaccacttataaatcggcatcaaaccgaacaattttggtataattcgaaaggatttgaaaaggagaatcttttttaagcgaacgctaaacaattttgcacaacaaaaagttataagacaggctatgcctaagctttaggcttaagtataggctaaaatgtggtggtgaacagcaacaggagcgcagttccattcacgtgggttttggagtggaggtaattggagaaaatttctgaaaatgtaaaaattggcgatcatacacacagccagtaatcagctaacagtaaatgatcgctgaccgtcatttcatccctggtcgtttcgttgcctaagccaaaatgagtagtttttccccaatttttttaaaaatgatattaatttattaataaatttaataaagcaaagggcaaagcgatgtggtttaaaaaaattccctcattctcaaactgtggtggtggtggaacagcagcgcagttccgttcatttgggtttttaaccaaaatcagggagggggtgggaattttttctgaaaatctaagaaattaatcatcaccggcggagggaagccatttcagtacaaagtacacacacagccaccaatcaccaaagtgatgatggacttttgctgcagtgaaacaggaaaagtggtaaggtacagatacaacaaacatataatgatgattcattcattcgtttattcattcatatttcgcactcccatctccttggccccgccgaggccccggctttgttggccgggtcaaggttttgacatttgtccggccccgctttcttggccaggttctgggctttgaatggtcatgtacctcgggctctatgaatccctcctcaaaagggcaagaaatgttggaaattatgtgctcaaaattcgaattttcgagtctctcgaaaatcgagactgacacttaattctcgagatgaaatcagcaggacaccaaatgttcgagccttttcatgatttgagaatcaagaataaaaattttaatgcgtacgggcccaagaaaccaaggcctccgcattagaaattagaacatttatttaaggatttttgtttgtttttcaacaatatgggcagggcaaagttaaatcgtattgcaaaatttgtattaaaaggtcactctcggcgtgcgatgtgaaacttttcccgctgcgtcagtgcgcctcctttgtttgcacttggccaagcccatttacgggaggaatgaaagtcataaaacataatttttcatataaatctttgatgaatagccttt

SEQ ID NO: 31775 - DNA, 1216 bp, Heterodera glycines
ttctttgtcatgtctgcctgaatttaaattttactcggttttctttaatgttttgtttcgtggaatttaataattagctttttaagttttcaaatttttttttcttaaaataggttttaatttggagtagcatgggaccacccaataataataatttaattcaattaaagtttcgtaataaaattgaggactatttttaaaaatggttttataatttttgattaagccaggtatagaacaaatttccttttttaaaatcagcaattgttcgatgttccgtcaaaactctgaccatttcgggcacattgaacagctcggaggtcaccgaaaattcatcagcggtgtgcataacattcagtgttcggctgcttaatgtgctcgcgtagcaaatgcttatactaaaaattggaatggaatatttaaatatatatatatataaatattttttaattttcgcttaatttcgcaatctgctgacccttctttgtcacagcttccgccattcttcgggagacgaaattcgatgccgaatgttttcgattcctcagatgggaggcattggtcaaaaaggccgagttgtatgtttgcccagctgcttttttggccagtcaatcgaatcctattacatacatatttgaaaatttattaaatataaatttttatttataaatttatttttaaccattgctgggtgatatagtaactttgccatttgtttcaaattatcttacggtttaaaattatcttacggtattgtttccatttgtgagttgacgccggcagagagaagcagcaacaatccgaaaatgttcataacagaatcaaagcagaccaaagatttttcacacatttttctccaattttatattatttaaaaaatgaatattaaaatgaatttggcttaatcggcgactcaattaaattctgtgcacacactgtccaatggaagcaaaaatgtgctgctgggatgagacggacaaattcaattcggacaatgaatcataacgataaaatgggactccatttttgatttgtcaataattctctgatatttttcccattttttgtgatgctaatttagataatttatgtttggtgtgttaaatcagcattagaaatgctaaaatagtgattaatttaatgattataactgaggtcattctttggtataaaaaaacggaaaatgagaacctaaataggtaaaaaaaacaaacaa

SEQ ID NO: 31776 - DNA, 724 bp, Heterodera glycines
gtaacaacaacctcagagcattttgggtgggtcagtgcaattggttatttgggaaaggattgccaaaggcaaggaacggcacagactgacccaccgcagacatctcgcagtcctcgagggggaaattgagtggatttatatactggcacaatggggatggatttggatagcatgaggggtaatgacggtaaaacacaaagggaataagagagatggatggcaatgcaacagaggtgaatgggatagaaatggcacggtaaatgagagggaaggattggcttgggattggatgaacagacggacaagtttatgacgggattgggtcggggaaatagggcaatttacattatgcacaaaatatgaaattttgaatgctgcggatacagcataaattttgtcaaaaatagatttatattgctgataaattagagtgctagtgcgtttcttaaaactgccttccctaagcctcatttcaaaaaactttgaaaaatttttgaaaagtaaaatatttttaaaaattaagcgaatatattcaaaatttagagaacattaaatatataagaaattttattaaatttttcaatgaaattttctgaggttttccaaaaatataaccatttagggctaacaatactgtatggctaaattgcattttaattttcttcaatttagttttctaaaaattttaagaattctcgaaatttaaaaatatttttcattttaa

SEQ ID NO: 31777 - DNA, 681 bp, Heterodera glycines
  misc_feature (305)..(305): n is a, c, g, or t
  misc_feature (308)..(309): n is a, c, g, or t
gggggggggggggggggggggggggaggggggggggggggggggggggggggggggggggggcccgcccccaacaccccaacaaaagggaagggagagaggtgctgggagggcgcccccccccccccccccccccccgccgccggggggggggtgggggggggagggtgggggtgggggggggggggggggggggggaaataacacacccccccccccccccccccccccccccccttcttttctttttttttttttggggcggggggggggggggggggggggggggggggggggggcctcggngtnnaaaaaaaaatataaaaactttttttttttttttttttttttttgttgggggggggggggggggggggggggccgggggggttttttttattattttttttttttttttttttttttttttttttttcccccccccccggggggggggggggggggggggggggggggggggggggggggggagggaaaaaaaaaaaaaaaaaaaaaaacacaccccccccccccccccccccccccccccccctcctcttttcctccttggtgttttgtggtggtgggggggtgtgggggtgggggggttttattttgtttttttttttttttttttttttttttttttttttttttttttttttttttatttttttttttt

SEQ ID NO: 31778 - DNA, 515 bp, Heterodera glycines
aaaaaaaaaaaaaaaaaaaaaaaaaaaaaaaaaaaaatattttttttttctttttttttttccccccccccaacaaaaaacaaaacacaaaaataaaaaaataaaaatataattattattttttttttttctccccctcccccccccacccccccccgcccgcccccccaacaaaaaagagaaaaaaaaaaaatattttttttttttttttttatatttaaaaaaaaaaaaaaaaaaaaaaaaaaaaaaaaaaatattttttttttttttttggggggggggggggggggggggggggggggcggcccgctccttcttcttttttttttttctttttttcctttcttcttctccttcttgtcgccgcggcgcgcgggcagaaaaaaaaaaataaaaaaaaaaaaaaaaaaaaaacacaccacccccccccccccccccccccccccccccccccccgcccccccccccccccccccccccccccccccccccccccccccccccccccccccccc

SEQ ID NO: 31779 - DNA, 1775 bp, Heterodera glycines
  misc_feature (959)..(959): n is a, c, g, or t
  misc_feature (969)..(970): n is a, c, g, or t
  misc_feature (1004)..(1004): n is a, c, g, or t
  misc_feature (1007)..(1007): n is a, c, g, or t
  misc_feature (1011)..(1016): n is a, c, g, or t
  misc_feature (1020)..(1020): n is a, c, g, or t
tttgtttttttttttttgtttaaaaaaaaaatataaaaaaaaaaaaaaaaaaaaaaaaaaagaggggggggggggtgtgtggtgtttttgttttgtattttttgttgggggtggggggggggggggggcggcgcccccccgcccgcccccccccccccccccccccccccccaaaaaaaaaaaaaaaaataaaattttttttttttttttttttttttttttttttttttccccccccccccccccccccaaaaaaaaaaaaaaaaaaaaaaaatcttttttttgggggggggggcggccacacccccccccgggggggggggggggggagggggggggggggtgttttttttcttttttttccgcgggggggaggagaaaaaaacccccccgcgcccccctctcctttttttttttttgggtggtgtgggggggcgcccccacccacccacttttgtttttttattttatataacaccccccgccgccccccccccccaccccccccggggggggaggagggacccccctcccttctaaaaaaaagaaaaaaaagaggggcccccccccgcgggggggggggccccccccccgcggggtttttttttttcctctcccccccccttgtttttgttggggggggggggggccccccacccacgggggggggggtgttttttttttttttcctcgggaagggggccgccctccccccggggggggcgcaagaaaattttgggaaaattgggggggttcttttttttgcacccccccctttggggtgtttttccccggggtgtggggggggggtttttttttggggaaaaattccaaaatttttgggggcccggttttcacaaagggggggggggggggggggtgggggccccacttcccccaaaccaatttgggcccactgggggtttcaggtggcgttttcggggtgaaccccggtcttnggctttctannggtagaccgctctgcgacgaccaacggtgagganganggannnnnngggnggatgtactaacaccgccagcatgacaggtttcttacggagctgatgtgtgatccctgccactgcggtgtggggcgcaacatagtcccgtctcgatcgcatgcgatggggcggagacagagcgtatgcgctgagacccgaaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaacccgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagacctcataaaaggtgttggttgatatagacagcaggacggtggccatggaagtcggaatccgctaaggagtgtgtaacaactcacctgccgaatcaactagccctgaaaatggatggcgctggagcggcccacctataagccaccgtcattggcttgtacacgtgcttgtcgctcagggggaggcatgacgtgtaggagggtcgtggtggttgcgttgaagg

SEQ ID NO: 31780 - DNA, 1045 bp, Heterodera glycines
  misc_feature (936)..(936): n is a, c, g, or t
  misc_feature (992)..(992): n is a, c, g, or t
ttaataaatttctaaaaaattaaaaaaattaaagacaaaaaaaaaagaaatttccatttgaaaaattaataaaatttgcttaaaacaaacaaacaaacaaacaaatttttaacatagcaaaaaaaaaatggaaagaaatttagcaaaaccaaaagtaattaaggcttaattgaaggggaattaatgaggtggaataattaatgggtgcactccaaaatcactcactccgctaaaattaatgagttgtgggctattaattaattaccccggccaattgactcttctccaattgtgggcctttgattttggcgagcagaatgccgagtttgttgatctgctcctgaatgccatgctcaaagctgacgaccacaaattgggctgccagtttgtctaacacattgttaagcttaatcaaattttattttttatttttttgaaaatatttaaaaaaattaaaattatttttttaataattttaaattatttgatggtcccccacctttttctgcaaattgttcaatactttgttggaatccgcatccaaatttggtccacccatgttctcgtaaattttctcaagttgtaccctaaaatttcaaaattaaaaaaattacattaaattcgccggccaaaatttcgcggccggaatttttttttaatttagaaatttaaaagaataaaaatcagaaaaaaatttttatgaaaattccaaggaaaaattgttgaaacatttttacgattttttggaaacattctcgaattaataattcatcataaatttgaaaaaaaatcgctgaaaattttttaaaatctttttcttaaaattttcttataaaaaaattctaagatttttgttgaaaaatttctaagttaattaattaatttattttttaaaattttggcggtgaaaatttttaatttcaataaaacttttanaaataaaatctttgtgccatttttttttaccttaattgctgcacattattcatcanaatgcatgccaatttttcactgctcacaaatttgacaaaatcttcttgcacca

SEQ ID NO: 31781 - DNA, 454 bp, Heterodera glycines
acctcaaaaaattataacatattaaaaatttaagcaattaacgagagaaaaacccttttaattaacataagttttataaaataaaatttaaaaaaatttaaacaacgcaacaaaagagaataatgaaactgacaacaaaaattaaaagaaacagattctttaaaatgtcgtgccattggtttcgtgatgtcgtggaagatttcccgttaatgagaccaattagtgagtcgcatgaaaaaatgttaagcaatttaaaatttacctaaatattttgttttattagaaaaaaacccgtgaaattggactcatttctttttaatgataaacaaatataaaagtttcacgaacattttaatgaattacaaagatttttgtaaaatttaagtagtgccatcggtgagagataaatactttgatatgagaccaatttaattactatgtttatgaaatctaa

SEQ ID NO: 31782 - DNA, 605 bp, Heterodera glycines
gaaattggtcaaaatgaattcagacccagcaaatccctatgatgtaccgtctttttagaataaacatttttcttccaaatagttgccatcatctatagttctagccgtgcggagaaaaacgggcggcgaaaacgaacacaaaaaatgagtgtcaaaaaaacagtcggcaaaaacgaatgccgaaatgctcggtccccaaaaaatttatttgtgtgtttgtatctatacataagaccattttttgacgttgcaatggtttttgacgacatttagcttgttttgatcaacttatgaacaaaagtaaattggcaaaagaaaaataaaaacttggaatttagtcaatgactctaaaatagccaacttaaaaaaataagtgaatttaattttaaggcctatccgatcaacaaaaccggcgaaagaggcctttgtttgatcataaacaacgttcacttcttggaccaaaaaaattcgaagacagacgcgggtcaaacatcgaccaggaacgtttcaaggccttaatggaaaagtttggatacaaagtgtttgaggaggttgaccggacgaaacaggtgaaaatttacagccaaaaatgccttttcattgat

SEQ ID NO: 31783 - DNA, 1287 bp, Heterodera glycines
  misc_feature (1189)..(1189): n is a, c, g, or t
  misc_feature (1207)..(1207): n is a, c, g, or t
  misc_feature (1214)..(1214): n is a, c, g, or t
  misc_feature (1222)..(1222): n is a, c, g, or t
  misc_feature (1268)..(1268): n is a, c, g, or t
atcattgttaataaaaattaactatccttacgaaaaaataatacaagctaaataacaattttttataaattccctgtatagatattaattagaaataataacttcattgaaaaaataaatttatttaaattatatagctcaataaaaaagcaaattttaatatattattttaattctacacaaaaagatttctgaattatattgaacttttttaatttgaaaaaagagaaaaaaagcaaatatttataaattaaaataaaaaacacaataataatattgttattttgcgccaacaaatggctaattattaaataaaatctgcattcaaatttaaatttgcttattaaaccattcatttttatataaattaaaaattatatgctgttttttaccgatttgtcgttgttgacaaaatagggaaatgttggggggggggatcaggcggtgccgatatacaccgccgggaaaaatattgaaaaattgtgtgtcctttgttaacagttattcaaaaaatgaccaatttttattgcttatatggtttgtataaaactattcaaattttcagggaatatagattaaacttcaaaatttcttatggggatattgtaaaaaacgaagaatttttgtgtaaaccttaatttaaaaaaatattattatatatcatattagtattttcgctttacaattttttgttataccacttcaggaccaacaacatgtatcggcactgcaaatgagaccgcggttggaaaaattatgagatttcataatatagatgacattgaaatggggccggttaagcatgatttttcacgtgaattagatgaaatgggaaaacggaacctgattgaaaaagcattgagattttatagttttaaaaccagagttcccaagtgtgcttatttctaagatttgtgcttattttgaggggtcggatcttagaaagtaaaaatgtgcttatttctaagatttgtgcttatttcagcgttacgtgcttattttgtgcttatttttggatttgaaaataaaaaatgaaaaatttgaatgactattttgatttttcatttttttctgaagcgaatatttgaattaatttgattttaaaaaaaaattacattttatttcattttttgagtgaaattcacaaaatgccaccaaaacgtaaacatgtttatttggaaagctacgncaaagaattccggcatantaagaanagtcgaanaggcgaagaaaattgccctttgtgtcgtctgcatattttttcatanaaatgggctcaaatctcaa

SEQ ID NO: 31784 - DNA, 1066 bp, Heterodera glycines
gcgcagataattgacaattttaatgattatgagtaggacaaaaagagtgacgaagccaataaatgcaaacaatgcgagagatgggtgaatgctgctttcttcctcatttttgccaaagagtgcgtccattccgaaataaagggcagaggtgccaataatgggtaatgacccttttgccatcggttttaaaattcctcccttacccatttttcccttggggtgcgcctcagtatgggacaggaaaacgagggtcaagatcaaaatcacataaacagtgggaattgacgagggtgaatgagggcgatcaggttcattctccgggttgggctggttgctggaattggcagggagggaaaggcgacgaaaaaatttacggaaaataaaaattccaaacaacagtaaagctccaataaaaattgttagggtcataatggcgaagaagaaccaaaagttgtgggaagttgtgtcttctggtgggtgctgatgataggccaattcaagcgcgatgatatttcccattgctgatggttgagttgatgaagaataattggatttgcttataggagtttattatataaggtgggaatcgcagtgattgtaagatgataggccaataatcgggaaaaatttaaacaaagcgtgtgaccggggagtgattaaggtgaggtgcggaaaggaagagaaaaaattcaatgctttaaacattgtgaatgggaaaatgtaaatttaatgtcataaaggccgtgatcggtggaataagccgtgtgaataaattgcgatagcatcatcccgtcgctaaagaaaattaaatcagtgatttggtactagtggtggttggagggcccaagtccatttctttccggcataagttttggcacaagagggggatggtggcgcattggccgggttaggtttgaaattgggagggaattttgcccaattatatttttgtggttgtgcttcgacgattggtggattacggttacaatattcatcttctgtttccaacgggtagagatgactcactgatctgttagttatatgaccggaaatagtttttattttt

SEQ ID NO: 31785 - DNA, 865 bp, Heterodera glycines
  misc_feature (847)..(847): n is a, c, g, or t
cattttactaagctcgtcgagccgagtctaatggtaccgaaaatcaacaaatctgttcacttttcatcaaatgccgtaagtgtcaatttcgatgaccactgattttttcaaaaaaaaaaattgaactattggaatttgtcgtaaactgaacagatttgatgattttcggtaccattagactcggctcgacgagcttagtaaaatggtacctcattcgcacggttttgtccacttttcgacaaataccgaaagtgtcaatttcgatgaccactaattttttcaaaaaaagtgacactattggaatttttagctaaaaattatttcagtttttatgacccaacaacccaaagcaaactattaagcgtttttggctacaaaaaaaaaacgaaaaaatatttagcgctaaaaagaattgttcaagttaaaattctattagtaaatttcataaaaatttaaatgcaccgaattgtccgagttgagccgagccaacatcgcttgtcactggtcgatgtgagtggagccgtccaaccaaacaatttgtagttgtggtaggacagaaaagcctgcaaaattttattggttattgaaatgtttaaattcagggcccaacatgctaatatttttttaaaaaatccaagcaaatttttcagtaaaaatatgattttttgcgaccgaaatttggtgatttatgacgctcaaaattcaacagaaaagcatttttgcttcctactcaatattaatgaataatttacgcaattgtgatgccaaaaacataaaactcgaaggaattttcttcaaaatcttttactggaaaatttcctttatgggttgtttgttgggctcaaanatttaacagaaaagcact

SEQ ID NO: 31786 - DNA, 1666 bp, Heterodera glycines
  misc_feature (34)..(34): n is a, c, g, or t
aaataagatcagtgctaaactccgtggtttattnaaaaaatattagcaccaatttttgattttggcacccttttcaaactttttatgaaattcaaaaaattgactaattgtaaggttgaaacaaagtcttggtaattttttttaaatataaataaagatttaaaaattatattatttgtttacttgcatgacgtggtccaccacccattcctgttcctgcttgaacacattgatttgctgcaaccaaatgttgagcttagtgaggagaaaagaaaatttacaattttttaagaaatattcaaaacaaaaaacaaaaacagcaccgttttgatcccttctttgctgcaggtgtggttcacttccagcaacacgcggtaattgtagctaaaaacagcaaataaggcaattaatcaaacactcatcatttacataataattactttttaaatataatttaaattaaattttgaataattttatttatttttttacttgagctgttgcatgtcatatacgggggccggtgtggttgcgttctcttttggctcgggttcggtggttttccgctcagcacagaggctaaaaaagacgaatttttgccaaattaaaaattttttttgttcagcagttttttctgttttccaattgaaattttttatgttatttatgtgacaaaaatgaatttttacaataatagtgcgtgttttactgcacataattaccgtaccgttccatcagcgtaataccgaagcaaagctgccaggcttcacccccgacagtgcattgctaaaaaacaaagaaaacaaatatttatttatttatttgtttatttttttacgtcggccgtttaacttatgcttcacacgtatcgttcaacagtccctgaaaaaatcataaaaattgataaataaatgttttgtttttgagtacctctggcatgtattggcgaagtgacagcgatgcagtcattttttggtttgcgcaaacgacgcaaccctcaaaaagcagcaacaccatgtctgagaaggaaatgttttaaattagattaaaaatttgtttaaaattttattcgattcaatttgggtgccaaagtcagtctttaaaattgttatcaagcccgtagccagaaaaattttggggggggggggaacctgaagaccttttttgctcttcgggcaaaaaaaatttttccattaaaaattcagcacccgagagcaaaaaaaatagggacttgtagccgtttttgcgtcaaaaactgtcaaattttggcaattttgtggctaaaattccaaaaaactaaagtaaattgggggtccggcggtgccgataggcgccgccgggaaaattttagacaatttgagtgcactttgttacaaaaacgcctataaaattcaaaaatgtcctaagcatttttggaaaattaataatttcaacaattgaaaacagaatttaataaattaatttttagcttctcttccaatgcttgcaaatttatgatgttcaatggctttttcaatgccaacaattcaccatgcatgaagccgtatttgtcgaactcggtcatgttcttgaagttttcctccggcccttctgttttgttgagaccgtacattttggcagatgcttcagtatagccagcatccccgtagaatgcaatctgaaaaaa

SEQ ID NO: 31787 - DNA, 1053 bp, Heterodera glycines
acaaatgttcagcaacagttgcgactgctccacaaagtccgccagtcgaagtgtgcgtccgtccgcactttccaatcggcacaacaattggccgagcaaatgcattttgaacgcctctttaagcacttccaaaggttttggcggctgagtcaaagcggagaagggaaagttcggcgtcttttgcacgccgctttgtgagagaattgtgccgacgcgcacggggcacgaaaggaaatgccgggcgagtggatggaacacccattggacggagttcggcacgcgacagccctcgagggcggcactctttcgtaggtgacgcctttgaatttgaacagaggcaaaattagcaatggcacgaaaaacagtcaaagggactgactttgcccggcggaagaaataagcggcgaccacccgacgcaaacacttgggcatgcacaggacggaacggagcgcggcacaaaggtaaatttcggcacggaatgagtggggaatggctggggagcccgccgactcggccaaattggtggccaacagtgccaaattaagcgcaccgcgtgaactcaatctgaaacttttttctttggccaaaaggggcgacaaaaatggcaaaagattcaattattttccgattttttaaataatcgaatggtagttgtggctttttctgacctaattccgtccacatccaaaaggtgcagctggtggagttggtggtaaaccagcgcagtctccgcatgacttcggcacaccgattgatgcgtaacggagggacgacgacggcgcgcgaaccatcggccaatccaaagaccgttaaggaagtggcgaatgacctgacaaaattttaaagtaatagttgacaaagaggtaattaattagatgtaaacgataaccgactgatttaaaaaaagtttaaattgcacttaccgaaaaggtcagcgacatccattcgtctacacttccgccggagggcaacggacgctgcagaatctgtaaaggctttttattagcctaattaaatgggtggcttttcatcgccatggcgtgccttcagcg

SEQ ID NO: 31788 - DNA, 1243 bp, Heterodera glycines
  misc_feature (19)..(19): n is a, c, g, or t
  misc_feature (33)..(33): n is a, c, g, or t
  misc_feature (101)..(101): n is a, c, g, or t
  misc_feature (1021)..(1021): n is a, c, g, or t
  misc_feature (1023)..(1023): n is a, c, g, or t
accccgatgctaatctgtncgcagagctctcanaattttttccataccgcaagagctgcggaaattgtgaataattctcagaaaaatggctatctcgtttnaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgntnatcccccccccccagcctctccccaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattattctcagaaaaatggctatctcttttt

SEQ ID NO: 31789 - DNA, 994 bp, Heterodera glycines
tttttgactgcaaattttttttccttttttgaattgggttcaaaaaaattttaagagaatttttgattattaatttgaagtctggaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatatttaaaacgatttcgtt

SEQ ID NO: 31790 - DNA, 1270 bp, Heterodera glycines
aagaatcaagcatataaagtaaaactaccccattttatattgtttttcaacaaattctgaatacgatccctaaaagagagatttgacattagattttataatctcagaatttaattgatttaaataaatttatagaattatcatttttctttcagacaatccaagtgatcatttacgtcggtgccattgtgtccgtcctctatttctacggcattatccaagcagtgctcaagcgcatggcaatgcttatgcaactaacgctgggcacaacagcgaccgagtcgttaaatgcatgcgcatgcgtattgcttggcaatgtatttaaatttttttcaatttacttattattaccttgaaattaaaaataattattattatttaatttattgacttttgtgatttaaacattcttttatatgttgttaagagttaactaaattaaaattattaattaataataaaaaattttctattaaattaaaattatttcgagtcaccgttttgttaaatgaatttttttaaattctaatttaaaataggctgagtcgccgcttctaatccggccctacatagaaaaaatgaccgcctcggagcttcatgctgtgatgaccactgggtaatttaaaaataattaaatgattaaaagcatttttttaatcgaagatattaactagaaatgaaattttgtctttgttctaagttttgcctgcattgcgggcgctgtgttcgccgcttacattagttttggcgcgtgcccgcgctatttgctgtccgccgctgtaatgagcgccccggggtcgttggcctgttccaaattgctttatccggagacagaaaagtcgagcgtgaaaagtgtgaaggatttggaattaccgcccaggtataaaaataagcgttcaaaatagtaggaaaaatttaattcccctatcgagataaaaatttttgttgtgggaaaggggaaaatttttgaattaatttaaaaatttcgagaattttcctgctgcttgggcccatcttacattgatcagtagggatgggaatgtatttagaaataagtttgaattactaatccaaaaagtggcattttcggattatactctaatcatgcgttattcaacatccaatccaaggaaacatgcatttatgaatattttttataaattagtttacgtgaataaatatcccaaccctaaaattttacttcgtttttaaattttttgaattgaatttaacgataaaactgttcagcaaagaaagcaatgcgatggaa

SEQ ID NO: 31791 - DNA, 1519 bp, Heterodera glycines
aatccttcagctttgtgcttaattggctcgcttcaccctgcatgaagttgtccatgatgccactttgcactgcccaatgtgccaatctctccttcacatggcacacttcttcgcactcttttgtcaatcattaatttggcttttcatccgtccctttcccttctcacctttctcaacttctgtcgactgcgcgtcaatgcattcgatcaccgcttcaaatgcttcaaattggttgtctcatgtcaattagttaatgaccagcagaccactgacctttcctctgctcaatgcaaatgtatcgaatacctgcagcatttgtttattagctgtgaatgtatggcgagcgaaagtgccaaagtaagcgggcggcactttctttttttacggggccatttataacccaattaacacattaaatttctttattattattttttttttttttgatatcatcccacatcgatgattttgccacattaaaatgccattctctctccgcctccccttttttctccgtcgtaccgctggtaaaaacgtggaatgtctcctggttggagcatcgtacgccctccaatttgtccatgcaatttaccgtttcattgtaatttctgaattactcacaacaattcccctccccccccccattttccataccgacagacgcccttaaagcggttgaaattgttgcccgatttcatcgccattttcaccgcttcgttaaacttcgaaaggcactccttctgacacaatggcacttccttccccccaattcccggcagaaaaagcccttccattccctcctcgggaaattcggccggaccaatatggggcttttcagcactggtgaaataatcggagtcaggcagagaaatgcctttagaaaagagaggaaaaggactgatttatgggagaagaaacccttcacaaaaatgccttcatccagcggactactgtagcctttcaaatggtgaacttccggcactttaattggaactttaatttgacggggcggcgaaccgagcgaaaaaagaatgggaaaaattgggaaaaaagggaaccgccaaccgaaggagggcagcaacattttaaggttttttaatatttgtacaattgctactgaagctaattgtaagcatttggcggatgaatcaaagggcggaagggcggggacctttgctcttttgtgtttctcaattacgcaatgactaacggacattcgatcacatcgcttaaaagagttaatttaattgttggcagtttttttagctaaaaattaattaaaaaatgattttatacaataaattctctttttgaatgaataaataaataatgaaattatggcgacaaataaaaaataaaattaaacataagaatgaagcacaattagaagagccaaaaagaaaaaggaaaattaaaattaaaaaattaaagaatttattcgttaaaaatttggttgacaaagagcaaatggtgagtaaaaaaaggcgaatttaaactttttcaatggcaccaaatttct

SEQ ID NO: 31792 - DNA, 1008 bp, Heterodera glycines
  misc_feature (965)..(965): n is a, c, g, or t
taattgttctggaatttgtttctctcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaatttggaaaattggctatctctttttctgctcacagtaatagaattccnaccgcattctcagaataatacgccgatactaattgttctggaa

SEQ ID NO: 31793 - DNA, 1420 bp, Heterodera glycines
cgttgaaaattttcaaataaaattagaaaaattttcgaatttttggccttgataaaaaataatcttgcgttttgggtctagggatttatttttgcatgttccattgtcacatctttgcgccagttttccttgtcccagcaaattttatggaaattccgacaaaataaattttcaaacctgatcatgaaaacaaaatatattttaaaaaaattagaataaaaatttttctagcgattatttggaaaaaatgttgaaaaaccgctagaaaaatttcttaaaatttttttttaatttttcgggggggggggagctgagctgttcccgaaaaaagccaaaatttgtaaaattttaacctcacccatgctaaatttgtaacatctcagatttatgtagagggaaatttttatttaaattttcaaaaatcaccgaaagcctcaaaatcgatatcgaatgaaagggggagaattacttaccaaacaccgttgtaattgattttttcgtgccatttaattttaaaaatttatttgggccaataattgtcacattgaaataatttacaataataaaaaaatagtttacgtgccgcggacgcgaacccacgctcctgtgcacactgatcattgcatggcgccatccccgcctaaagggaaaaattccgatttttgagggcccgtaactttttgcttcgtcattatgcatccgtaagattaaaaatccacaatagaagtcgaccctgctctatcgaatggtatataacacatatgcatttcccgacttacagttcgggtggttcccttgttagccctaagcttaatcctaggtaaaaaattttgttgtacgaacttcctattgtacgaactgctattgacccaaatctacttggggtgacggtttattaaataaaagaaaatttaatgaaatggacaatcagtaaatgaatatgatcatagccgattttactgtcggcgataggtacacacagcacaaaaaacaaacaatcgaatccaatcagtcctcacaccaggcattctcgcgacgaatctgctcctcttcttcgggcgtgaaatcgtttttgatgttgaatgtgcgacgaatctcatccggcgacttgcctttgatcatgttggccaccgtcttgcacgcaacgtcgagcaacccgcgcacgtccaaatagttggctgccttaatgagagcaacacaattaaattgtgccaaattcaatgtgaataaaggggacaaatccccataagattctgatgacaaaaaacgaatgaaaattttggagcgtccaaaaatgtaatttaaaaaaaatatatattaaatttgagatttctctattttcaaaattgcagtctttttgataaaaacttcagcatgtaaaccaactgaccaaattagctcaacagcgttcctggtcgac

SEQ ID NO: 31794 - DNA, 1349 bp, Heterodera glycines
  misc_feature (10)..(10): n is a, c, g, or t
  misc_feature (32)..(32): n is a, c, g, or t
taatattttntacattatgtgtgaaagaattngaggctgcttctgatgcgattgaaatttttcagcttttcttgaaaagttttttccccagaatttatacagctttcccgacaaattgtttagataattattctaaacgatttttttatatctcagtgcttaactattgcctttttgtatgataactggtagatattgggagtgaaaaaaaatttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctactttttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatgtaaaaataatttcttgcgtggtatctgttacattatgctgttgaagattttgaggctgcttcggccgcgattgaaaatttgtcagcttgtcgtgaaaagttttttcccagcatttatacagcttttccgacaaattgtctagataaatattcgagacgatttccagatatcacaaagctgaactatcgctattcagtctgctctcttggtagatctgtgcagtcctaccctaatatatatatatattatttgccaagataagttccaccaggacctgtttgagtgccatgctcccatctgacgggtcccaatgtgccatataatccgaacgttggagttgaacagccaatggctgatgaatgccctcgtcgtggaccacttgggcgatttgcacaaggcgtgccataaatgggtcgccttt

SEQ ID NO: 31795 - DNA, 823 bp, Heterodera glycines
tctacgagtctatggtttataggcgaggcaaaaataataaatttgaatgattgcattatgcctatacagtaatgtattaattttattgggtgataaagtgctacagtatacatttttttgccattcgtaaaacaaaacaattaattcctctcaaaaggcgccaaatttgcacattcaaaaaaatgtcattcgtaaactcaatgtctgttttctaaaaatttgttcaaaaaagtgtgggaaaaaaagtccaaaacattattaaaactttacgaaatgaatggggaaatgtttcaatagccgtgggcaaatttttagcgtctacaattataaaaaattaagattttcaaatttgaaaaaatatttttgaaccctgaattgtcaccctatctgtgtataaaattgttaaaaattttaaaataatttttttaaccctgaggttgcttgccaacttgtgcatccgctgctgacataggggggagtaaaaatttgggaaatttgtggaggggggggggtatataaaagcaaaacgccgacaaaattggacactttcacagcacacaaaattaaatttggagggcagcaggagcaggcagaaactgtacaacaacaataacaacaaaaatatgtcaagctgttgaagaagaaaaagaagaatggactgactaatgactgactgacttttacatgttcataaatttaattttgaagacgatgacgacggatgaaaagtcagtctcctgctgctgctacgaaaaaagagggggaaggacggcaaaaaaaatgtgcgaaattgatttaatgaaggaaatttatgggagaaaat

SEQ ID NO: 31796 - DNA, 1937 bp, Heterodera glycines
ctcatgtatgcccaaatttgtgtccatgcgacacagacagttcggctcctggtttatccaagcgttttgcaatgttatgcggaagcatgctaaaaccatggatttggaagccatgttaagaagagtcagagcaattgtggcacacatgggagaagaaaggtcaattgcccgaaacgcacacttctctaacgaaagaattttattttttccccggttggaatgtggattaattatagacctgaaagattgctcattgagctaaaaactgttgctaaatcaaatgttaaaaattttttgcattttattatgcttttattaataaaaagatgaaagtaggagttcaaataaataaattttcaaaattgttaaaacttattgccatttccttcctctgctggcggtgtgttcatttttgacaggccttcgccccgggggggaggaggcgggcgccctcacttcaacagcaggtggtttaaatatcaaatggatttggcatttcaaagttatttaaaggcagcggccaaacaccacgaaactgacaaatgagagcaaaggtgcgcttgtccaatggttttaaaggttaggggcgtattatctgtcatttgcaagaaaaagtaagaaaatgtaatgagaattcgttgagggtgaggcaataaattggaagataaagccggccacaatcaacacaaaaccattagaaccaataaaactgaaaatgcgacattaaaaaagagtaaacatttggtctccactaattgcccctaattgggtgccccttttggccgttccatcgccgcccaacgaaatttctttttatttagtccgacggcagcagcacttttctaaaaaactttataaaatttttgcttaaaaatatttattattcataataataattttatatgctttttttattattttttatcataaatatttttgtagagaataattaaaaacacaaggcatttaaaatgacaaattttcagtgaaaatctgtaaaatagtcaaaatttcaaatttttcctctggcgcctggcccccaattagaaatagtggattttattcaaaaaaatgcacaaaaatttcttatcaccttatctttttttgtttttcaaatcatctttttttttcgcggtgctctttttctaaagacctttaggagaaaggggcccggcggtgccgataggcgccgccgggaaaaaaatttgaaaatttggatgggtctgttaacagattttgtccaaaaaaattataaaatttttcgattttgagccaaattttttaatgtaataatagttcttccttttttgtggcgctggcgatatacgtacatatattaaattttcatgatttagtcaaaaaattgaatttttaattccaaagaaaggaaaattgggtttaatacgtctataaattatgccaaggacgattgattttttattcagaagaaataaaatatccagcgaaggggtgaccacttacacgttagattttagtaaattaatatcaagtccaaggagctcttttacagactaaatttttgtttaactcaatccatttatttatacgttttttgaaactgtcaacagatggagcatctgttatatctttgttgagtttagaccatattaaggccgttctgttgataaaggaatttgaagttttactggattgtgattttaacacaactttacgtctaagattataagggatgtgaccagaaaattgtgggaatatgtcttttttaagatgagtgagaccattaattgcaatttgttaacatgttttatcggaaaaatgaccaaatttgcgatttttaacatatgtatatagggttgggcccccgaccccgccccgaccccgaaccccgacatttttggccatttttcggggttaaccccgaaccgaaccccgaagctttcaaccccgacgacccc

SEQ ID NO: 31797 - DNA, 2168 bp, Heterodera glycines
aagaaacatcgataagctgatcgatttggccaaaaagaacaaagagtttatatttgccgatcatattaatgaattgaacaacgagaaccgtggattgcacttattgttggaagattgggaaaaagaaataccgtatcagtatgaccgtaaccaaatgaaattatgggtagagaaacattcgacaagtaaggggcattcattctatgttgtggcaattaagaaaaaaattcactcgccataaattcgtcacacaaaaatgaaaggctcagctaaatcgggcataaattcccttatttccaagaaacacatgaaaacaaagattggaaaatagatttcttacgtgtccttaaatatgcgccccggacatttggcccaagacatttgccgaagatatttggcccggacatttgcccaagacatttggcccaagacatttggccccggacatttgccgaagatatttagcccagacatttgcccaagacatttggccccggacatttgccgaagatatttgccccggacatttgcccaagacatttggccccggacatttgcctaagatatttgccccggacatttgcccaagacatttggccccagacatttgcgcccatttgcgcctatgtccaaaatcgggttcaaacttacattttttcaatcttagagctcttaaacagcattaaatttaagaaaacttgttcttttagtttagtaggaacagtaattaggtatgttgtttcaaaatatgttttttggggttttctcgaaaattaaaaaaacatcactgcttaagaactggaaattatgccaaaaacaagacaaaaatggaaatatttcggtttttgctaacctaagcgtttaatgtccttgaaaataaggatgagtcggtgccgtgacattagtcaaataaccatcaaatgaaaatactttttgatataactttgctcaaaaacaatcaagttttaaaatattgatatcattccatagctccaagtgttttcaattatcctgcaaaatttttaaaaatttcgtttactttcaaggaagttatgatttttttggaacttaacgaattttttttttgaaacttttgcgggataatagaacacacttagggctatcgaataataccaatatttaaaaatttggggtcatttgggcgaagttatgaataattttctgtcaaaaattttccatttgatggtccttgcttgactatccgtcaacggcaccgatgagtcttgtgccttccggttttgaaatttaaaaatattttcgtccttgattttctctaattatatgcccgtctccattagtctgcccgtctccaattatctcctcctttctgaggaggttgaaaaataatactcgggcatataattcgataaaatacggtaggataaaaataggtgcctaggcattaagcagaaaaagccaaaaataggcaaaaataggcattatataagtcatcgtaaactccctaaactaaacggaaaatgctttttttcgtgcttatctctgagtgtatcatgtgcgcagaaattttatccgtgatttttggttttttaaagaaaaatatacaaaactcgaaatataaacagaactttagttcatacaggttttgggcgctgttttagataaaaagaatacaataagccgtacgatttaatagtattataaaaagccttaatttataaaaaaaataaagtgtattcaatataacattttaattccatttgtttttaaataatatataataattcaatttttatatattttaactataaaatttccattgaataggaagtgtcattcgaattgccttttgccgaatctaatgaccgtaaaaagaaaataatggatgaaaatgcggagccattgcatccaccaaatcctcttgaaattggaattattggcagcagtgccaacaattcgttgtcagaggtgggtgaattttaaaaattctagttttgaaaaaatttgtaaaataataaaaatgcacaaagtatgtcctaaatatgtagaaaaattcgaaaatgttaaaaaattggttagacttattttcctacaaaacgctaataatgtgtttaaattatcctgctttgagataaataaaagaggattaagaaaataaaaaagtttttcgaaaaaataataaaaataaa

SEQ ID NO: 31798 - DNA, 1688 bp, Heterodera glycines
cgcttgaaggcttttccgggaagaggcggcacaattatctgacgaaacagatggaacaaaaatgaaaacaaaaaactttgctgtctcgctccaactcattcctcagccattcgaagtccgagtaacgtcgacggacgctcgactccttttgagaagggagacaaacactccaatttaaacagagccgccaatgccaaaacgactcactttgtgtttgaacaccggcaagttggtcctcagtcgaacttcgtagtccgtgtatcggttcttcccgaccccgtgagtgatctgctgaaaaaggtcacaacgggccacactaagcattgcttacgggattgaccacttcgatctccaaaaaattggctgggggagcataagcctcgtccaaagtttgccgcttcgcttgaagacgttgggtcgcagcggcactcattgcgaagtcgaaaggaagaaacgaattgcgaaacggaaaagaaagaaactgataaagggtgaattaaccaatgcaatttcaatttaagtaaagaactgaattatcagaaggcaaaatcacagtttgttataattagtccacaaaacaatcacaatgggaatgttttggccttttttgttttccgtcgcgcactttcttttaatacgcccatcggtcgacgcggcgcatttcggccggcgttaattgtaaaacggcacctgaaatcgggaatcctgtcagttatttaattcaaaatcgcatgcgttaatttccctcggacacggaccaattgccttgagaatgtgccgtcgcccgctgatggacccttgtccaacgaattgtacaaaaatatttcgcagataggccatattcgtttgactgctggccaacgaaagtcgtcctaaagtgactgaccattaactgccatttgtcagacccaaaaagtcaccttccaacacacgaatttcctctttcaatgtctctattatttgcaggtactggacgtccttcatcagcattgcctgctcaatgtcgcgcactttgagttcaagcagtcggatcatattcctgcgttttcctcttttttggccactcttcgccccccccccccgccttttccgcctctttccccggcccaccttagttctccaatctcttgctcccttttgctcagctcctgctcataaaaaatattacgcgctgccgtccccgcaactatcggtgccttttctgtcgttggagtcgaatttacaccggaaaaaaccgacgaatggctcaaacgacgggcataaacggaacggaaagaagctgaaggagaagcaaagtcaaccaaaaacaaaaagagtaccaaacgaaccggaaaagtctgtttggggaggcgtttttccgtcattaccattttcaccgaccgatgaacgcctttcgccccctccgtcggcacagtcttggccggtgttgagttcatcaatcgaattcgccatacttgcatgatttttcgaatgggtagctctcgtttgattccatttcatccgggcggaagccgacaccgatgcgccgttaggctgaggatccatgggaagagcggggacggactcacaatcggaggcaccaaagtgaccggaggaagtgactaatttcctaaaaggagtgcagaaagaacatcagccaacatacgtgtgcaaggggtggggggatcaggaaaagggtcgtgcgtttg

SEQ ID NO: 31799 - DNA, 867 bp, Heterodera glycines
ccgacccccggataccttgttttgagtgtatcgggcttagttttcgagttttttgttcgagttccggctcaggctctcggaataggacgaaattgaaggaaattactagattatttgttgtggattgcacacccaacacacacagaacacgatgatgctgctgcggatcacccagggactgatgcatttgggcaagggcactcaaacgttgaaccctttccactccgaccgtcagctgatgtgccccgcagcggttgccgcactgttgaccacctgttttgcgtttattgacggagaaaaatgtacggcaaaaccaacaaccattttaaatgaaaatttttatttttcgaaaatttttttagtgattttgaatggtcgccaacactatttgttctacacattggtggccgccatccagcccaggatgttgatcacggtgttgcaggtgagcagtggagaagttcaaaaaggggggttttgtcgccggagagaaaagccggggaatttgtagccatttttggcaacaaaaaaaaagccaatttgcatttaggggtcaaaatttcaacaaaaaaggttaattttggggattacggattgacacgcacctcataccatcggaaatttttaaaattatccgaaagttattcctatttttttcaatagcaaaccctttgattaaatgcatttcatttcgagaatggagcttgcacattttttttcttcaaatcttgaataaatatttgcttctccccctttccaggacccattggaccccactcgactcgtccagaaagcggtttgtttggtttttctctattgtccattgctttccaaatacatgtctttgtatacatactgtatcactgt

SEQ ID NO: 31800 - DNA, 1195 bp, Heterodera glycines
aatgcactccaagtccaggtactgctgctgcaactgttgttgtttttgctggattcgattgcctaaaaaattgagtttcttttttttataggaaaattttgccgatagtacgggaaatttttggatcggattaggctatataactacaatttaaaaaatccttttttttttgtttttttgtcggtgctataaggaattgctccaatgcggccgtcaaagtttcatcattggcacacaaaacatcccatttaggcattttgaaaacaaactaaaaaaacgaagtttctttttataccaacggcccctttggcacaaatttgaataagattttcaatgcattttttattttcataaaaaaaattttaaatggtaaagcaagtatttttttaaattatttttttatcgtaaaaaatttaaaaaattcggaaggacgagttgaaaccgagatgccttctatctttacatatttaaattaaagacgctagaattgcatttcgtttaaaaaaaaatttctgtataaaagtggaaaaggaaacaatccacaaaattttttttcaaaaaaaatggctaaaaaatttgccgcgaatatttaaaaaaaaaatacggaaaatttttacccattcgcttctgctgttgctgctcctccgctgggcttggcattggcatttggttggcaccgggcaaatatttgcgtgtcagcaacaggaaaaagatggagcccaatgagaacacgtcagccgacattgtgtatttgccggcacggacttcactaaacatggggagtggggggggaggggttaaagccgtacaatagaaaatcgggaaaattttttttttgaaaaaaacattccaaggtccacaggatacggccaaaaaggaacgggaaggggtacactatggtagtaagacgaattttgaaaaaaccacctcaaaagctagggcaaccaagccagaaatcttacatgaaaagggggccggagggggggggggggtcaacccgaaaattttgggtagggtccggccataccatgtacatagacggtctttttttattgcttttaaaaccgccttttttgtgacgcttttccaaaaaacctttggagaacgggggaggcggccggcagtgccaaggggtcgccgaaaaaataatttaaaaattttttttttaaataaaccgagttttgttcgcccactg

SEQ ID NO: 31801 - DNA, 1193 bp, Heterodera glycines
tttttcaaaattttcaagagcccagactcgcccaagaaagaaaatccagaaaaattaggggtcgtcgctactattccgaaaatgtggttggagttcatttgagtgttgagcagaaaaagagatagacgttttttcaaaattttcagagccaaactcgcccagaaagaaatccagaaaaattagggtcgtcgctattattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattgtcagagcctaactcgtccagaaagaaaatccagaaaaattagggtcgtcgct

SEQ ID NO: 31802 - DNA, 1450 bp, Heterodera glycines
ccattgacaacggcacaattaggacaattagtaccaggggcacttaaacaggcgtgtgactttgtgcacacagttttgatgagtcatcaaattgccggcgcggataattttggcaaaaattggatagttttgtttacattaattaacatgaagttgttgtgagcgtgggaaaacggggcggaaattgtgaatgaagtgttgatattttgggcttctttccattctgaaaaaatggcaccggcaaaattctgtgaatggcatggacaaaaatgttgaggcctccggcataaaaaggtgcgcgcaagaggtaaaaatgggcaaaagtcaaacattggcataacaccgcgcgtataaatagcggataagtgtaaaggaaaagccaccaattacgtcccagttggatcatccccaaaatatcaaaatatccattaatttggttccaaaaatcccattaccacactactatgacttccttcatcatcattaccattgcattcagtttttgtgccatttcgatggctcatgtgccgttttggtgggagcagctaagcgatgcggaagagcaatggaggatcaacacaagtaaaaaattggattacaacttttaaaactaagatattaaaatcggggaattcattgaaaaattcttttgaattttttttgttgaaagaaatcatcaagcccatttctgaaaggctggctctcggaaaacgaaaacgcagaaaaacaatatcaataaaaatctgaaagaattttctggaaattttttaatggcatttctgggactgaaaaagcttaatttgaataaaataattttcaatttttaagcaatcaacgaatgctgcccaccagccacatattgttgcgtcaacaatctgttcgtgccgcgagagcttgacgaaatgggaatggacaggtgcatcgatgacggcacaatgggaaaggtgaaaaacattaaaaaaataagaatttaaataaaatttaaataaattatacataaaataataatttaataaattatacataaataatcatttacataaataaattttgcaaaaaaataatcatttgataaattatcgataaaataataattaaataaattatacataattaataatttaaataaattatacataaaaataaaattttaaataaattaaacatgaaataataattaaataaattatacataaaaataataattttttataaattttgcataaaataataatttaaataaatttttgcatctaaatttattggattgaaaaaaaaacaaattattttaggaacaaagttacaacaccatcaaatgtgcgcaacgcaaatatttgggtgacgaatcaacggatatttgccgtaagttgtaaaaccattaacagttaatttgtagaatataggaaaaatgagtttttggagatacgaaatattggttgcctatttttgt

SEQ ID NO: 31803 - DNA, 1106 bp, Heterodera glycines
agaaatgcgagaaaaaaaggagccccgtgcattttctttctcagagtttcggtgtgatcgactcagcaaatttacagatcggcactcgtttaggaggggtaccaaatttattttataggtgacactgtcttcccattaattttgttccactatttgtagggcgcttttggttgtgttaacgaagcgaagtggaccctaagttgtgcgaaagaggcagagaaacagcagggcaaaaccggaaaagcgagcaaaagctcgaaaagggtcggtcattcagcctttcacacctccaaattcaatgcccttttctgcaggtggccattaaaacattcacaaattttgctgacatggagaaagaagcggtgccttagcctgtttactattcgaattccgaattccctaatttttagggtctgctcaaacagctcgaccacccaaatattttgcgaatgtttggtgtgacaaaattggatgacaaaaacgcaatggtcattgagctgatgaacttgggcgatttgaagttattttttgtgattctttgctgcgataattaaaaaaatcgttgcttcccatcagaacgtacgttgatggaaggaagccgaagccgcatcttaccggatacaccaaatcactaatacccgcgttggagacattggagctcgtaaaaattgctgctcaggtagagagtaatgagggtgccttaagtttccccaccccgagaaatttatctaatttatcgaaaaagtttcaaatttcaaacctattttttcaaaatcatgatgaactactaaattattcaaaaaattcccgaaaaaattttctatttgttttgttcgaacataaaagtgagaattttgacaattttaaatttcgactttttgttcgaattcgggtcagggactcgaaattggtcaaagcgaatattagattcatgttccccgacccagaaaaccccctataaacatgttttcacgacttctcttttctcaggtcgcagatggacttaagtacctcgtccagcagagaattgtccatcgcgacattgccgcccgtaattgccttgtttccggggactctgacttccgttgtaaagacgccgcctcacg

SEQ ID NO: 31804 - DNA, 1086 bp, Heterodera glycines
attataattagataaaaaaatttaatgttcccgtattttttttttttattccggctctaatttttagattgttttacttttcgtgacactctggtacatccttttgtacatattttcagatttttttcatattttgccatttttcttcaaatattttccgatttgaatatctcttaggaaaaaatttttgattatgcctaaaattgaatccaaatttgaatggatgcgcgagtggatcaacagtttttgggcaaaaccgggacccggacttgccgggacctgagaagccgggaccgggacctcggttttattcgggaccgggaaccgggaccaactgggaatttttcaaaattcaaaaaattttaaaaaattcaaattttaatttatttcaagtgaaaatattaaataattaattttgatttttattttataaattccaaaagttaaaacaaaattaaattaataagaattttcaaacaaatttgttcaattatttcaaacaattaatcaattttggactaagtgatcgaatattattataaattcagatttacttttcagatcacttttttttaaagaatatattaatattttttaaaattttttccttgtaaccaatttccatcactaatttttcacccagacccccattcttaccagtgcttgtttttcccggtttcggttgcccattgggaccgggacctgagcttttcaaaatccggaaccgggaccgggacctcaaaggatcgggaattcccggcccggtcccgctgcactctaatttgcacccctaattttcaaattttttgtgcatatttgatgcatattttgcgatttttatgcatatttcacgactttatttgcatatttatgcgcatattttggccacttttagtacatattttttgcagccctgttgattggtatatgtaattaataaaatatataattcctttaattaaaaaaaaaaattatgaccaaaaaaggatgtaccaggagtgtcacgaaaagtaaaacaatctaaaaattagagccggaataaaaaaaaaaattacgggaacattaaattttttatctaattataat

SEQ ID NO: 31805 - DNA, 1202 bp, Heterodera glycines
atctttattatattgtaaattaattcattggtttttcccacaacattattatttatgataattattttaatgtatttttataattaaaactttaacttttgtaaaatttctaatcgatgcgtgctgcatcaaattgccatctattgtaagacagactttcacccaaatacaaaactgagaaaaaaaagttcagtaaatatacgaagttactgattctgatatcccttattcgaccaacataaagccggacaaaaaaaaacatttttatttaaataccttcaacaaatttgacagcaagggtgaagaggagagaattttaaatattagtttttttttctaaaaattacataaaaatactaaaatttacaatttttcaatgaaaatctattaaaaatttggcaaaaatttcatttttatcagcgacactagtgacaccggcaggcccaaataacccacacaatttcacccaaaatcaacctgaaaaataggccacactaattgattgtttatttgaaataattaaagaagaatttaatttgttttaaattttcgaactggcataactaatttgatgaatttcaagtagagctggtcgggaccggaaacttttacaaaaacagggaccgggaccggaattgtggaatgttcgtaaaagcacgaaaaacacgtttttaagcttggtttgaagtttatcaaaattcatttttttttgctattttctcgaaaatttttaaaaatgtcgtttacataaaatattgaaaatatgtcaaaaataagtcaaaaaaatgaacatttttcaatttttcatcaacggttttttgacaaataaattaacataagttgaacaccgtgctacaaaaaatggccatcaaattttttcccaacctttctatataaattatattttcttattacatattttacgattttttttacatttaatcggatcattaataattttattagcattgcatttcccattttataagtgcattatttttaattaaaaatgtgttttattaatgtgatcagcagatttgtcactatgggaaaccatcaaaaaccatcatccatttagaaagtgatgaatgaattaatgaataattactttttcaccatttgtgaaggcccaaaagagaaaaatcacaaaaaatggaaattaatagccactggaaattattttatttaattatcaagaaatt

SEQ ID NO: 31806 - DNA, 1324 bp, Heterodera glycines
  misc_feature (1286)..(1286): n is a, c, g, or t
aacattagcgtcacagtacaacgtaacactggccttctgttcgatttgatcagtgatgtgatcacgtttggggcgatcagtgcaatcccacaccgttttgaagtactcattgtctaaagagcatttggcgggaatggcatggattaaaaaaatgaaaaaaacaaaaacaaatgcaatttgcataaaaccgtgtgcatattttttgcgggattttcacatgtcgtaaatttaaaataaaaatttaaaatatttaaaaaaataactcattgttttttttttaaaaatatgaccatcaattttcatacttttaccaagaattcattttacatatattttttttggagcatcctttgtagtaattataatgtacagaaaatttcactttgctagaattctttttttttaaatcttttttttattaatttggcgaaactttttacatttttcagtattttgaagataggtaatttaataataatataataaagtggcgaaattatgaaacgattcatatttttttccaaaaatgattagcctcattatctctctctctcatgtttcttctctctttatctctcttttctttctcactctctatcccttacatcacgctctcacgccctcacctttcctttcctcatctctctctatctctctccatctctatcactcatctctctgtctctcacactctctccctttcgctttctcgtctcttactctctctctctctaactctctctctctctaactctctctctctatcattccttctctctctctctcttacatcactctatctctccccttctctctctccctacttcatctctctctctctctccgcctcactctctctctctctctcaccttttgtgcatttggcaatgtaacagtaatggtcgtcgtgcaggcatttcccctccgacacttggccaattccgttctcatcaaactgtcccactttgcacatcatcccatcagggatgggcggaagcacaaattgttcattgtccatctctttgcccatttccccgaaatggcattcgcaccaatggccattggaatgtgtgatatattcttccaccaactttgtgaaccgctcggcacactcataaggaggggatttgatcctggcacaataccattggattcgtgaaaagcctgcccgaccagctgtaaaatgcgaataataaacttgattaaatcagttgttaaatattagtgatataggtcagccgaatattatatatatttaaatgcatttaattaattttatccatctnaaagtctaatattattccaaatacatctaaacggcatt

SEQ ID NO: 31807 - DNA, 991 bp, Heterodera glycines
  misc_feature (939)..(939): n is a, c, g, or t
tcacaaagttatggggagtgaaatagtgaaatattagttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccgagacttaaaactgggagaagcaagggggctgtggctggtggcctacaatttgntgcacattggagactgattctgatttctgagaagtccagaaatactattttt

SEQ ID NO: 31808 - DNA, 1670 bp, Heterodera glycines
  misc_feature (168)..(168): n is a, c, g, or t
tgtcaagtcctcttcttttttctcttccgccattctcttaaaaaattattgagtcaaaatcaaaaaatttgagctttttgtcattttcaaaagaaaaacttgcgaatattttttgagggcgcagattttctcgaaagccgagagaaaatagaaaatcacccccccccntgaaaaatttttttctagggtaattttatgagttgagcacgaaaaatgttattgtaagccatcacgcattttacgtgagttacgtgaaaatttagatgaaaaatttacgtaaaaatttaaaattacatgtaaaacttgaaatttcaaaaaataagacactgagagggatataaatgagaaaaatgagctgggagatcaagaatgccgtataacttcgagactcttttgccgttgtgttccaatgaaatggatgcgcccaatcttatgaacgccgcattattcatcgtgaaaagcactgccgatgtggtacagaaatgcgccgctctttcgcgaactcccatggaaaagtttaaaattttacaagtaactttaaatttttcatgtaaaatgcgttatggcttaaaataaacatttttcgtgctcacaatcagcgcataaaattatcctagaaaaaaattttgaaaaaaaattttcaggggagtgacaaaacggataagcaccgaaaattttgtcctattttaacggttactccacatttgcgccccggacatttgcgccccaaaggaaaatcggacatttgcgcccggacttttgcgccccgacatttgcgcctcagacttttgcgccccagtgaaaattagacattctcgccccgacatttgcgccatccatttttattttattttttcccccaatttttttatttcttaggacgcttattttcagaaatttttgggtcatttctgaggggtgtatttttaaattcccaaaaagtcgattcttagggggtgatttttcgtttttattgcatttttgttaacaaattttgggcaaaacgcaaaaataggctctttcaaaatttgggagctcaggaaaaaaataggtttttgcctaaaaatcttatccctaatctggacacgattttaacagattgcccatttatacaatagaccaaagattactctattactctatgaaggtttaacaaagagcccctgattcaaaaacttatggtcgaaaatgctcagaaagtcaattttttaagttaacgaattctttgaaactttgcatctaatagagaattcttagagctattaatttgggtgcttttagaaagtaatggagctttaaatcaggagtgcgattgaaaatttttcaaaatcaaaacatcgggctcaaaaaatcagattttggggtcaaaacagaaattttgcaaaattgcttcaaatcatttatttttacaatttatttaatcaaaatgtattaaaaattatatttttcgcctgtgattatcatttttaaaaattttggtgatcgtaaatttcagtgcactcggaatgaaaaaatgagatttttaagaattttttgcggcgcatttttccaaaaaacttttgggggatggacaggggggtccggcgatgccgatagtcgccgctcggggaaatttttgaaaatgagtatactttgttaagagaattttgtccaaaattgtacaaattttg

SEQ ID NO: 31809 - DNA, 1218 bp, Heterodera glycines
  misc_feature (107)..(107): n is a, c, g, or t
  misc_feature (1066)..(1066): n is a, c, g, or t
  misc_feature (1071)..(1071): n is a, c, g, or t
  misc_feature (1108)..(1108): n is a, c, g, or t
agttcatttgagtgttgagcagaaaaagagatagacgtttttcaaaatattcagagccaactcgcccagaaagaaatccagaaaattagggtcgtcgctactatcgnaaaatgtggtggagttcatctgagtgttgagcagaaaaagagatagacgttttttcaaaattttcagagccaaactcgcccagaaagacaatccagaaaaattagggtcgtcgctattattccgaaaatgtggttggagttcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaataagagatagacgttttttcagattttcagagccaaactcgcccaganagacnatccagacgaattagggtcgtcgctattattccgaangatgtggttggagttcatttgagcgttgagcagaataagagatagacgttttttcaaattttcagagtcaaactcgcccagaaagaaatccagaaaaataaggtcgtcgc

SEQ ID NO: 31810 - DNA, 992 bp, Heterodera glycines
ttaattgtattattaaggggaggggggggggatttatttttttaaatgaacatttcttacatcgtaaaaaaactttaaattggccctacctaataagtgcattttcaatttaaattttttatttatcaattatacataattaattgtttttaaaatgagatttctttttctggggatggaataattattaatcattttgaatgaacatattaaatattaagatgggcatcatcagcaggggccaatcacacaattaggacaaatttggcagttgtctccgaatgtgccgttagcgacaacaaatcacggcgtttgacttggttcgatttggcgtttgtctctgtcgtccaaattgtcgcccaatcacatatgataaaatcttacttaaatttgtcgttcctcataaattatctttaaaatgaatgaaaaatttcagaaaattcaaaaaattataaaagagtctttctgtgcttttttgggtgcattgattgtgagtttaacgtttattttgcttctaattcgaaccctaaacccaaattcgttagacttaaaaaacttaattaaaagtatagactaaagtcaatttctttccctgatttgtcctgatcaagaactctcgattgatataatatttgctatcaaaacttcaatttctggcctatttgtgttagattttcctcaattttttgtcattttaacggttcaaaaccgggtttttttcgatggcgcgcctgtgtccaaaatcgggttcaaacatatgtttttcaattttctgatagcagaaacagtattatataagtgatagaaagtgattgtatctgataattgttcattagtaaacttttgaaaaaatcatcaattatccaaacagcagaattattgctcttaataaactagaagactacgatttcttaattttaatgctgtttaggctatcagaaaattgaaaattttttagtttgaatccgattttggtcacgggcgcaaatgtc

SEQ ID NO: 31811 - DNA, 1446 bp, Heterodera glycines
  misc_feature (1406)..(1406): n is a, c, g, or t
  misc_feature (1438)..(1439): n is a, c, g, or t
atgcaattacattgtcaaaatattccatgttaagacgcttaagttttacaatattctccatttcttgaattgttacatgtatatattttttatttctttattagattgttaataaagaaaattttattttattttattttgttttttgagctcatatttttttgaatttcttattcagcatacgtatctcctcacgaactgtcacatataattaatttgtagtatcggttatgattttatttgatatttaattttttataaataatgttttatttaaaaatcatatttttaattattaaattacattattttatacattatataaattattaagttcaattatttgatttttttatatgttatatattttatttttaatttttttatttgtatgtaatatttaagattttttattttattaatgtaatattactattaatctgtttttagcattcatttcactcttttccactcaatatgcataataaatttgttttccattttgtataattattaatgttataaatttttgttaaaattgttgtaaattcaattttaattgctgtgaatttcttataaaatttgaatttttaaaaattagcataataatatgaggtttgtgatcctaacgaaacatagagaaattttttgaaaatttgcaggccaatagagaaaccttagggctatcgaatgatataaagcaaataaaaaatttaaataatttatttttaacatttttaccttaataagactttattcacaaaaattctgatcaaaactttcttaaaatcaaaaaataattgatcttgatatttcgcaaattttcaaaaagttatgaccaaaaatgtttgaaaaacaagtacttagtttgttaaaacttgacaacattttgcgttatgcaggccaatagagaacatttagggctgtcgaatgatattaagaataaaaataaagtttcttttgcacagttatggtaaatttttgttctataacgatgtgtttgtgttttgctattttacttatggcgcgatcaaatcgattcatttttacgagaatacaaaccgtaatattattgtataataagttttgaataaatatttttcactaattcatagttttaaaaagctgcgagattgaggcagtaaaaatttggtttttttattttcgctttctaactcattttataagtatttttatttggaaagataattaaattcattaaaattttaaatttatataatgaatttttctgatttaatgaagtcaactttttataattacatttaataaagaatgatttaaaaagttagaattttcaataaaaaatttcgtgttttcgcgtttttaatttgtgtttttagggcgttttggtttcttatttcatattttatttttatctttcgaantatcgctattttattttttgatcgatagaccnntgcaggc

SEQ ID NO: 31812 - DNA, 1496 bp, Heterodera glycines
  misc_feature (12)..(12): n is a, c, g, or t
  misc_feature (1470)..(1470): n is a, c, g, or t
cccccccccccnccccctcggaatgaaaaattattttttttaatgaaaaatgatgatccgagcgaggtctctagggttgccatattgcctcacaatcagaaatttggagaatttcggtcgttttgaagtccctctgcgttccttgagagatttgtcatcctttttcagcgatggcaccctcgccatttaagacgttagaatcagtctaatccagcaacatgacgtgcaactcacttactcagccaaaagctgtccattcgttttttcaataagccgaattgtgccgcccatagaagcgaccaaaaagcattggttgtccgccgtcaaatgcacactgatcacctgacaaaaacagagagaaagcataaaagttaaaaaatctttttgtgagataaataaacagaagggggacagacaaaatttcgccgcagaaatttaaaaaatttcaaacttagaaattttaaaaaatcatagaaactttttttataaaaaattttttgaaaattttcagcgatttttttaaaattatatgataaattactaagttttttttgaaaaattttcaaaaaaagtatcaatttttttttcttaaaattttctcataaaaaaattttctatgattttttttgaaacagaaggcacgcaccgaatccttcatgtagtcaatgaaaagtcggccctcccgcaggtcgtacagccgaacattgccatccgccgagccggtgacaatttcggacgcattcgcatccaaacacagcacaccgtcacgagcctcgtccaacacctgcaacagcagcaaacaactagcaaattttttaagagaattttcgggaacaggacaaaatcacgccgccagaatcccgccgctagaaatttttaaacaaattttcaaacttagaattttttcaagaaaaaaatcttagaaaatttttctatatgaaaatttcaagaaacataaaaaaaatttcgaaaaaacttgtaatttatcataaaattccaaaaaaaaaattgctgaaaatttttcaaatttttattttcctgaaattttcatataaaaaatttttttggcggcgggattttggggtgcacccgaattttcttccttttcaattcttgggttgggggggggaatgactggctccgaatcatttcttttttgaagttttttagttagaatttttttttttttgaaacttaaagaatttcaataatgcgttatcgaggactatcgcacatttgtccctttccgtaagcaattgccccccgccccccttcctccagggccgaaatggaaaaattttttgctaaatttttaggaattttggggccaagtttaaaaacatttttgggcaattttcgtgccaaatttcgtcaaaatgttccaacatgagtagagaccacgaattgagcccggcactgaggtcgagaatcttatgttagcttagtacaagtaaggaagttaaagcccgnaaatacacatttatcccatcagcaca

SEQ ID NO: 31813 - DNA, 1660 bp, Heterodera glycines
ccggctttttttctggcgaagtgttctacaggattgtcttcaagctttttcgcctcacttcctcaatgatctctattcgggctcaaaagttgtccgatcaaacggggcgagacggaaacaaaatgtggtaaagagccatgccaaaactgaaagtggcatttaattgggcattaaataaatgaatttggacctgtacacgtcgcctaagggcgtgccgcggggatattccctgccataggccacctactggccgccgtagtcgagtgtgcgctggttttttgcgcaatactcaaattgagcacacatgaacttctttaactaataacttgggatgggatttttaatgaaaaaaaatcccaaattaattaactaaatagtgaccaaaaaatgccaaaatagtggcgaaaaagttccaaatttaggggtgtaattttttaaatagctatttttaatttgaaaataatttaaaattaaggcaaacaattttattcactgattgcagttacaaaacattttcttagcaaatattgagcaagaaaaaaaatttggggaagaatttttgagaaaattttccaattcttaggggtgtaatttgaaaatgtttagttcaattcttaggggtgtattttttgaattcttggggtatatttttcatttttgttgcattttttgggaaattttccaaaatagtgacgaaacgccaaaatagtggcaaaaaactattttagtggccaacttccgaaattgtttttttagtggcaaagctccaaaatagtgattcatactaaaaatcctcgccctattcatcatcatgtaaattgcactaaagtaaattatatttaaaaaacgaaaattcgtaaaatataattaatttgacgtatcatctgcagaaaaagattaaaatatagcttcttttgtcttattaactgttcacttattgcatatttaatccatggcatttgattataaatttcgtgccgttcccctaactttcagccaatgccctgcttccgccccccgtgcttttcccacctcgtttctggccccaacaaatttgttccactgttccgccatccaatcagaccacccgcgcttttgcagctcggcactgtcccaattgctgaggtaaagccgcttctcgtacggcatcgcaaattcgcggacgcttcgaaaggtccatctcaagtgcatttgcgacaacggtgtggtaacattccagtccatgtcgcgcgggtcgccgcttaagcgaacactgccgccccgctcgaaggcggccgcaatgcctttgaaccaatcggtggcattggcgtcgaattgttggctcggccctccgatgtttgacctgaagaagttggcacgggtcggatttgcttctctttcaatcattagttattgaattaccattgagcaaaaatgaagagcaccggtggcattggcaccgaaggattatttggcattgatcggttgccagaaacaagcgtgaccatcaagtcatagtcttggccaaactcggacatttgaggcagcagaccgagtacattctgtgcacttgcatttgtgtactgaacccggggatataattaataaatgcattgaggaatcaattaaaaatgcttcttgtcaagccagagcaattggcattttaataattgccattaat

SEQ ID NO: 31814 - DNA, 1106 bp, Heterodera glycines
gatcactccccaacgaaaagttcctggcacggacagtgtgatttctatgcccggattgaccggcttcacacaaacaataaaatgaagtcaaggagatcattttggagttcatttttgttatttgtccgtcaattaatttgaaaatttcttgaaattaactaaaaggatttagagcataattttgtgcccataaactattcttaaattttgttcaaaatttattttattaaagaaaaatttataaatattacaattatacaataaatatttaaagctaaaataaggaagattttgtccaattttttttttcattttaaactcaaaattcagccgatcaaaaaatttgtgtataatcattttagtgatttcttctgtttttctgctgaaaactttagacggcattcttttggcacacaacgccggcgaggttggcacggtcacactgaatgtcgttccaccagtcggtcgcacgggtgccacacttggacacactcttccgcggactgatcttttgccaaaaagcatcattcatattagtagggctgccaaaaatatgtacaaaaatatgtaaataaatttttaaaatggttattttcttgaaaaaggcacaaaatgccataaaaattatctaattagcagggaacggatttatatgtgctaaaaaacgccaaatctgtacatatatatgcgccaaaaatccccaaaatatgtgctaaaactcaaaaaaggctaaaatatgtgccaaaaatgaaaaatatttaagagtcgagcaatgtgttcgtgaatttagatcagccatagtattcaggaggcggggggttcatgaggggcttaaacccccccccccccgaaacccataaaaagtaaaaaaattttaaattttaagcaattttttaacaaattgtcattaaaatttcaaaaaaaaattcctgcggcgcttaccggcaccaccggacagacctctcttgctccccaaaaatttttgaaaatagtgcgacgcaaaaaacgttttaaagcaaaaaaaaggtcatcagtttgatgttgagactcctgcgcaaacctagtgggtgacctactttttatttgtttttgatttaataaaaata

SEQ ID NO: 31815 - DNA, 1557 bp, Heterodera glycines
atcaatttttaaaaaattattcgtgccaatgccaaaagcggcacacgacgcacttaaaaggtacagtgtgaagaatggcagccagcagaacagaaatgagcaggacacaacgccaagcgtttttgcaatgcgttcatgggtgcgcaacacccgtcgctggtgctcaaccatgccgttgttcttgccgatgtgcactctcagtgcagtctgtgtgtgaaatattattgtgaatatttgactgttatatatgtggtatcgatatttgtggtgattgactctttaattgtctgggtcgagaattttctttcttctcgcgaacggaactctcgagttatttattccattgtgaatgcgattgggctattttatttgtggatgatcgaaaatgtcgttgtgcctaataggcccattattgaaatttatttcattttttttaaattggccccgagagtcttgataggatcctgttctaaatcgttttgtaacacgagtgcgattgtatgagtgtatttgttcgagaatttaattcgtcgagactttaatttatccctaattgggttcatcttgatcactgtgctctgcattttcgaaatcccaaaaaaatagtgtcacacaccgtttgcgacaatgtgttggtcaagaagttcatgttgtggccgagaatcatcaaaaatccgcggtccaacgctctctgcctgttcctggccaggctgtagatgcgccagtacagtgtcaatgtgacagaggcgggaaggaagaaagcgaacaccacgctgtgcgcgaggtagcgaatttcgtcgccaacataacatgtctaaacaacatggacagatatctttttttcgaatttgctcttgggtacactattgcatactgtatgtgcagtatttgctactgtaggagtttgacaaaaattgcccgcaaaatggctatataactccgggtgggagctgaaccctgcgagtttccatttttaaatagacgatcagttctgccccttggcaattttttgcatcgaaattcacgattagcatttcacttatgctgctgatcatctgatcaatcacagtactcatcaacaaatgatcaaaaaatctaatgcaacttctttcccagtgggcgatgtgtcggcatgccactttcccacattcttgagctttgaattccgatttcctattgccgcatttttggggccatcagaatgtcggtttccaattgccaacattttttccaccacctctcactttgttttccacggtgtgctgttgggactcccatcggacagtggccaacagaatgcccaatgaaaatgaccaaatcagcacgatcacaacgatcactttgagtttggtgaccacggatttgtagcgcaacggtcgcgtcaccgccaggtagcggtcaacagagattatgcaaatggtgaccacggaacacgtgcagaatgtcacatcggcacccacctgtcaaattatttattacaccaatcgatcaatgtaaggattatttccaaaatcatatttccgtgtttgaaaatgccaaccatacatgcaaaagggg

SEQ ID NO: 31816 - DNA, 1254 bp, Heterodera glycines
  misc_feature (1078)..(1078): n is a, c, g, or t
  misc_feature (1091)..(1091): n is a, c, g, or t
  misc_feature (1204)..(1204): n is a, c, g, or t
ccaggcgcaggagtgcatgttggagaagtcgatgatcgaccatcggaagccgacggtggtggcacgggtggcactccatctgtacaacatttacccagcagtgtgacgagcacttgcgcagctcgggactggccgatttgctctcctccggccgatacaaggcaaaaaaagggcggaataatcagaacacaattcaaaccatcaaccgaactggtcggatttgggcaattaattaactgttaaccccggcggactgatcagtgatattttgtctaacaaattatagtaaaaattaaaatgcaaatgaattcattaaaaatttgattttaaagaattttttatataaaaatgtttttggtttttaacatttttttgaaaaaattccaaatttgagttttttttttttttttggctcgggggacgaccttttccgtgtttaaatgacgccaattcgtttggcatcgatcctcaacaaagcaattagtccaatctctaggaggtcgagagactgtgcagtgccaaaagccatctgtacggtgccatttccagctattatttgggccaacaggcggacgacgagcaaaaatatgggacgaggtcgtgaaaaccaattaattttcccggatttgaccacccccctccccctcttttaggttggcttactttgcgcgctctttggcccatgccaaaattgcggtgcaattatgcgacaaagagcggccaaagtcggcacttcgcgaggccgtccaattcgcatacgacgtaattgtgcaaaggttggcacggaattggggggcaaacaatccaattgaaattttttttataaatgtttaaaaattctgcgaattgacacaaaaaaataaattgaataaaaaaatattcgactgttttttaaaatccaaaaatgctaattttctgtgcctttttcgcacagagaagccaacgcgcgcaaagagaatgacattgtgtaccacgagagggtgccggggcccgacgaattggccaagttggacggcgcgccgatggtcaaccactcggcttcgacccgtgcgacccgtccatcgttggtgaagatttngtccgggagctgntgcccaccgacgtggtgaagacggtatccatgtacagcgaggagaaggaccggctgaagcgcgaactgctcgccaaagtgggccaatgtgacgcggaattggagtgcgttggnggggggggggggggggggggggaaaaaaatttttttttttttttaaaaaa

SEQ ID NO: 31817 - DNA, 1124 bp, Heterodera glycines
ggagagcgccagttgacggtttgttcacttggctgtatgctgatgatttttgggtgtcctagtgggtagtccgctgtgaagttggtccacgggtagaggctggtgaagtccttgtagctgattttttgtccaggttttgcagtatgcagtagttttttaacatcagtcctcccaccatgaaaggcgtcgcgtattcgaatgggtgaattatccttccaattattgaaaaatccccgcatctgcttgtttctcctcagctcctcattgatttcgtgctcccatataacttccaagtcaacgtaacgcctcaatgttttgtgcttccttttctccctctctcttatttccctcagcgtctttccgttcggcatcctcgattcctcatccatattaccgaaacatatctcacacccatgccaaacacacccattaacttcaataattttgtcccgccttccattcgtgcctttgatgtatccgtcgacttggtaaacctccccttcgcgtttaaagacatattcgccgtaccgagagtgtgccgtctggatattgacattgttgatgtgggagtaccagtcgaggtatttgatggcgagtgcgctttgattttgttgaggggtgtagcctttctccgggacgatggcaagtgagttaggcttcagatgattgagggcaaaatttttgacgcaggcactggcgatggtcatggcttgccacaaaatgtcgattccaccgtgttttccgtccctttgtgtaagttgtttgaattcccggcgtagttctgcaagggcgtgggtgaggattcggacgtcgttgcagcattattcaggtagtttctctttgaggtcgaatggttgagtgcgattgtagttataccaattatcaaatttctgtaaatcggcttttttcatttgatcaggacagtagtcttcacgtggagggaggtgctggaggaccttatcgtagttagctgatttgttgaacatatggggaaagtgctgtttatcctaaaattatatttagatcaaaaaattttttatgcattaatataagtaataaatagagttctaggaaatatggacaaatagactcattttaaatatttatttcaataaaataattaa

SEQ ID NO: 31818 - DNA, 1115 bp, Heterodera glycines
  misc_feature (1023)..(1023): n is a, c, g, or t
ccccccccattcgttacgcctcaattccttctttcccatgtcgcccattagtccctttcataagatcattatcccaggctaattgacgacgcattgattatatctgaagaagcgtcccccacccctctataaaataaagcgagtaaagtatgaaaattgatatttgaaaacattcccaaagtgtgaaaaatgtccgacctgcccaccggtactgtaacggtggcggtcattctgtccgtcatttctctcagtgccattctcgtcggagtgccgctaatgctcaacgatttggtgaatcttcagcttgagtttggactgaaaagccaagcgcacttggacatgagcaacgttttgtggagagacataatgaaagaggtggcgacgattggccaatgggacaaaagggagcaaaagcagacgatacggaagcggagacaatgtgcgaaagggacggacaattgaccactcgaatcaaatcccgttcagacggaagcggaaatatcggcggagggggcgcgagcagtccaagcgccacttgccctcagggagcgcgaggggccccgggagtgccgggggcaccgggagagccgggtcaatcaaagccaagagcgaagttgctaacaaagaattgcctttaaggccaagacggacaacccggcacttcgggattctcgggctttctggaggattttgctcacgtgtcgcagtgccccacttggtgatttatttcaccatctcttaacctgtgtttctctttgttaaagtccaattggtccacctggccccccgggatacaaagggaggagaggctttcgcggtgaaaagggcccaatcggtacacatttaaatggcccaatggcgtcattcaattttaattttaaaggacctcccgggtcgcctggtcgcgatggccatcccggtgagcagctaatgaacggattaagccgtgtgaggggaaattgtactgtttttttatcaggtgacgaagggcccgaaggcgaattggacttcacggagatttgngagagcctgggccgagaggccctcccggcgagacgggcatggatatgcacagggcgagccggggccaaagggagagcacggacagccggggg

SEQ ID NO: 31819 - DNA, 1196 bp, Heterodera glycines
ctgaaaattttttacacactacaggatgaaacgcaataaataatgtttgtagacaaaagaaattgggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgtttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgtgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttccactgtagaaactgtctaaaaatttttgttgttaatattcag

SEQ ID NO: 31820 - DNA, 981 bp, Heterodera glycines
caattttagaaacgaaacagtgcacaaaaagagggggggggtagacgacgagagtaattttttgaaaggatcgcaccccatcgaatatttccttatttctttttaataactgtccaaaggtgactgcgtcattggctcttctgtagtccttaaggtacttggactttccacagtaaaatgtggtacaaattttggaactgtcccgcctcacggtgggacttaaaagcagggtaaagccaagttaaaaacttcagtggagaatttttagttttgaatttttacaatttaattacttaaagccaaaagattcgaaacagaagcattatttaaatcaaaaataattattaaattttttacattttagtttcaaaaaaacatacaaaaaaatgttcccaattttgaaaatgaaatagagcacaaaaaggtgggatggttagacgaaaagagaaatttttaggaagggacgcaccccatctgatatccacccttttctgttccataagaggccaaaggcgactgtgttcgttgacaagtaattatccaattaaggtacttggactctccgcagtaaaatgtggtacaaatttttgaactgtcccccctcacggtgggacttaaaagcagggtaaagccaaattaaaaacttcagtggagaatttttagttttgaatttttacaatttaattacttaaagccaaaagattcgaaacagaagcattatttaaatcaaaaataattattaaattttttacattttagtttcaaaaaaacaaacaaaaaatgttcccaattttgaaaatgaaatagtgcacaaaaaggggggatggttagacgaaaagagaaatttttaggaagggacgcaccccatctgatatccacccttttctgttccataagaggccaaaggcgactgtgttcgttgacaagtaatatccaattaaggtacttggactctccgcagtaaaatgtggtacaaatttt

SEQ ID NO: 31821 - DNA, 1069 bp, Heterodera glycines
tttagcgctcataatggggatgtataaaggcgattgtagaaggaattggaagcgtaaaaattgtttgagaagctttttgagcgtaattacggatttttacttccaccatttttttttaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccatttttttctaggcttagatcacatgcgattttcggcactctgataattttagcgctcataatgggatgtataaaggcgattgtagaaggaattggaagcgttaaaatgtttgagaagctttttgagcgtaattacgatttttacttgaccatttttttctaggcttagatcacatgcgattttcggcactctgat

SEQ ID NO: 31822 - DNA, 1225 bp, Heterodera glycines
  misc_feature (1210)..(1210): n is a, c, g, or t
tttcattttttcttcaatttattcccacgaaaaattcaatctaaaaaattatctaaaattcctctttgcgtatgaacagaagttttccaagacgttcttcgatccaccaacaggtgctgtgggtggtgttttgtctgctgatcaccagcgtgtttctatgctcgcccatcaattactacgcggaactgaagcccctgcaagtagcgccttggccggggaaccgggatcgtgaaaacaaattttgtgggatcccgaaccatattttgggggttttcgggaataaatccatatttcgacatttttgcattttaagtccatatttcggcatattttcacaagaaaaatgcaaaaaaaaagcaaaaatacaaccccgaaagatcgactttttgtaaatttttaaaaattacaccccaaaaatacgaaaaatttgcgttttcttcgtcattttggcaattttaataaatatttcaccactttttgcgaatttttctttttttaaatgagaattttttttttaaattggcaaacttggaggtgttttttatacaacggatgacaataaatcggtgtgccaccgccaggccaaaattggcggaattattaatagattagcacacccccccccccccataaaaaaaataaattgctaaatttatgatttttgaaggtaatttggactcaaaaattaaatttttccaaattgcagttgagttacgatgatggcagcagcgaatccagcactcagatggtttgcggttctgatttgccggaccatggcaagaatattgaaaaatataaagaaatttatttttattttttagaacaaaattaaaaaatatatgtaatttttgacttttcataattttaattgaatcttttctcaattaaagttataatttaaaataattttattcaaaatattccaaaacgaaaaaataacaaaaactctaatgttaaacaaatattaataagaaaaaactgacaaattattattaaaattttttgttaaaataaaaacaaataattaaataatgaaattgccgaattaactaattatttatatccatccatttgttagtgatgtcattcttcatctgttatatgtttgtgctcggatttgtccttccgctgtttttcatttcgctgtgctattttttcttgatccaacatttgcgcaaagcaagcgagagttttgaatgttggccaaganggtctaattaaatgt

SEQ ID NO: 31823 - DNA, 1447 bp, Heterodera glycines
attataaaaaataatgtgtcgaagcgaaaataaaaaaacaagaactgcgaagaaacagcagacatgtgagagtcagacactacataaaaattaatgaaaataagtgcgcacagtgcgccaagagaaaaaaagtgataaaacagtgatttttatgaaatttctaatcgcttttaacttggtcattagtaaaccaaatagagcaattttggtctcattttgaaggggaaattcttaagaatatgtttaactatcgtttttacgtaccaatatcatttttaacctttaaaatgacggtaatttattcaaattttcacccagttgaaaaaattttccctatgttcaaatggttcttgtaattttgcatagggccatattttgaccccctctagcgattccaagtttatttaatagaacttgtttttaactcgagatcggctcttccgtttttacaagggaaattctcgacaatttttgaattagcgtggttttttggcgttttgtctgtgcgaacttttgctcaaattgatgatatatgtggcgttaaattaaagatttttcgaaaaaagcagaattgaatcaatttaggacaaaaacagcttgccagactaaaacgactctctgactaaaacggccagactaaactgatccggtccgaaatttgtaaataaaaatatttaatgtatttaaaagagaatctgctgaacagagattttcattcaaattaagcagtttccgtccccgttgaaaaaaatcctttcagttttcttttctgcagaaagtgctgtactttcgccgactcctgattcacactcacatttaagtatattaaattataaatattcttttttcgtcactcactttcgcaacatcggattctgtaataacagtacatgcttttcctcccgcacactttgcattcactcggatgccttttcggtcgtcccacccctcttttcttttgatcgctttcattgccaaatttggcttcatcaacaccatttgtgtgcttttccatttccaattttggcattttgcccttccgtgccataagcaggcatcattgatgaattttggctaaaattttgtgccactaaatattcaattgctgtcaaattgtcccgttgtgggcccaacaaaacacgatggatgaagtcaaactccttttgggcagcacttgccaaagacgatgattttgaatcggttaaataataattctgctgggccactttctccattaatcgaaaaatttataaaattgcttataaatttaatttttttgcgtttgttagatataaagcaaagaaggaaatcccaatatattagcctcctatttctttttggaatggaatctgttgtagattttttcagttacttattgattgtaatatctttattttattgatcatttaaatgcaaaataatattggacaaagcaaagggaaaattt

SEQ ID NO: 31824 - DNA, 987 bp, Heterodera glycines
agagagagagaaaagacaaaaatgttttatgttgtcataaatgcgagcgtgtgtatgtgcgtgagtgtgtaaaacaaaagagattttccgatcattgcatttcgtttcgtttcgtttctttgtttaatttccgctaaccgtttcgctcgtgccttcctcaacatccgcatctcgcgctccggcattggtcaaattggtcgctgccgccgcctcatcgggctcgccctcactttgtccatcatctgccgtcacaacgccggtgcctgtaataacgatttaaggaaattaaattattaattaaatccatctgatcagttcatattttgttgaactgacaattgctttacactcactgttttgtccgtggatgtgctgattattggcaccgctgctgctgctgttgtgacgcaccacgttgctgagagtgttcatgcccggctgttgttgttccaccgccgcctcaacaatgattggtgtgttgctgctgctggccaaatttgcgcctgagaatgtgagggaaaaatgaacacagttacaaaaaaaacgttcgaaaaatgcgaaaatgcaactcaccaatgtggccggatgccgagagcacgcggtgacgagactcgttgttgtagaggagattgaacgggaagaatcccttggcgttcttcccctgctcccgaactttaagacgactgaattcgacgatctggccgcactgaatgttgttggcaaggcgtggcatgcaatcctcccaacagtggacggccatttcctgttgggtgttgtgttggtcgaagatgaggcgcacgtcgaagccattcagaccacccatcgtggtgaacggaccacacaacacgacaagcccaacaacacgccttaaaacaaaacggggccaatgtataaacaatattaccaaagtgatcagaatttgagaacatacccaattagcatggcgggttgccaatccaaaagaaccaagcgggatttgacatcccg

SEQ ID NO: 31825 - DNA, 1311 bp, Heterodera glycines
tttttaaatgagtaatttaggggccgcaaatgtcgggctcgcaaatgtcgggaaataacacttaagaaatgggccgcaaatgtcggggccgcaaatgtcgggccgcaaaagtcgggccgcaaatgtcggtaattggctggggccgcaaatgtcgggccgcaaatgtcggggccgcaaatgtcggggccgcaaatgtcgggacacgtccttgtgtatgtggtgcgcttgatggaacccttataaaaaatcgttttgtttgcttgaaatcgacattacgcatgaaaaatctgacggattcagcgatgacaataaaggcactgattcatttgcataatttttaattgacacaaaacaagaggaagaaaatgatgatcagttcatgttatcagaagaagaaacattagaagaaagagaagatgaaaatatgcaaccaatcgaaaatccttttttatactgcgatcatgcaaaaaatctatcaaatttttctctcagccaataattttgtttagctaggtttttaaaattattccaattaaacaatttgttgataatttttaaatattatttatatttcaatgatagaggtttcaatctataaaatgctttttaaatgaaaattttcgattaagtttaaagttttttatgaattttatcatacaaacgattgggcatgtctccgcttcggagcggatacacccgcatatgatttgcagaagggaaggggtgtcatatgtgacggcatcatacgtagaaaagggagttaattggaacgcgcatatgattaatcatggaaaagtcgtactccgcgtatgacggcgtggcagttacgatatcatatctgtgaccatgacacaattgaaacgcgcctatgacactatgacacgtcatatcatacgccgcatattatttttggggtgatttaattgaaaaagaaattttgcgtatgatctgacaccgtgtcatagagtcatatcgcagatatgatccgaattgaaataggcccctggtcgagttcagaaatataaatacaaagcattttataaataatactaatatttatatagaaaactaatatataagcttaagaagtatttacagaatatttagaattaattcatcagtctttgcaaaataatatatatataaataatttaaactatgaaaagctgaaaagatcaattataatgaaacagcacattttaaatttaataaataattacatttactcataaataataatccaaattatattattacatattagcggaaaatacaaatctgatacaaataatagaaaaacaaaaatgcaaa

SEQ ID NO: 31826 - DNA, 938 bp, Heterodera glycines
  misc_feature (887)..(887): n is a, c, g, or t
tcataccttttaattatacgccatttaagaaccattaaacgtatttttggtttaccccttgaacccagctctagccttcgaaaaaaatattctataaaattcgaaaaaatgaggcccaaaatttcggaaattggaattccgaccccactcaaattgtttagcattttcttcgtgccaatgccatttcttccgtcagttacgaaattcatttttatgttcgcgtgccgtcaatgcaaattgtgccatttgaattggtgaacgaatggacaaaggaaaagctgacattggccaaagcaaaggaaaatgaatggtacatcgattggataatgaaacgaagcaaaattattggggagacagcggcggtcaattggaaagacggaaattgggacaacaattgtaactgtgtgttcttttggcttgatagtgacactaattgcattgtgtgagaaaacaacaaaaacagcgatcaaccgcagaagaagaaatgaattaattagaaatgaccgatcgaccataattatatcattgatcaaatgcattttatgaagaaaaaactcaatttcggtaaataaatcggatgtataaaaatggtttggtatctatcgatgtatgaatttctccttgaaacttgtgacaattaattttcgggattttgacgatggatttacgacacacaaaattagcaattagcaccggcaacattaagtgccgatttgctgctgttcttttctcttttcagcttcattctctcctcttccttccgccgaatttttccttttcctctctttctcttccgtctctcctccttccctaatgctatttccttccttttcctcctctttccttgtttctccatttttgctgttgtccatcttaatttatttggntaaatggaacattttgatttttttattaaagaaattttgaaactgctgggg

SEQ ID NO: 31827 - DNA, 1212 bp, Heterodera glycines
tgccgggggtccgtcttcgatcgctgtcatcctccaccggcgaccagcacgtcgacagtagcaacgacaacagcctcggagatggcggttatgctggcaaaattgcaccaacagcaggtgtatagcaattgcaattaaatgaaaaggccgccataattgattccttttcctaatttctcagggatccgacatcgattcgggcggtgagggtggcggacgtgcatcgcttccagactctccgattccttccgccagtgcgttcaccactacgctggcggccagcggcggactgaacctggacgacgaattcttcgccattccgtccagcgaaggtggttgaacggaagatcggagtggaacgaagagtggattttttgatggatttatcactttagattctccacgcaaattgctttacttcatcggcctagtggacattctcacttattacggagtgaaaaagcgtactgaaatggcagccaaaacggtgaagtatggctcaagtgcggagaacgtctctacggtgaagccggaacaggcaaataattcctttttggttgcttaaaaaaactgttcatttttcagtatgcaaagcgattgcttgagttcgtcaatcgtaatgttgtatgtccgactcagcaaagctcgtcgacagcggatgcgttttcaccattaacaatcgctgaccctccgccgtcacagcgtcaaattggcagaaccgaactgatggttacagcgaccccccccccagctgaccatgtgacaataatcactgaaccgatggcggccgcgagcattcactctcaaaattgattgttgaatgataattttaaatgcgagaaaacagaaaatttccatacttattgtagattattatgatggatgttgaatgtgtggtgtctgtcagttatagatgcaatttttaattctgtacatgaatgggtatagaaatgttatattttactttctgacacttattcattccatgttcattcactctttccaaatgcttcacacttcatgcccattactttttgtttctgaaacatgcaaattagacccgtatccccccccccccccccccccctcccttcccgaaatgaaaaaaaatggatgtgtatcggtactgccgaacgacttaattactttagattaaaaatttccaacaaagatagacgtttcttgtgggctaaattttagacctgccaggcc

SEQ ID NO: 31828 - DNA, 1081 bp, Heterodera glycines
tccaaattgacaaatgacacataaaccaacgataaatgagccctttccgctgctatccgacatttttagcttgatacattcacaacaatcaatagaaagctaaaagagaatttggaatcattccttatatgcccataaaaatgagaaatatgtacaaatataaattaggaataaagaaaggttggcacttttccgttttaggccctaaagttttaattttttttttaaattaacaaaggccgcacagaattgcaaaaattgcacgtcaaaattatatcaagggcataaatcccacaatttgagctaagatttcctcaaatagatttataacggaaacaaaaatttgtgcaattctgcgcgcactttgttgcttttttaagaattcaaatctaagcccaaaattgaaaagtaccgaaaggtttgacattcaattgggttataagaatgtgatcagtcagtattgtctgtgctgctgttggttcatcgccctttgctgctgctgttgctgtgccatcataaattgttgctgtgcgttcagcatgcccatttgctgttgctgctgctggggatgcatttgttgcactgaaaatttaatttacagacgcaaaaatgtagctgataatcactgttttgttgctgctgctgcatcatttgctgctgattgtgagcaaacccgcccatttgcgcggtctgttgccgcatttgcaacggctgggcgctgctcatgccaggatggaccattccttaacagcggacaaccgactaattcctaacgcaacaattaatcagtggctgggtgaccctgttgcggctgctgttgcgactgagtctggtgcataaactgaggcggcatcatcgccccgcccccttgactcggaatgagcgtcgtcccctgctgctgattctgtgccattctcatctgctgctgtgctccgttagagcccatctgatggccaccaatttgcatttgttgttgcgaagttggcatttgctgatgcacgttaacaaattcaaaatgccaaatgcggtaatttgtctcccgacctgttgctgaaacatctgttggtgctgatgcgattgg

SEQ ID NO: 31829 - DNA, 1587 bp, Heterodera glycines
aaattttatttacatgctagtttaggcactttgatgctttttctatcaaaaagggagatgaataaaatttttaaaaattttaattcctttttaaacagcacaaaaagtttagacttaactttttagtgaaattcaatcattcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcatatctgaaacgcaccaaattttatttacatgttagtttaggcactctgatgctttttctatcaaaaagggagatgaataaaatttttaaaaatttttaattcctttttaaacaggccaaaaagtttagacttaactttttagtgaaattcaatcactcatttttcgagtagtgatcagaagcgcaccagattttgcaggggcctaaaaaggtcaaggaaaggcgtctctgcgtggatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtattcctgcataatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaatattttatagatttttaaatgtttggatttttttggctta

SEQ ID NO: 31830 - DNA, 1351 bp, Heterodera glycines
  misc_feature (71)..(71): n is a, c, g, or t
  misc_feature (91)..(91): n is a, c, g, or t
  misc_feature (93)..(93): n is a, c, g, or t
  misc_feature (102)..(102): n is a, c, g, or t
tttttgccttttcacaagagattttattaaaaaaggcaaaattcgccttaaattaataaggtgaaagttgnaaaatgtttattaaaaaatntnaaggatganatataattaaaataatcaaaaagaaaaaaaaatcatttattttttttaaataaataaaaaacattttcagaggcagtgcctcccgaaaaaaagacaaaaaattttcgaaaaaaagctaaaaaaatggaaattttaaataaattaaaaagtgaaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggaaagcaatgaaagtaatttaaataggcatatttaaaagagctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaatcaatttatttttctaaataaataaaaaacattgtcagaggcagtgcctgccgaaaaaaagacaaaaaatttttcgaaaaaagctaaaaaaattgaaaatttaaataaatttacaagtgaaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggaaagcaattaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaatcaatttatttttctaaataaataaaaaacattgtcagaggcagtgcctgccgaaaaaaagacaaacaaaaaatttttcgaaaaaaagctaaaaattgaaaatttaaataaatttacaagtgaaaaaaggaaaaaaagcttacaacaccttcgattcccaggacgtctccgttccaagtactaagaaggcccaacgttgcttaacttggcagatcggacgggatggcgtgctttcaacgtggtatggtcgtaagcgaaaggaaagcaattaaagtaatttaaataggcatatttaaaagagctatttttttgccttttcacaagagaatttattaaaaaaggcaaa

SEQ ID NO: 31831 - DNA, 1129 bp, Heterodera glycines
cgagtattttcgtttcaaaattttcttttttaaatggtatagagcatcagaaagagagacaggtgagggttcaattgagtcaaactcggctcgggctgtccactgagcaaaattctcaatctgctcaatttttgcacttcagaatactgtgggtatagtgttagcatatcctcgaaacgtgcaacccaccgtgagaatgatacacttgggtttccatcataaccctctcgaggggggtaattccccctaaaaatggatctgcaaccataatttcgcaacttccgtccccaattgggatgttgtcttccccttccgttgcccctttgtcgtcaggcaatcgattatgttcttgggattgtccgtcatcaaaccattcaccaaatccctctggattatcttgttcaaattccaacaattgtactcggccttttagagcatccaaattttcggtaattttccgaacctcctccttcattttttcaacaattttcccaaatcgaacctttgtgaacgtctcataacgttccatatgattacttacctttccaatttcttcctccacttcaataaacttttctttggtctcaaatgtgtccatttctgtaaagttctcgagttcctttatcgaactttccaattctcttactcggtcagcggtgtcctgaatctgaatttgactcgagatttgtgaaattgtcgaagaatgggtgtttccgtttatctcaccagatgccgtcttcgatcggctcgacctgcatcatggcacagtccctaatcggactccaatgcgggaaaggcgatctaatcaattctgaacagttgagttgacttgaattcgaacaaaaagccgaagcactcaaaatccatgttttacatttgaattcggttatttcaatatgaattatggactttagaaaaggcaatttgaaatttactctaactgctaataaaattttgtcgttaatactcactcaataaaataggttcatttttgcgggtaagcacaaataatgcaaagtgaaaagattagtgattttcgtaattgcttaatagggcaacaattggtgcaattccacgggtcctttggtgcacactttggccagcacgggaggcatcaccaaatcgaact

SEQ ID NO: 31832 - DNA, 1086 bp, Heterodera glycines
  misc_feature (1003)..(1003): n is a, c, g, or t
tttacatagtaggaaatgattaattatatcaacaataaatttgataaataaatataaaaataaaatttaaaaataatttataaatttttttcttatgccgaaaaattgaaaaaattagattaaaaatcaaatccattaatgtaagaaatattttattatttcaatgacaaaatattgttaattaataaaaaattgttttctaacagaatttaattctatttcttaaggggtacatttgtggcaataaaattatatacctagttgatatttgaaaattttccttcttaagtatgcatttcatttattttatttcatttattaaatatgcgaataaaaattcatatattaaaaaatctacaacttgaattaattaattaataattattattttcttttagttgtttatgaccaaataacgataaatgaactgaacgcataaaccaaggattgagaaataataagcaattatccatgtgcaaaacagaaaaccgcgacaagttgaagacaaatagggcgaaatatatgagacagaaaagccaaacacccatccatcatattcaatcacaaccgaaaacaattatagttaaatgctattgcggtgtgaatcaaaattcgcctgtacaatgtcatttctgtgggcgatcgcttcattaccaacaaaattaaaattgtgttcaaacacaatgccaaaaacacggtaattagcgcttcacatgatgaattaggatgttcattttgtttccagcaaattttgatcaaattaaatagaccttaaaaattttatttgaggaaatgacggcaaattaaatgccttgtcagaaattttgcataaatttattttagaggatttaagcggtagccgaaaaaataggcaaattaggagtggtatcagcttacatcactgatttcgagaattattatttcataatttttgggcaaaactcatattttctgtcagtgatatttttattcctgggattttttgtggtaattccatgcatanacactttttgtctggtggtttaaagtaaaactttttcagttttatttctttattaatttagcgcaaataaaaattaatttttg

SEQ ID NO: 31833 - DNA, 1068 bp, Heterodera glycines
tcaccatcgtcagtcagcttgttgtgtgtgggtgtgtatgtttctgcgctgctgccgctgggttgacagtgagtgatcaaagtgatcaggatttttttgtgtgtgtttgcgcgtttcttttccttcccccaattgtttatttatttgtgtgtacactctctgctgatcaaacacacacgccgctcgcggacgactgatcagtgcgggcgatccccaacctttgattcttaggcttttttgacaaaaaaaaatttttttatgaacgtcattttttgacaattttctcgggaacaaataaaaaaaatcactgcttttccgctccgatcacttcttacttaatgctgcactcaaaataaaacaaaaaaaatttttccgatcagtgacagatcaaagtttgatcacaacgacgacggacgacgtgtacacaaacattgagagtttttcttcctccaaatttcctcccccggggggacggatttgcaagaaaaacgatggaaaaacggacggaggaacagcagcaaaaacgtgtgtgttagtttgtgcccacccacattttgcacacaaaacaaccgcaaatgtcctcaaaatttaacggagatttgcatcatcctttgtcaaatggtgacagttttcgagaatggaaagtgattatttgtggtggtggcgtcggtggatgggactcgaaccgccgcgggacccaatataaaagggtggcgcactgggccattctgctgatcagaggcccgccggcgttccactgtctatatttttgaaggattcgaaatttcgaaaattttgcccaaactttctcgatgtttaaatttcgagatcaatacgatgggtttacacgagagttagcctcttttacttctttaccccccccccccctctgaatttaattttgattttttttaaatttaaccgattttttcgggggcttatttttctccaattttcacaattttcgcaaaagacttttacaaaaatgttcaaacgacgaactttcatcttttccgagcagttcttcccttttttctcggtttttttgaaaattttcacgcgaatgct

SEQ ID NO: 31834 - DNA, 2093 bp, Heterodera glycines
tttttgctttttccatgtaggcattgattttttacggcatatttttctcaatttctctttttatatgcctgatttatacaactataatgcgcatacatttattaatttgtataaaattttaataaataaatttagtttctgcttttttgaatttcccattttgggcatcgattttccatggcaaattttctaaagcaaaaaatgcatataaaagtgatggcacagattaagcaaggcattcgcattgaataattttaatttaaaattatataaaaatgcattttctaacttttttctattttaatcttttagagaaaataagtggcaatgaaaatcattttcatttccatttttctcattgttttttcctctacaacaaaaaatgtgcgtggcgttcttattggcggcaacataaacaacaggggaacacaaatagttggaagggtaacagtgaatggaccatcgaaagatgacattggacgaaacataaacaacggtggtggaacacagatcattaaagcagtgaatgtaaaagatggagcagtcatatcggatgaagaagaaacgaacacaagcgatgctgaaatggacgaagcctggagaagaagcgatgacaaaggcaatttaaaaattaaaatttaattttatggaaaaaggcaaattccattcgtagaatataagtaaaactgaatccatagctaggattgtttttcatatttttcaaaagatcgaaaggaatgcgttaccagcggcacctttcggcaccgccggttcccagcacatttggcactttagtaatatatttctttttcttcaatacttttacggtctttttggcattgcacactatctaataaagaagaaacccaagtggtggtgggattttccgaacgaaactttcagcgtaggtaaatcagtcccccctctttgtgttatcaattttttaaaataaatttgaaaataatttatgtttttaatattttttaggtttttctgagaaatttaaccgtaacgatagtgataatgaagatactgctgaaggcaactcttccaatgatagtgaaattgagaagggcgcgaaagcaaagggtgttcgacacaactcaaagaataaagggatcagcgaatcgtcgagaggaagcggtgactttggacattggaagggatggaagggtaattttgaacactaattttatcttattaaaaggatggagagaatttctatctatattaaaagtgtcattaaaaggcatattttatctcataaaaattaaataaaagaaagaaggtgcccggcggtgtctgtcaattatttaataatatttctcatcttcaatattcttttagggtgcgtaaatcaccccccccctttttgtatagtaatattttactaatattttagattttgaccagaaatttaaccataaagatagtgatagtgaagatgatgaaagcaactcttccaatgacagtggtggtggcgacgttcaagaaaagactggacaacccaccagaaactattggaaatatttgaagaaagttccggtgccttttctaaatacgtttcggaattctttcaaagggaacagtgaacacgtggctggagaagagagaccatcgcgggagaatgttcttgtgcccaacataaacacgggtggaggtagccagcacattgcaccggtaaattttggagaaggagcgaaagggaatcaagttgggggaaactattgctctggaggtagccagaacattgcaccggttaatcttggagctggattgaatctggctcgtgttggaaacaacaaaaacagtggtggaaaacagacgattggagcggtaactattcgtcgatcgtgaaaacaacaaaagcactggttggagaagccacacgattgaaaacatgactatagatcgtaacttttttcttttaacttgtactgttgtactgcagtgataaagccagatattagtcagaaatgtgcctagtccaaaccgtcggatatcggctttatctctgccgggatggctaggtaaaactcttttcattcagaacattgttagaatttttaaatttgaccattgcattttccttt

SEQ ID NO: 31835 - DNA, 1017 bp, Heterodera glycines
atttttaggtgctaaaaaatgctaaaatagttagtttttaggttctaaaaacacccaaaatagatgctaaaaatgggaaaataggtgcaaaaagttccaaatttaggggtgtaaaatcgaaaattttcttcaaaaagcaaaaaaaattatgccaattttaaaatccaaaattctcgtcaataaaataaacaaataaattttggagatgatttattggggaaccgcccaactcgccgcggccatctcgccgcgagactcgcgcccacggggcaaacctccgccgtgccttgttttttgactatctcgccgccagattttttcgttaaaaatacatttaaaactatgtctcaatataatacatttcatcaaattttctctccaaactaagatgattcaaattgaaagctaacgcaggaaagaaaaattgcagaacgatggattcctcggcaattgtgaagattattggtcccacaaaaaaaaaataaaagcaaaagtcgtcacagtgatcaagaggcgtgtggcggaatgcatggaattgccttctcaataccggtactaatttagtatgtgaaaattttggtcccttaaattcagggttctgatttttgccaatatttattacgcaaattgggcgcaagcaatgacagaagtgttcgcagatggaacatttccattgcactgcaaaacctgcacaagcgcctaatttccgaaggacttcaaaaggtaatttcctgttatcagaaaaagaaattgtctccttctcaaaaaaaaaattgtctcccgtttaacgctaccgaagtgaccccgttttcgtagaaacggctcgtatgatcaccgcgctcgcatttttgccaaatcagcatttaactgctgcaaactgcgctgaacgacatcgtggggcaaaactggaccacaatttgcttataaaataagttccttcagtgttccctacaatttggcgtttcatcgaagttcttcgaatggatcagcgtgcgcgcgacgccaattatgtgaaca

SEQ ID NO: 31836 - DNA, 1534 bp, Heterodera glycines
gtacccaattataaaatggagaaaagcattaatttacattattagcactcactttccaacgattccgactcattggtacgaagaaaaggcaaatgaacacaagcaaaacacggtgaagcaacgtgagcagaagactcgtgcaggtggggctcgaccagtgggatggagcaattgggaaaaagaaaggtcagaacggcgtaacgaacgcgacagtcaacccaaagaatggaccaaaaacgcttcggaatggcatcgagaaggccaacagagagacatcggacgaaaattataggataaattttaattattcattgaaatattaatgaagagcatcgtcttaaaaaaacaatagtttaataattaattagacattaatgggtaaaaatttattcatgaagtgcagttttagagatcaacactaaaaagaaaaacaatgcttacaacacatttgtagcgcagtgaaaaaaaaagctgatgagaagcaaatgggagacagagaaaaagagagaaattgagagactgggggaagggaggggcggggcaaatttcgaatcaaaagcggattgactttcttcaactcgaaacttcatcgttctcgtcctgtaacgctttctcactttcattgtacaatttccgacgttttaatcccaatgccggcttaaagtaattcaattttacaatattatatggaaaataattatgacaagcagggaattttagtgaaaagactcaatgtaccagattttttgcatgatttattaatttaaaaaacgcttacttggaattttcttgaaattctaaattttggtgaacatcggaaaaataaactcaaatcagcttgatttagtgcggaagtcctcacagtgttagagaaattaggtgtttttgttttaatccataatttttggcctatcctttttttaaatatgttcaaaaccaattgtgattgaccgttttgagtgtagtgtcaagcattggattatgctccttcagagaagtgttggcgtaatagcgcaggtaattccaataagaggcggacgcgcggtcgagagggggcaagccccctactgcgacctttttccaaaaattggttaatctctttgaccccggtaggggtcgttacggagattaagccgtaaagaacagatactacactttgatcttagccaaaaggccgagaagcgatgcctgaacaggcaaaatgggttccggaaacggatccggcaccatcgaaaacatatgggtagcattttaggcgaccaaaattgcacatttgggagcagagatattgaaaaaattggggaaatagcgtttaacgggagggacaaataggggaaagaaacaagacggacgagagagagtgcttcctgaagaggaaagcgtaggagagagtgtgtgccacagacatgggaagggagaaagtggggggggggcgaggcagcagcagcagttgaaggtcatgtcgtcgcacgccgacgaccacttctcttcctggagggtcattgactctcgctcgttctctctctctctctcc

SEQ ID NO: 31837 - DNA, 1479 bp, Heterodera glycines
  misc_feature (21)..(21): n is a, c, g, or t
  misc_feature (30)..(30): n is a, c, g, or t
  misc_feature (1329)..(1329): n is a, c, g, or t
acgtatgggagatgctgctgnatacggtgncgagcgtagaaatggcagcaaatgtgatgtttgtacggttgtctgagtctgccatacgcctgggtcaaagccgctcccttgtccgatattccgtcgacaaaaaatgttttctgcatcccattccggtccttgtatgtcgtccgaaccttttttccgaccagctccttcaatgccttcactcggtcctcgggatgattgagcttgtcgcggagagttttgggggaacagccaagaatttgggcacaaaattcgatgacgaggacccattgaagcagaacgaatgaagcatggctgataaattgccgggtcttttatactcccggaaaattagaccacgcccacttttgaaagctatttaagccaagattttctcgcacaatcaaatcagtcttactaaacatcatcatcaaaaatggcagagcagtttgcacaacctgaaacccaggagcaccaagtgaaagaagctaaggaagcacgagttgatgaccgtttcctttggaaaatcacgcggggccaatttatgtttgcaattcgactaaaaggtgcaggaaataagcagcaaaatttaaagaaaaccattaatacttaatccaatttgctgaaagaaactttttagatttatgtattattgagtttctacaaaaattttctgttttatcaaaaatttgagagtgtgcattcaattctttgagaaaataagttaattaccctcaaaaaattgggaaatggagcaaaatctgtagagacactgtctaaatattctttaattaatacactaattgtccctcttattcaggacgccgagatcaaagagctcagacaggacctagcggaaaaggtgctggataaggacccatttgggtatcccaaaaattacaaacgaaggattcactattaggaaaagatgatcacacatcagcaaaaaaaaataaggcagtttgaaagcgatcttcgcgagcttcgacaaattgtaagtgtatttaaacatttttttaaattttaatatttaaattttctatgaggttaatggaatcgccgtttcccatgtttcaacaatgcccacttcatctgccgtcgccgaccaattcattgccaatgacctttacgaaaaaaaagggtggaagaatacgaaatcgaactggccgggctctctgatcagcgcaattggcagaaaagcgaggaggaacaaaatttagcgcaccatttgtgggatgccgtaagtttttctgaaggaattcatcatgtattttggggtgaaattcggcggggcatttacaagggatgggcgggattagactnaaaatttaattgggcataataaataacttgtaaaatataaaatatttgacacaggaaatggaaaatcaacggttggattatgaactttatggaaagcaaaagaaacgggattgccacatttgccttctccaccaacgactcatttcgaaa

SEQ ID NO: 31838 - DNA, 861 bp, Heterodera glycines
atatagctaggggttgtcagttaaccaaacaaaaaaaaggaattttaaaaaacttttttttcaaactccacaaaaaagtgtccattgataattccctgcttaaaattataagttatcaaatagaccacacctttcatattgatcgatttccagacatggccactgtgcattttgcttgtaatcagcaatcgttttgtactcctctgataaaacgttttgatgataaaatccagaagcgcgcttttttaattggcattgacttaaaaaatataagaaattatttgatattaaaacaaatataagaaattatttggtaataaacaaacataaaaaaatatttgatatttttaagaaaaccgaacaagaacacggtttcggttagtaattctgcatataggaagttgaaatgattccggtatgcgaaaacgaataacaccgataagtctcgaccagacatttagcgatatgatgttatcaaaaaaataatcaatatttgagcccaaatcatcagagcttggggtgatcgttttggcgccgacaatagagtcgtaatcacacatttcgagattctaggcgaaaaaaaacaaaaaaagcaaacaataaaatttaccagacaaaaaggaacataaatgaacacacagacccctgcccccaccagcccccagccccacgaacacctgcccgccagcagacccctgaccccaccagccaccagccccacgggcacctgcccgccagcagacccctaaccccaccagcccccagccccacgggcacctgcccgccagcagacccctaaccccaccagccaccagccccacgggcacctgcccgccagcagacccctaaccccaccagccc

SEQ ID NO: 31839 - DNA, 1561 bp, Heterodera glycines
tgcagcagctgcaggaccaggtggaccagctgaacaccgaacggggccaccttccagcggcgccttcgtgcattggctaaccaattggggcgcgattgatttggtcgcagaatgtgcgcgagtttttcatgtttttgcgcgtttgactgaacacaccacaaaaaatgctaacgaattaatttaagatcagattattccattccatattcatttttattgtttattttctttgttcggctcaatgattgatgtctcttgtgtctcgctgctgtccctgatcgatagggatgaaaaatatgggtataaattgcaaaatgtggccataaaatgcaaatattgagtgaaatgtcttgaaatccgtcaaattcagttaagaaatcgcgaaatggctgacatgaaattttcgatgtgatttaaaaaaacgccggattatgtttccatcttgcctagcagattcaaatcaagttaaaagttcggataaattccatgattttcatccctacttaataatatcctcgtcgtccattatttatctatccaattttctgcacatactataaaatgccaatgaaaattgtttgtgcgttttgtttttctattgttttttttccgattttcatcaacacaacatatccaaccacagacactgactgtcccttctgtgtccgacattctctcccgctttctctcgcaatttcactttttattattattattaatgaaaaattgaaaaataattcccctttttatttttgaacatttccttcctcccgcacacattctcttggcactcctctctttctgctcatttttaaattatatatatatatatatatttaaaactcaaaaaatgaaattgtgtatttttttggctatgacgtcatggaacaataaaatttaattattacacaatttaaattgaattaattatttttcaaatcctccgccaaactcctcccgacttccatcatcatcatcatctgttgtaacgatgagtttcgtctttatctctttctctcaaattctattttattcttgccttccgttccgaccaccgccgctggacccacaaaaacaaatcgccccgttcgtttccatcatcaatttttgtgtcccatcatttacccatcaatcatcatacattcctctttctcccccccccaattttacatatattatgctttccaccgtttgctgatcagaatcgaccaattttggctgactgatcggagaatgtgaccctcattcaccacccaattcccacaaattatgcattattattattacacacaccaccaattggcactttacgcttttaagaaaaatgtttatataaattaaggaaaagtgcttttcgatatgttttttcatttaatcaaatcaatttgagaggatttttctctttgttttttctttttgaattcgcataaacatattacgatctttcaaaatataaggaaattggggtccgaaacttcaccaagttattaaatttgtattttttgggatcattttgaccggatttttaaacacacagcaaccaattattattgtgcaagaa

SEQ ID NO: 31840 - DNA, 1088 bp, Heterodera glycines
  misc_feature (1054)..(1054): n is a, c, g, or t
  misc_feature (1062)..(1062): n is a, c, g, or t
ccagggcctaggtttttaattctttttttttaaattttaaattatggatgcacccaaaatataatttttgccttggaaaacacattaagagcttttggaaccctaaatgtaaaaaaaccattttatagaaaccagaaaatttaaaaaaaatatatctacaggaacccaaaaatgcaaaaaatttactcaatcaaaacacgcaaatttcacttacaaaattgttactacctaaattttaggaattaacaaaacaactacacaaaaaaattttttttgttgatattattgttttttgaagatatttgtataatatttatccattatttgaaaaacaaataaataaacaatgtttttggcagaaagtaaattttgtttcaaataaaatattatataaatatataaagttcattatgaaattaaagaccaaggaaataaatacaaacaaaaagttttaaattttatttgttatactttaaaaacataaagaacaaatagattcaacaaaacaacaaaaatgaattaattgttgaactctggttaacgcagaaagttaaataaaataacagcaatgaaaagccaaaatatttataaaaaaaatagccaaaaattttcaaaaaaatacaaacttcggaacgtaaaaagcaacagaagaaaaaaggaccggaaaaagacaagccttataatctgaaaaaaagttcatatacaaaataataaatatatagttaaaagacattgaagaagtaaaatattgatttaatgcataaattaattttttattcgatgctttatcctagatagtatttaaaaccccaaaatgtaaaacaaaaaatcgataaattaatcataaatattctttaaaaattcggaataaggtaaagttgaatcaaaatccagctattaacgaaaaattggtaatttatataataaaatatcttgataataaatataaatttgaaccaaaataataataatttgttaagcatacatttctgtttaaagaaaatcaatttccttaataaattaaaaaataataatttaataaagcaagatttgnatatatanttaaaaataataatttaatcattttt

SEQ ID NO: 31841 - DNA, 2019 bp, Heterodera glycines
  misc_feature (30)..(30): n is a, c, g, or t
  misc_feature (90)..(90): n is a, c, g, or t
  misc_feature (96)..(96): n is a, c, g, or t
  misc_feature (132)..(132): n is a, c, g, or t
  misc_feature (156)..(156): n is a, c, g, or t
  misc_feature (189)..(189): n is a, c, g, or t
gacagggagattatttttcgacagattatnttagtggaaaatttttgaaatttattttgaatatttcttcaaaaaacccccaaaaaaacnctcatntgaaaatgtagcctcatgaccctatcaaaaaatcancccaaatgaggctaaagcctcatnacctggggaccctgatttaaacgaatttcaatntagaataaattaatttttataaaaaaagaagttattttttcgaaaaaataaaaatttctatttatccccgggcagataaatagagacgggcagattaatggagacgggcatataattagagaaaatacgtaagtaagtaattgtgaataaaaatggaaaataaagcatgaagatgcaagattcaatttaaaaggttctaattggcaagggatgagcttcggtgctgaacacccattggtccaatgacaacatttgttggtcatcggagagcaacaagtacagatatttgagcgactgaaaattacagtgttttaccatatttatttttttaatggatacataaatagtaaattcaaatttttcaaaaaagagtaaaattcaaacactgttaaacccccacctcggctaggaaaaatgattccatcaggtcccggtgttgaacgggaattcgtttgacattttgcactgaagcatagccgtcaccatttgaccgcttggcgtaccgttcaatagcctgtcaatataataatatatgtaaattaatatcaaaaattcaatattatttttcaacaatttccattttttattggaaacagagtctatctagcatgctctcaacatatttataattgaataaattgtatgaaaataaatatttttttaatttactcattttacaatacctttctaatttattctgaattaatatatatttcgttaataattctcaaaattctcctccgtggtgaatatcggcaccgccgggccctaccacttcaattgaaaaaatggcaaaattagtaaaataaggtggagcaacaaaaaaaaaagtcgccgaagatatacacccctgttggccgtgtggattatagtcacctgaaatgcgtcccagccccagtcctggtactgcttgtcaccggtcagccgatacatgtaaaaccatgctaaaatgtctcaaaaaattgtttaaaaaattctgtgtcattctctccatcaagtgcgacccaccttcaaatgcctcgggacgaagcagagaatgtgcgtcaagcggctaaaaagcaccgaattaggaaactgtacaatacagtacatcaaattgtcatttggcaatgcaatagaattttttaattgcctatcctaaaaattcgataatttttgcaaatacaaaaaaacacccaaaaattttgtcaagtattttttggcctttttttttggaaattcagcaaattttgttttcagtaacatcattccaaacagatttttcttgaattttagatatttttcaatttttttccaccttaatgtacaggtcaggcactgttgttgctgctgctttacgcctctcaacattctccgcactcatcaactgttcatgctcaacaccagcaacattgaaccttattacaatacattagcaaagcaacatttggtttgttcgtaagttttaaatgttaaaaataggtttcataaataatttaaaaaattgtttttttttgagttcctataggaaagtgaccagcagaaaaaaaggggaccatcactttgtgaagttgggaaaaatcagtaaaaaaaagtaagaaatcaaaagtacagtagcaaatttaaaaaaaaatcaaagaataaaaagcagccaaactcttaaacttttttggaataatcaatggggaaacattcgaataaatcaaaaataacatgataaaacatgtgttgttaacccatctaacaatcagcactttttctgatcacttttggcgcataggcaaaacaaaaaaaaggcatccaaattcaattaacaaattggaaatagaaaatttcagtcccctttttttt

SEQ ID NO: 31842 - DNA, 1704 bp, Heterodera glycines
  misc_feature (84)..(84): n is a, c, g, or t
  misc_feature (149)..(149): n is a, c, g, or t
  misc_feature (170)..(170): n is a, c, g, or t
  misc_feature (176)..(176): n is a, c, g, or t
  misc_feature (233)..(233): n is a, c, g, or t
  misc_feature (1681)..(1681): n is a, c, g, or t
ctaaaccccttgctttttaatcctggacgacctgatgctgagcgtaaacaacgatttttttgatttattgttcacccgaggctnccataattgggacgtaagtgtgattttgtaacgcaaagtcttctatggacgcaatattcgtacgncaagagccaatagccattttntggttntaactcggaatcctttctggcccaacttcagggtcagaacggtgggatctcaactcntttccgaagaggttaaattattttatggaagcatacaatgatgcaaccagcgaacccgttcagttatttggttataaatatgcatcctaatgcgcccgagtctgaacgtttaacaactaaaattttcccagatgaacagcgtgaggtgtacctaccaattgaatagagaaagggtataaaaggttgagaaaatctgtttttgtcactacaaatgtatgaattcagtccatatataagggaaaacgcagaattttttaaaaaaatcgcctctacgaaatccgaaaaaaagaaaaacattcttctgcgagacgccacagccgaacaaatattaggacttgttgaaatttgtgcaaacatattaaaattcaatttcagcctaaacagaagccagaggaaacggttggccgaatacgcggactattatcgtgcaattgcacgctcgcgtagcgaaaagactgcgagaaaaaggctacaacagggaagtggtattgcattaggggcaatattagtacctattcttggtgcactagctcaacacttggtcgaaaaaattacggcctgacaatagcgagtcaatgaaatatacaaaaaagatggttatggtgccagaaagcgagtatttggctctcattaatctactgaaagggagcagcggcgtatctcctcctctagccgatccgttacagggcgagaaaacgctgcttgatgtacagattcaaaggaatttggctgatccaaaaacgaacgcagaaataaaaatgaagcgtcactcatggttgtacaagcgtagacaccagctaaaagatattattgagaacaaacctcaaaaagtaattgttgagagtggctcagttacagcaccaaacgttgcgccgtatatgggcattcaaaaacaacaaacaccgtccaatgtgaacgcacaacaccgcaattcgacatcaattcaatcgtatggtggcgtaagtaagagcaacactgatgtagaagaggacacggacttttcaactgcctctgatcagtttgagcctgctgctgctgatgctgctactacatcgtcgaggaaaacgccacaccaaaagacgccagccatttcattaaggaccagtccgaaaaatttcccaaaattgatgggtattatcgggaaggatctcaaaaaattcggtgtcaatgctagcagcggagaaattttgactaatttcaataaacccgtttcaggctctcatttcaccgaatcgttaaagcatttgacaggtcagcgcgaagatgtgcccagaggccatcgcttcttcattcagcgcatctcaaaagacccggaaatgatgaaactgcttcaaaaaatacatcaaacgggggaaaggccgccggcggcacagcactgtgaagaaaatgggaaagaaaaaaatagtgtttgtcaatatgatgaattcatcgtctataaaaaccccagnattacacccgaacggaaccaaaa

SEQ ID NO: 31843 - DNA, 960 bp, Heterodera glycines
tctgacgaaatcacatgttaccctccttaatgttgatctacactagagatcaacattttgaaaaaaccgtagttgtacctgtttcaaaaaatggcctgtacctattttttctgtacataagtacaggaaaataaatgtacaggaaaaatccaggttgccgaaaaatggcctgtacctggatccaggaaaaatacagggctggatccaggtacatgttgatctctaatctacacccataaaacacagtcaaaatcgggaagtttgaaaaaaaattctagggggttgtgaattttttgaaaatttgaaaaacccattggaaggtaaaagtttttcacttttttttataaaatttttgatcaaatttttaccttttttaatttttggcttcgcgccaaaacgtgtgcgccaaaacgaccctggcgccaaaacgtgggcgccaaatcgtcggcgccaaaacgtgggcgccaaaacgacccagtcccttcgggggggggggggggggggaagaaatgctgatgtcgacattgtgttactgatttgggccatttgatgaaatgatcctaatgcaatctcacgcatttcttgcgcagtaaaggcctccgtaacattgtcacgattgaatacgtcaagaaagagtgtgcctgttgcaaaagcctaaaataacgcatgaaggccagcttcggccggtgggctgatcgaatgaaagaatgtttcggagacggcacattctcattggcacctccaatgttctaccaaataaattgtttccatttcttcattttgttaaatttattatatttaacgaaaaatttcattttttataatttttacaatttcttcctgcctttttttcatttttggcttggcgccaaaacttcggcgccaaaacgaccctggtgccaaaacgtcggcgccaaatcgacggagccaaaacgtcggcgccaaaacgacctggtccca

SEQ ID NO: 31844 - DNA, 1666 bp, Heterodera glycines
tttcaattaaaatagattaattctatagtaataataatccttttttttgaaaattaatagaagaaagtgctaaataaaattctcctgggaatgcgcagaaaattttcgcaacattaatcaatttggaacacatattcacacattcattcatttattcattattagtttcacgctgaaaatggtaaaaattttaattccttatttaaaaatttaatttaaaataatatttaaaagatatagaacatttttttccattaaaattattcaaaatgatctgattgaaatatcaatgattaaaaacaatctttttttaatgctttattattttaataaataaattttttaaacaataaaatttaaaaaaattaataatcattgattaaattcattttatattccaaataatttttaaaaattattttgaacaatatagaatttcaaaacgatttggttgaaaaattggtgctaggtcgaacctaaaaaagtatcaatgattataatatttgaatttaattattgtttaaatattatttgctggttaataaatcataacttagctcaaaattgataaaattaaacaatcttgagaaacaaccaatttaattttgtttatataattagatagccaaaagatttctctataaatcagttaaatttaaattttttttattgggtataaaaaaagttagggaccatataattgggtataaattttacgaaattttttgtcataagtttttataaatttttgccaaattttttaaaaatatataagataatggagggacatgtaaagctatcgctaactactaagattctttaattttatcaagtttgtgctaagatatgatttattatacagcaaataatatttaaataaaataattaaatttaaatattattatcattgatacttttttaggttcggctcagcatggaaaaattaatattcaacctaactacataaaatcaaaatgaattaaattactattcaaaaattaatcccaatttcaggtagccccacaacgtgaacaatcagttgacgacagcggtggaccatctgctgcagaaacagtgccattaatagagcatcaacttttgatgacggatcaggaccagctgaacaacaacattgttcaacaacaaaatctgtatcagcagcaccagcacaattttgtggcaccgtccatcttggtgtcgtcgtcgtccatggagaaaagtgcgtcggcacaggacttggccggcacggccgcagcgctgatacgacggcaccgcagtgcgagcaaagtttggacacaacaaataacggaatattaattaatttaaattaatatttctttattgaaaattaatcattttttttttgagccccggacgggttcgatggtattgaatctttttatctaaaactcaaaaaattctgaagtaaaaaattgaaaaatgcttgccaaatttggctaatattcgatccttttaattaaagaagcttttcaaaagcccgcaaaaaaatctgtttggcgcttagttgtcaaaaacaggctttttggcacccaattgcccgccgtcgtttcccttcaaatattaaattgtaagcaaagagtggaaagaggaaagactttgcggatttttagagatgtttttcagcaggatttgcatgataattctt

SEQ ID NO: 31845 - DNA, 835 bp, Heterodera glycines
acgaagtcctcatccggttaaaaaaaatcaatttaaaaacgaaataacgtaaaaaaatcagcaaatctccctcatccttcttaaacgttttttttcgaattttcgtacgaagtcgattaaattttaaaggattttgttaaattatttaaatttcttcgcttttacgaagtcacctctctcttatcccttcgtctccgacctttccccacattttttttcacattttatcccaacaaatacgaagtcagcccttttttcagttttatacgaacgaagtcaggggaggtcgaccccccccccccatttaatgtatgactttattcgtattcattccattgtcttttcaaagataatgtaactgatgcgactgcactccgacaaatggtctcaaattcgggaacaccaacttcagatttggtcgagtccatcgtacggtaaatttgtggggctctaagaaaactttatagaaacgcatgtatggaccaatcctagaacaaatcggtggtaattaatttagtctgactttataatataaatgggaatttaagcgaaggattcatgcaaaataataatctatagaaattctcaaaaaagtagttcctcgcagattcgggaaccgtttctataaagctagagacatatgcgctaaccataaaaaagatgaatcattttttgaaaaatttatatttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggt

SEQ ID NO: 31846 - DNA, 905 bp, Heterodera glycines
atataataagtgagaggaagctccgccccttttttggttgagttaaattggcgtttatttatggcgcttagttcttttaataaaaagaagagaaaaatcaaaaaaacgttagaaaaagaaagaggaaaagtcagacataattataaccaagaaattttttgcttcacaacaatgcatatttcaaaatattcatttctgtttttgtttttatgtatgagagagagagagagaggggggaggtgagaaaaggaggaagagaaagaggagaggtgagaaaaggatgaagagagagagagaagaatatgaggagagaataaagagaggaaagaagaaaggaagagagtgagatgagaagaaaaaaaggggagagatagataatgaggagagataagagaggaagcgagagagaaaaagagaaagagagagagtgatatgaggagaggagagaataatgcgaggatagaaaaaaagagagtgatatgagaagaaaggaaggagagagagagagatagtaaagagagaagatagaaaaggaggaagagagagagagtgtgatgagacagagagaaagaatgaaggggagaaagaatggaagagaaagtgaaaggaagtagagagaaagaaagggaagacagaagagtaaggtgggaaagagaaaagagagagtatgaggaaaaaaagtgcgtaagaagatgagagaggcagaggagagagagagagagagagagatggggagagagagagggggagaggggagagagagagaggagagagaggggatgagagagagggggagaaaaagaagcatgggaagagggagagaaaggacggaagagagaaaagaggtaggagagagaagcatgggaaaatagaggggggggatagagagtgagggggagagagag

SEQ ID NO: 31847 - DNA, 1109 bp, Heterodera glycines
gcctgaaaatttttaaaaagttcagtattttttcaatcgttttggaatcggaacgaaatttatttaatttgaaaaacgctagaaaaaaattttcaattttttttcttgaaattttcttagtatttttatacctggtcttggtcgttggccagcctgaacaggcactccaggaaaggatcaatgacggcactgatagactcgttttggaccagcaaaatgcagttgaccgtgctgacggagagggcacggagccgggcgagctgcgagttgaagaagggcaacacacgggcaaccacttggttgatctcctcgtgggacaaacggtcggccgaatcctcgcaaatcttttgcaatgcgccaagcgtaccctgaacaaacagaaataaatgataggcataccagaaaaattttttgaaaaattatgagtttttgtgccgacagtagcgataggtgtcgggaaaatttggaaattttggacaaattgtcaacagatttcaccgaatggattttcgggaaaattttggtcagagagctcttggagaaggtaaccaataaggaaaaccgtaaatttgataaaataaaaatattattatatttttgaaacttttgcacaatttcatatcatattttattaaaacaacttaaaaaaatttcactggtggcgcctaccggcacagccaaacctccatttcccatattttctagaaatttgactccaaaataacaaaatttgttattttttggcacaaaaccgttattaatttctgcattttcgctccggcgataaaatttttgaaaaataaactataaaaaatttttgacccgaagatgaaaaaaatttttcagagattctccttccgaatttttttcttgctatgggcctgaatttaaaagcaaacttttaaaaatgcactcgtccgttagtccaacctcaaagacattggcatcgtgttgctggttctggtccaggaattggcacagcgttggcaacaattcgggccattgttgggtgccgtcgtacagaaacatggtcgtgatgataatgccgaccgtggcacggaccaacgacgacgggtcgccaatggcgcggaacgcattccggcgtaggt

SEQ ID NO: 31848 - DNA, 1438 bp, Heterodera glycines
  misc_feature (1414)..(1414): n is a, c, g, or t
tgtgggcaaaaggccacaaaaatttgcacttcccggcagaaggggggagtcttttaagcaaagcgaatttctgtccaaaagacagaaactcacagagtccaaagggacaaattaaagggggaaattcctctcctttactgaagggacatttggaaggagaaattcttctcctttcctttggtaagccttttctgacccaagggggtcaatggcttaatggtctgtattaaagggctcctgatgtcccttttacagacagggaaaagattaagactcttttcttaatctttattcaatttacacaattacaatttaatgcaaattgtttggacagaaaactgtccggctgacttaatcaaaaattgatcagtgaagaaaatggagaatgggccggacttttataccctcacaaatcaatgggggcggggccaggcacgtgaaaaatgtgcacaagcaaagggaaaaattccctcaaaaatgatgactcataataaaaatgaagagagaaaaagagatgagtcataaaaaagaggagcgagcgaatgggaaaattgatcgacgaaaaaggatcaaaaaataaaggaaatttcaaagaaatttgtgtcgcttcggcgacagttatgtaacaattatgaaatggaagaaagaattcggaatgagttggaaaataacggagaaagaaaaaatgaataaaatgaaaatgtattggcaaataaaaggagaaaatcaaaaaataagtgatgaaaacattgcaaaaatgttgaaaattagtggtaagaatattcgaagatggaagaagaaatttggagaaatttaggatgccgagaattttatgaatagggacaatatcgggcacgaaattttggtttcttttttcatgtttcatgcctttttgatttattatttttttgtaaaaggctcaatttttttcgtattttttgtgttttatttttcaaaatatccagaagccgatccttaggtgtgtattttttattttactgaatatttattgtgaaaatttcaaaaaaatagatgaaatatggattaaaaatccaaaaatttcggggccgggggacttttggcacaggatcgtacgcaaaagccaagtctgggcatttttcagtgcaataattttgcacaatttcaattttttcttcatccgaagtcaatttgtgaaattatattggcctaatttttgttcaatagtaaatatattggcaagtgatttgtgcccaattttttcactattttttttcaattttccccattcttgaacaataaagtggtgcttcattctgcaagatggaatatgaaaaccaaagattccaacatacatgtcccttacaaattagagttgtttatttcttttttttctatccttagctattagcaaatctgctttgttttcctcctnaatttattctattttggtgttgtt

SEQ ID NO: 31849 - DNA, 1521 bp, Heterodera glycines
  misc_feature (206)..(206): n is a, c, g, or t
atcgcgcccgtttttaaatttttggggggacattcggccgcttcgcggcctcaggacgggcgcttcgcgccccgtttttaaaatttgtggtggatattcggccgcttcgcggcctcaggacgggcgcttcgcgctctttttaaattttgtgggggacattcggccgcttcgcggcctcaggacgggcgcttcgcgcccgtttttanaattttatgggggatattcggccgcttcgcggcctcaggacgggcgcttcgcgctctttttaaattttgtgggggacattcggccgcttcgcggcctcaggacgggcgcttcgcgctctttttaaattttatggtggatattcggccgcttcgcggcctcaggacgggcgcttcgcgattaaaaatcgaatgcattttagtttaaattttttttataataaaatactcgttttattaattaaaaacaacgttgaaaattaataattaatttaaaattttagcctcagaatccccaatcacacagggattctaaggctttaacgatgtattaactgaaatctgatttcagattcgtgatcagcgtcataaataacccctaaaaaactaatattaaataactaaggaaaattttttaattaaagattaaaaatcacatgcattttaattttaattttttataattaaatactcgttttattaattaaaaacaacgtcgaaaattaataattgaatatttgtttaatttgaaatgaaattaatttttttgcaaattcaaaaaataaataatgaaaatttttaattaaaaaaaattaatttaaataatttacaacaaaactattttaatttattaaatgcagtgaaaattacccaaaaaatgaacagaaaaataatgtacaccgaccggatccgaacttgccccccgccccctcaaaatgatgcctcagaatccccaatcacacagggattctgaggtcttaacgatgtcaaaagtaaaatctgattgcgtattcgtgatcagcggcccaaataacccataaagacatatttttggatgatttttgattttcaattaataaaaatatgtaaaaacagcaaaaaatacaaagaaaataatttacacagtccggactcgaacttgccccccgccccctcaaaatgatgcctcagaatccccaatcacacagggattctgaggtcttaacgatgtcagaagtgaaatctgattacgcattcgtgatcagcggcccaaataacccataaagacatgtttttggaagatttttgtgagaaaaatttttcaactcaaaaatcctgtccaccccctttggtcccgaaccccaaaatcacttttatttttgtatctttttttaaaaatatgataaaaaggtcaaataaaatttatctaatagagcaaaaaattgcggatttttgtagtattttactcttctctaatgacttttcagaaccgagttatgaatttttttctgaaaaatcgaaaatttccagaatttctggaataactttttttgttttt

SEQ ID NO: 31850 - DNA, 1503 bp, Heterodera glycines
cccgggactcccgttaaaaatggacgggattttccttttagcgggatttttacgggattcccgttcgggactcccgtctcggaaaattttaactcccgatcccgctcccgctcccggaaatttttttttaccggactctaaaaaagatgtttttttttggtcgccaagcccatctttaggtttattttcatccccgtccccggcggggattcagtgcggaggataggaaaatggggaaggggatgaaaatccttgggatccgcccgtccccgcttcccctgactgcaaccctttcaaaaacaacattttggcgtcttggaagctgtccgggacggagttgactcatacagttgcagggagttgggggcgggaaacaatcacttagcaattagtacagccaaatccaaaccaaaacggtcattcactgatcactgatcattcttttccatttatctttggcttttctcacttcagtggaagaccatttccgcaagtcattgggcgaggatcgctttctgcaaataaaaaatgaacagcaaaggaaggagagggaagagcaaagcgaagacggagggacaataagccgattgtgaagggaacggaagaagaagcgggggggggggacaacggacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaagggaaaagcgacgaaaagcaaaccgaagggaaaagcgacgaaaagcaaaccgaaggggaaagcgacgaaaagcaaaccgaaggggaaagcgacgaaaagcaaaccgaaggggaaagcgacgaaaagcaaaccgaaggggaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaagggaaaagcgacgaaaagcaaaccgaaggggaaagcgacgaaaagcaaaccgaaggggaaagcgacgaaaagcaaaccgaaggggaaagcgacgaaaagcaaaccgaagggaaaagcgtaagggaag

SEQ ID NO: 31851 - DNA, 1694 bp, Heterodera glycines
cgtaatactatttcgccatttttgagttcttagagatccccctctttgttagcttaattccacgcagagtaagacggtagaacaattcatttaggatgaaaagttgggccgaaattttaaatatcgctcaataacccaaaatggcacgataaaaatatttgtgaagtataaaatttttcattaatccttcttcgatagcaaaacacacgaataagtttgattaaacaaaataaatttatgtaaatatttaaaaaatttctcaaaatagtgacaatttttaaaatcaaaaattttataaatttgataattttcgagaaaatgttatttctgcttagaattttataaaaagaggagaggatttttacaaaaaaatgataaaatcataatcaacaataatgaaaaatacatcatttgatcatttttgcttactttttgcaataaaaataaaatttttaagcgaatttatgaactgataagaaaattaacttatattcaaacttcatgaattttacagccctggcaatcaatcagagattggggtgggaggcatttgttatcaaaggaagacaaaaaaaagggagaaatagtacacaaactagtgcattatttatcgacaaagaaacgagcgcagcggagaaatagtgcatggatagtgcgccccgctgccatccatccctcgccccttttgaaccccacctaaaaatacaaataacatatcccatcttttataataaatttgtgtgcttatttgccctgcggttgctcgccggcgccgtttcgcgccccccgccctctgtctcgtatctcctcagggagaacggatattttggcttgacaatggcttagaccgcatgcgcagtcgtttgaagacgccatgcggcgcttgcattcggttggagtcggcttgagcgaaatcgccaacttttttttttatttttcaaatttgctgtaaatccttttttttgtactttttaaaatgtacatgaccaccttcatatacattttaaaaacgacataataaaaaaggctttcgagaattttctgggtcaccgactctgcatatgacatccatttcgacgaattattgtgagccccggcccagaacttgatcgttaagtcaaaccttcaaattttataactcaagcattactttaaaaattcgactggtttgttcgaactcgggtccggattttcgaaatttgtcgaaatgaatgtcatattcgtaatcagtgagtgaccccgaaacccttaaaaattttttaaacagaaatatataatttattcatatttattggcattaaaaaatgcatataaattggtcatgtaaactagaaaagtacaccttttttttgaattggcaaccggtggaaggaggacactaactcgtacgaaactgaggaatcataaatttgatggcggatgcaaaatcctgggactgttcctgatctctggacgacaacatctctcataatttaaaaaaaatcgaatcaatgtcccaaaagttggcgaatttcgtgataaattgcgtcaacaaattttattaaagttcagatttttacgccggtgccgacaggcactgccttccccatctacataggactattgcgaaataccgactgattttcggcaaattttttcgcttttcttaatcattacatcgcttctgatcagatattatttgagtcaaaaaatga

SEQ ID NO: 31852 - DNA, 1454 bp, Heterodera glycines
  misc_feature (138)..(138): n is a, c, g, or t
  misc_feature (1268)..(1268): n is a, c, g, or t
  misc_feature (1300)..(1300): n is a, c, g, or t
ttgaaatggaatcattggatgatttaaattttaaaaatgaaaaatgtgatgccaatcattcactcttcactttccaactcgttggacagcccaatcgggattggcacagcgggcaccggttgttctgcttcacccacnagagacatacaaccctgtaaggggggggggggagtttcgtcaaatttttgaaaaatgaaaaaacacattttgaaaaaataaccccaccccccatttgttgtaatgacaaaaaaaaaatagaaatttttttaccgatttcttggaaaatttttcaaaaaaaaaaaaacagtaattcatcataattcggggtctattgaccacgaaactgccatccatttcgaccaataaccaaattcctaacccgacaaaaattcgaaaactcaaatttacgaagttcaattgcccaaatcgggattcaaacaggtggaaatggatgtcagattcgtgttctattcagagcgacccccgaaagcctccgggaatataaataacccaatgtgagacacatacaaaggtggaaacagtggttgcactcgccccaaatgaccacacattcttgcgcctttgaatcggcctgacaacggaggcatgcctctgaaaaatttggaaatctattggacaatcaactaaaaattctactttttattcttatccaaattaaaaatattcccggcacgggaaaattttgagcgatgaattcatgttttccagtctgtcaactttggggaaaaaattggtttctcctgaatcagactcgggtgtttttcggtaaccttgatttttgtcaatgaaatccaggccaacatggaagcccagtcttttttcataatgttgagctttaattacatatggtccaaatagttagtccatccttttacttaattaatataacaattaggtaacaatgacccattaaatggacacgacaaatggcgcacgtgtcacactccacgtcccaactccatgtagacaccaaattccatcgcttaattgcaaatggtcgttgttgctgttgctgtgtttcctctgtttctttgaagaaaaatgaaatttattaaaaaaaaatcaaaaatttaaaggcatggctcaccagcgttttcagtttccatgaaaaaagagagaggggaattgttcgggtatcgtacaaaaaaaaatctgtaaaaaaggaccagaaggtcgacaattttgattagaaaatagactaaaaacattggcaaagacttaatttacaatcggcggaaaggaatcancaaagaagtaattaactgatttgtcaaagctnaaaatagatcaacaaatttatttatttatttgtcacaaagaaaaataatccacgaaagggaaaaatccacttactttcgggacatatgaaaacataaaatagtgcacaagcaaatggataaataaataataaaaaatcatcgtcaaaggaaaca

SEQ ID NO: 31853 - DNA, 2408 bp, Heterodera glycines
atcaggatttggtcgaaccatttcaatttgatgtttgattaatattaatttactatccaatatcttttgacattgaagtaaggaaatgttatgtccattttgatcggattttaattgaattattttgtatttatttatattagaaagtattttagttttttatattaattgattaacagattttttatatgcatagcgagtttgcctggagctttccccaatacatttgctatttagtttttcaattaaatagatattattattattagactattattataaaataaccatttgctctcgagtccatgggccaatactcaatgcttactcatccatgttgtaaggcgtgatgagaccatttgcgccgcgcccatttgcgccgcacagcaaaagtggacacttgcgccgctcagcaaagtcgacacttgcgcctctccatttgcgccgcaacatttgcgccttccagcaaaaatggacttttgcgccgcgctgtcaaaaatattatattcataaaaattccactattatcaataagttttactaaaactataagccatcgacaaaaataactaattgaaaattcgaaaaaattactagtcataaagattgacattcaattttttaaccattaaaatcttaacattgaataggttcatcaaagatatgaaaaaatgattaagaatacaaactaacaaaaaactgaaaaaaagaattttctgtagaaaccccattatttttttgcttcgaaaaaagaatgaaattcaattcctttgtaattaattttctcaataagttattttcatcgattttaatttaatttcattgaaaaaacgcactgattttcaattttcgctcctattttaccatttttcgcattatttcgcaatttttatgcccttatttatttacctatttttttcgcttaaaatccgccgcttaatgatcaggcaatacgaaggcttgttatcgcatatggtcccaatgaaaaccaaaatgatcaagatttgatcaatcattacgtgcacttcaatatggaattgacatgaaaggcttcgaaaaaggaattaataatgaatatctatcaattcttattctataaagcacataaatttattttaatcagagcgcaaatgtcttttttcgctgtacggcgcaaatgtcgcggcgcaaatgtcgtttttgttaggcggcgcaagtgtcgcggcgcaaatggcacggcgcaaatgtccgcggcgcaagagtcttttttgctgagcggcgcaagtgtcgcggcgcaaatggcgcggcgcaaatgtctgcggcgcaaaagtcggctaaccatttagacctcattttgtgtggccaccgcagcccaagaagcaatcgcaactgaggcaaaagcgccgctcactttcaccgcgggggttttagtgactgtttgcgcttcgatgcttatcagtttctttgagatcatgtgagcgataattatcatttgtgatttatcggattcacattaaggctttctctcttctgatcactcacaatttgaaacttttcatgcgcgggctccaaataccggcgaatttgcacaatctcagcgaacgctatcaggtaaatcccattcattcattcattattcgtcattcgtttaaattcctccaatttcatttttataattttattttatttaaattaaatttagttggccgaaaatattcgaacggggcgccaactcgcgccgacttttctgttccatttcattaacatttgcgggtccgtcttcaccccatttgtcgtctattttcatctgatcaccgacccaattttgctgaatttaattgtgttcacttattactccgtcctttctctcagcaacgctttgattgaattgactttaatgaggtcattaaaagtgataatagaataaaactcattatttaaatgcattttaattaattaatttttagacgtcatcaaattttgaagaaaaatgcattgaaaattttggcaaaatttcttccaaatcgctgcttctccaataatcgcatcactgacagtggcaaaagtcagaaaatggtccaaagaattgacgggcaaaagcggtgggaaaagccacagcaaaaaagagacaataaaagcaatgaaatgacggaaatgcactttaaaaagttgaaggaacagtggcaaaagtgaaaaggaaatttgtgaaaaatggaaatgataaaagaaaaggaaaggtgaaaatgaagtggacaaaatgaaattgatcattctgataatcgtttgaccattttattattgacttttggcgaataaaactaaaactaaaaaaagtcagaaacaatttcaatccttaattaagttatttaaaattattgaaaagtgaataaatggtttatgtggtaaattatttaaaataaatatttaag

SEQ ID NO: 31854 - DNA, 1468 bp, Heterodera glycines
taattcgctttcatcgttcagaaatcattgccaccggcaaagagtcggccgttttgcacgcccttttggacaccgacggggacagcagcaggaagaaagtcgttgggagtggcatggcaacaaaaagtgggactgttcaagaagttgaggaggagcaggatgaaggaagacaacaaattgttggcctatccgccgatgaaacggcggaacatttggcaccaccggcggagcggcaaaaaatgccaaccgccgcggcacggcaaacgcattttgcggtcaaagtgtaccgggcgacgttggccggctttcgcaaccgagcggagtatgtgaaggatgacttccgcttcaaaaacccacgccgtgtgatgaaaatttgggcggaaaaggagtttttgaacctcaaaaggtatgaaaaaaaactcgggaaaaattttttgggatttcttttgcatctgaaattctctaataatttaaaattttgcaaaactattcaaagtttttggattttctgtatttctctacccttattagccacattttccttggagcaggtcattttctcccccaccaatttccaaaaaagtattccaaaaaatcgctttttcgtggaaatttttttaaattttcggtgaagtgcaccccattttcatttcgtttactgtgccactgaaactcagactgaaaaatgccaacattatgtgcccgacgccaatcaaattgcgcaaacacgtgctgctgatgtcgatggttggcgaaacgtacccggcgccgaaattgaaggaattggaatgggtcgacgacgcaatgcgacgggacgcgtttgaaagagtcagacgagtaagtttaaaaggttcgaaaatataaatattttatgattacaaattgaattgagcgggactggtccggcaatttccggtttcccaggtcccggaagaaaaaaaaaatttttgacgcctctcccccgttttgttttttgttacaaaatggcgttttatttgtatggacatctttcccatttgcgcagatggtcgtcacgatgtacaaacagtgtcagttggtgcacggcgacctcagcgagttcaacctgctctaccacctggacactgtctatgtgattgacctcgcccaagccatggacatttcgcatccgtcctcgctgcgcttcctccaccgggacatcagtcagttcggtgatgggcaccaacggcggaattttgttagaaattttgtccaaaacccaaatttgaaaccaatggcattctcttgattcgtgaaaacatatttatatgggttttcagggtcactgatcacctgacattcagcccgggattcgaaattgggtcaaaataaatgtcaaatttgtgattcgagactctgaaaatcccttcctctccctcataaacatgtttttttcgggatttttttaaacaaaaaaaatcttcctcaagatggaggggggggagggggg

SEQ ID NO: 31855 - DNA, 1143 bp, Heterodera glycines
aataagcagtgtgtacaaatattatctaggtatttcaagtgcaacaaatagccgagtgcaaactaataaaatggagcttcaagaagttcttttaaattcccggaaaccggaactttaatgcagtttcttccgtctttagatttataagagcccacgggacaagcgcagatttttcctttgttcatgttaagacactgttgaccttgaaaaacgatgaattgtccaaagtgaaaaaaagaacaaaaaaataacctttggggcattcttcgtagagacattcgtctaaatccacgcattggagaacatcaaaacgataaatctgaaaaaggtttctaacaataaatctgtcccttcccaaatggacctttgaattgtcaatgctcccatcggcagaggcacaagcgcagctcaaattccagcggttctgctgaaatttgagaagacaatgcgaggacagtagctttcgattaccataatcgcaaacaaatcatcgttaaaaggactttccaaatctaaaaatgcatgtttttcgcggaaagggaacttcggataaaagcattgctggggtcggttggtgcttcgcttcccccccccccccactcacagcagtagtgcgtgttgacaacgctgtttcctgcttcggtggcgttgtgccgttcctcttcgtcttcctccaagtcctccgcctcttccgtcgtcgatggcatacgttccgtcgtcccctccccgtcgccttccgccgcccccttaggcaattcctctttcggtgttttctttttgaagtgccgcgctgccattttctcgttgagattttttacattctgaaagttcaaaatacagcgtcaaatctcaaaaaaaagaccatggcacaagcggagtgggcgcaaaagccaaaagagccttggttttttgctgacttagaattgtcaccgcctcggaaaaaacgaagacttttccgaccacaacatggatcaggacagaagctgtggggaagggactaattttgtttagtaaatatgagtagggcacccaattatatgcacataaaatcgtaaaatatgcaccaaaaaagtgaaaaatatgcacataaatttttccaaattgagggtataatttctcaaattttcttcaaattcgctaaat

SEQ ID NO: 31856 - DNA, 1289 bp, Heterodera glycines
  misc_feature (13)..(13): n is a, c, g, or t
  misc_feature (47)..(47): n is a, c, g, or t
cgggagtctcgtnacaaagccttcattttctggcatccatttgaccnaattccgaaccccttgaccccataatcaagcaaaaaactcaaaaactttttgactatatcgaattcggtcaggggctcagaattaattgaaatggatgccggattatgatcagcaacccgaatacccacttttggatgtgtgttttcgtgatggggtgcgtgagttgaaaaaatgcaccaaaaccgatttgattcgaatcgactcatgtgttcattcatcggtctttgtcttttttggttctgttttttgcgattcattgctctacgcgttaactaatgagaatggaatttggggtctccagaaaaaaaatttaatccatttttccttccaactattcattatgattaattatgaaaacggttttcccttcaattcaagggccacaaatcgggcacggaagacagcatcagtggcacggacactccgactgcctcttcgggcaacggggcggaacagaacgacaacagccgagcggccagacggccagcggaactgcagcagcaccagcacgtggctttggccggcgggcacagggcgaatctgcggctggcccgctcccgccactcccaggcctccctggtgagtgaggacgaattagtgttcgtccctgccgccggggggggcggggggtggcggtggagcctccagcagcagcagcagttccagcgctgagaagaagaagaagaagaagaaggcggggaagaagaagaagaagaaaaagcgggggaagaagaagaagaagaaggcggggaagaagaagaagtgatcattttatgaaggaaatgaaacgattgttgatggaatgctttatcttttgttttggctatttattgtttgtttttggatggattttcagttgaattttttaaaaattttatcagaaaaaaaaattttcgggggggggggaatctgaaggcctttttttttgctcttctgccaaaaaaatttttctattaaaattcgggagcaaaaaaaaaagtgtcataattattcctaaatttttgaaaattatggtaaatgtcaaatgatagtgcagcaactgcaggtacttccgtgttttgctacccccccctcccctcgaaaaattttaaaaattcataaaagggaggaaactcaaaaattttttggtggacaattgggtcagttaatgcgctaatggacaaattggtgttatagcattatggtagtcagcggttaggcatacggtaagggtgcttatggcgcgcctaaaaagcctgata

SEQ ID NO: 31857 - DNA, 1558 bp, Heterodera glycines
  misc_feature (17)..(17): n is a, c, g, or t
  misc_feature (1444)..(1444): n is a, c, g, or t
cattttttatacatatnttatttacatatttcgcgatttttcttacataaaaaaggaagtcctattaataatataggcaatactcccttttcaatatataatatttttcttttcttgttctctttttcacccttgctcattcattgtttgtctgtcacacttttttgtcccaaatttttacgttttgtcgcctttttgcttgttatttgggaaagccaacgtggaatgaaaggtgtcattatgtgaaggggacaaatgagtgacattcaaaattaattattgcctccaattattttattgttttatttaaatacagtttactaaattatttaactcataattaataattattaatcaatataatttaaggatcggattggttttgcatttttttttcctcatatacaatgaagaaaagagctaaaaaatcaaaatgaaattatttgaattgtcaaactaattagatttataaaattaattttctataataaattttttaaaaatgcgattacattgtaaagagttttgaaaagtttctaatttttatgccaattttgaatattttttatatgtatgtctttgttgcctttttattgcgtttgaaaagttacatatttcagcagttttcatacatgttttgtttctttgcggttttagcccatattttagagggttttgaccaaattaaatgtccaattttgcgtctttaatcccatacaaattcgaaccctattaaaaagaaatgattattaaagctttttgataaaatagatttgctatgacgtagcttgcttactgcaactttttgtcaatcgatagggaagtaatgtctttaatgaaaaaatcgaaattgcaaataagcgaataaaaaaataataattttaaacattcatattttataaatttttgttgaattcacttacaagctttaagttacattcaaaaaatgctcaaaatatccctattttcaggttccattatgtttttcactgctccaaaaacgctatttttttctcaaatatttaataaccaacataaaacgcacataagcgccatttcttcctctcattattaaatgataatttaaaagttattccacttttggttaattagagctaggtcaagcatgcttctaatcatcagtcattaaaattctaccatctttttgacctctgaaaaagtggtcgtaatttttgaacattgttctacatagcatgttcttgcctatatattttaaagaatagtttttttcatggcaaccaatgcatcgatcaatagcaattagaaaatttttacaattatttcatgcttaattggatggaagcgttatgatttttatttgctcatatgctatgaagaaaggagcccgataaataacatttatgtatgaaaatttttggcttatgaatacgtttcttgtcaatcatataaatccaacttttgngaaatttggaaatcatttttaatgtgaattttatttgtccacatttaataggctcaacttacgtgctcggaaaatgcgtcagtattcagtacttttgaaagcgggatagtatga

SEQ ID NO: 31858 - DNA, 1159 bp, Heterodera glycines
  misc_feature (55)..(55): n is a, c, g, or t
  misc_feature (57)..(57): n is a, c, g, or t
  misc_feature (66)..(66): n is a, c, g, or t
  misc_feature (71)..(71): n is a, c, g, or t
  misc_feature (78)..(78): n is a, c, g, or t
gtcctatattacaatattaatgccatacaactttataagtccccccctgggtgangnattttgtantgggnattttgnagtcttaattttaagtggaagattttagggttagggatatagtaaatgggttacaaggatatgtttaaaaattgggacaaaattttaataaatatttttttgagaaaaattgggtaaatcagtgccgtttcggcgccgccattttggcgccagacccataataataaaaaaaaaggtgagaaaggaattttctagtgctcgttttcgagtatctgggtcctcaaatcgagtcgaggcaatttcactccctcccctcaccaaatgaaaaattaaaaaaaaaagtgtctttaaaaaatcataaaatttgaaaaaaacccccaatagcgcacaatggcaaatttctaaacaattaaattccttaaatttcatggaattgcgagccaaaaattccttaaaagtcatcaattttctgcaaataatacgattttttttaccaactatgccaataatttttagaaaattaaaaaagaaaaaaatttttgggggtttgattttattaattgttcaatttcttataatcagggctcgcagatctgaggctttagcctcattttgtggttttttgataggtcaatgaggctaaattttcaaactgaggctttttgtggttttttgagaaaaaccgcaaaataaagaatttttttaatgaaaatagggtcaaaattcttaatttttcccccggtggcgcctgtcggcaccgccggaccataaaaatttgctcaaaatcacaaaatttggtcatttttgtggacaaatctgttaacaaatcgcattaaaaattacaaaatttttcccggcgttgcctatcggtgccgccggacccccttgttccccaaaagtttttggaaaaagcggtgaaaaaaaaaatcaatttcgatttttcatactcagattttcacaaaatgcttatttcaaataaaaaattgctcaaattgatcatggacagtcaaaaatacaacatttgaacattttaaacgtgttttgaataaatttgtaaaaatgaggctttttgacccaaaatgaggcttttttgcttgccgaatgagacttttgaaaattttcatctgcgagccctgcttat

SEQ ID NO: 31859 - DNA, 914 bp, Heterodera glycines
gaattgggcaaatattttattagtataatgtataaaagtaaaagaaaatgattagaaataaaaaaataaaaaatgtgcaacccaaaattatcaagataaattaattttaaaaatattcaccaagagcaataaagttaatttgaattttatttattttagaataattaacttaaaaataagttattaaaaataatttacgcaatggcaaccttagataataattataataaaataattatatttaaataccgctgatcacgaatttgacatcatttttccctattccgaaccatgaatcaaaacaattttaaaaagcttttacaggcaagtggatttgaacgcatggcaaagaaaaaaataaaacttttttaattaaaatcattagaaaattgtttgctattttcgagaagatcttataaaaaacgccattttttgttgggtttttatttgaaaaaatagggtggtaaaataaccccctacctaaatcagacaccccccccccctaaaataaagttccccttttgtgaggggttgaaaatagagccctccggggctcaagcatttgttaggaaatatattatttatttattcaattataatataaattaatctatcaaaaaacaataactagttaattattaaaaagaatttattaagggaatttgaaatcttcccggtcgctgagtttaggtgagttggcgaaacgtccgactttgggtcagttggtgagatgtcagttggtgaaaagtcagttggcgaaatgttaacacaccggttaattgtcaatttaaatgtcatgtcacaaatatatttttaattattttattttctcgaagttaaataaatatataaatgatttcaatagtttgaaatccttcaacttggtcaacttcagaaattttgctattgagttt

SEQ ID NO: 31860 - DNA, 2496 bp, Heterodera glycines
aatttttgggaaaattttgaaagtaattattaagtcgccctttcaaaggtaaatttccgttttggctgaaagtatgcaaattccaagattttgataaatctattataatggaaatttcgttcgatgggaaaaatgaaaattaaagattaaatttagcataaatattaaattatgataatattaaataaaaatttaaaaattaattaaaaaagagaaaaacttaaacaactctaaaaaattaagaaattataaattaaaaatattaaattaaaaaagaaattaaatttaaattcttatgaattaaactattttaaaatgataaatgatagagataatttcaattaaaacctaataaaaagaatatataaataaattattaatttgcccattttattacaaaattaatgaaataaattcattttagtaatttgtggcatttgtttttatattgccaacctattgaataactggtgtttaaataagaaaatttcagggaattaattggtattttatcccaaatttaaaacctgaaaatgatggcattgtgctatttttatgaaataatgagttgcgtttaccgttaattaacacataaaggcatcattggtttcatgtttgaaaatcaaagtttatactaattggaacattcatcattttaaaataattggctatccttttttgactttaaaattccaaaaatttaatactaatactaatgggcataggcttttttgctctaatgaactcattaaaaactaattatcttcactagttaaccctttttagcatttacattacgccaaatgaaaagtatgtctcaatttttttaaaattcgattggaaacttgtaattgaaattaaattaccaaattttgcgattttgtgccatttttttaagaaaaataggagttttgggggcgcggcggtgccgataggcgccgccgggggaaaaattggaaattttgatcatttataaacaggttttcactgaaaattagccaatttataggtaaaattttgaaaaattttaggggaatttaatccaattcttaggggtgtaaaagtcgtgtttcgcgccaaaatgcgaaacgcgaaagcgaaagtgccaaaaaagcgaaatatgcgaatgcgaaacgcgaatgcgaaacgcgaaagcgaaagcttatccctgataagtacctaatttatagaataaaacattgggcattttgttatgctgagggtggggatgtaagaatttattttaaattgagccgccgctggagtgaatttgttttgccggaggcgtttttgataatcaaaaaataataattgggctgaaaaattgaggcgagtggggttagtggtgtaaatcaattacatctaaatttattcgaaaagaattggaaaaaatatatatttttaatttatgtctcgaaaataaattaggtcaaaaaaaattaccagaaaacttttaaaaattcagaaatttcttagtccacgaatttttggagcctcatgaaccgaaatttgtaattttgaagttttttaaatatttacatagaaaaaacagcaatttaataaatttcacccccccccccaacatttgaaactttttcgcccctattttgcgaatattattgtctcaaaagcaacataatgccattcatttatcgtctgtttccggtcctatggccaaattgaaaaagaaaaaaatggcgtaatgtttctcttttatcaagctcaattaagaaaaaaaaatcataaatgacatcatcaaaaaacaatagtttttcgggatgtttgccttaacctatgacacaattggcacattaattgctccacaaatctgttttttgtgtcatggaaaaatggtaaaatttatttggaattaaaaacaaactgaaaaaagcgtaaattttagaaaacgattggcattttttttttcatttttactatataaatttatttgagaaactattttttacaaaaatgggtaaattaagcctataaaataataaattttaaaaaatagtgataaatctttgacaattcctaaatgatttcttgttgacatgatcaggaaaatttgagttaattgaatttttttaatatttaaaattggtattcctaaatttaaaaaattccttaattatgggtttggaagcaggaaatattttaatttttagcatagaatttaggtcgacatttaatttaacacaaattattattaattctaactctaattatcattaatacctaattaaaataaagtaatttcaaaaaaataaaaatggtaaattcagaaagtcaaaaggtattaaatctgtaataatacaaaacattagcatctatctttctgtatttatagcctagcggctaaagaggtaattcattagtttttaattaaccctccgcggtcatttttataaaataacaaaaaattattaataaaataatcatacgaggcaataaaggggacacaaacagcaaggaaaagcgtaatatcgcaatgta

SEQ ID NO: 31861 - DNA, 1425 bp, Heterodera glycines
  misc_feature (18)..(18): n is a, c, g, or t
tgattataagaggtacancagtgattagaagaggtacaatggtgattagaagaggtacaaaagtgatataaagaggtacaacagtgattagaagaggtacaatggtgattagaagaggtacaaaagtgattataagaggtacaacagtgataaaagaagtataaaagtgattagaagaggtaaaaaagtgattagaagaggtacaatgtgatttagaagaggtacaaaagtgattagaagaggtacaatggtgattagaagaggtacaaaagtgattataagaggtacaacagtgattagaagaggtacaatggtgattagaagaggtacaaaagtgattataagaggtacaactgtgattagaagtggtacaacattgttaggagaggtacaatattgtttaaaattaaataaataaggaaacgtttttattaaaagttaaaaatcgagtgcattttaatctaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgctgccccccccctcagaacatgtcccagaatccccaatcacacagggattctgagggcttaacgatgtcaaacgtaaaatctgatcacgtattcgtgatcagcggcccaaataacccctaaagacatgtttttggaagatttttggtgaaaaaaatttttcaatcaaaaatcctgtcacccccctttggtcccgaatcctaaaatcacttttatttttgtatctttttttaaaaatgtgataaaaatgtaaaataaaatttatattatagagaaaaaaattgcggatttttgtagtattttacttttctcaaatatcttttcagaaggcagttacgaatttttttctgaaaaatctaaaatttccagaatttctggaataacttttttcatattgatgttagaaaacctaaataaatcccataaaattctcctgatttttctctatttttaaagctttatttgctcaaaattggtcaacccttaggctagatatgaattttcaaatattaagccaaaatcccgagggccaaaaaactgccaaaaaataaagaatttttaaaatattccaaaaaatctgaaacttaaaataaacatcatatttgtgctcaggaccctaatttaccccagaaaaatatttttcaccctctttttcacccaaaaaaatttttgaaatttctagggggcctagctcgaaatttttgaaaattt

SEQ ID NO: 31862 - DNA, 1487 bp, Heterodera glycines
  misc_feature (826)..(826): n is a, c, g, or t
aaaaaataaaaaaaaaaaaaaaaaaaaaaaaatattttttttttttttttttttttttttttttttgggggggggggggggggggggggcgcccccccccccccccccccccccccccgggggaagaaaaaaaaaaaaaaaaaaaaaaaaaaaaaaaaaaattttttttttttttttgcccccccccccccccccccccccccaaaaaaaaaaaataatattttttttttttttaaaaaaagggggggggcccctcaaaaaaaaaaaaaaatttttttttaaaaaaattccaaaaaatttttgaaaaaaaaaaaaaaaaaattttggggaaaaaggggaaaaacccaaaattttccccctttcccaccccccaaaccccttttttttaatttttaatgggttttccaagcccccccccctaaaaaattgggggggttttggtttaaaaagaaatgcaaaaattggggggggggccccttgaaggattccctttcttttacccccccctttttgagatttttgggtaaatgagcaaatttggcttaatcagggtgcccgttttttttcaattcagaaaaagaccctaaattcagatttagactccaaaatcagattttttcaaccaagagggtcagcgtcaatttccaatttgtgaatgtccgcccattcaatcgataccacccgcttttttcgcggcgcgttctttcaaaaatttttacccaaagatgactaatttgcgctttaagccaattttctagaaaaatcgagttttgggggccggtggtgccgataggcaggcgccgcctgtgaaaattttggaattttnttatgaattctgttataacatatctccttttttcttttaccggagacctaaaaattcaggacagtctgagaattcaggacatttttgatttttcagataggtgccctccacaatacaggacaaatctaaaaaatcaggacacttggtcaccctggctttaattaacctcgtcatatttaaattataactttatttaagccattgtctccacaaaaggcgggtcaaatgaacacaaaaaattcgtctgaaaatgagaagtaaatgaattattaagaagtgacaagtgattgatcattatgaaagcaagtttctctgataattgctcctcatatttatttttttcgtttgagtatatattaattgtttggttttttacttttaattggacaaattggaattggagcaaaaaagaaaaaagtgaaacttggagaaaaatgggaagaaaatttggaagaagaaaaaaaaaataaataaaagccacaaatcaaaaacggatgaacaaaaaagtgaaattgttctaaaatttatatgtaatgaaaaatgaattaagtaaaaaggaagaaaatatttgggaaaagaatggaagaaaaattatgccaaaatttgtaagaaaattggggttggccgtaccgtaattgaaaaatggaagaaacaatttgga

SEQ ID NO: 31863 - DNA, 1473 bp, Heterodera glycines
ccagctttgtccaatataaattctccctttaattttctatgtgtgtgatgtatgcactggtcaaagaaaggaaattacatgtttatctctgtgattaatgcttttctttagttaggcgtttttttttaaattttagtcaataaaattgttgaaattaaaatttattaaagcggcgcaaatgtcgattttgctgggcggcgcaagtgtctgcggcgcaaaaaacgcggcgcaagtgtctgcggcgcaagtgtcgatttggctgggcggcgcaaatgtcttggcgcaagtgtctgcggcgcaaatgtcggccaacctagcagggatgttactcgtctcgtgtctcatttaattataaaatactttcggtttttcacacaaacatacatatcaatacatatttacataggtatctttatacatattttggacttttcgtacatattcaatttttcgtacacattttcatttttttacataatttagttttttgaaaattaacacattcctttcaaaatttttcgtttttgcgccactcactattcatcacttggaatcactaaaaattcaatctccaaaatttattttgcttctctgacatcttgcgacgtgaaatatctttttccgtttataaatcaattttggccggtaaccatatttatgtcttttaaccacgaaaattttgaaatgttttttatgtatttgtaagtgcgatcagtgaataaaattgtttgccttaatctgaaagtattttcatataaaaaaagcaattaaaattataaatccgagccctacatattaataagtagggatgccatttctaagaaaaaaattgctaaataggcacccaaaaaggcagaaaaaaatcgtaattaaattaaacaagtgcttaattcaaaaatttggtaaatcaaacataattaattagaatttttatcagaatttcgattttaatttagtattttataaacaaggaaataaaaccattcaaacattggtaggaaataagaactaaaaaagagttgctcggtttctataatttttttgacaagaaaatcaaataaaaatggcaaaaagtgtaactgtttttttttgtaagaaaattcaattcgaagaaaagaccctgaaattcgatgtttaagcatcatattttggatttgtccaattatgtatttaacgtttactttgccttacatatgcaaatgaatcgcattcgcccgcaccagttaatctgctgaatgatctcaacattttctcatcagttcacacatctgcgatttcaccattataataaaccattatttttactgccaatttattcagccaaacatttttatttaaatattcgtacaaaaattaataaaaataaaataaatcctaacttttactttattttagatacaattttttgaaatcctaaaatgcaatttctcgcatttcttattgctttttgttgggcttcttctcattgttatg

SEQ ID NO: 31864 - DNA, 1323 bp, Heterodera glycines
  misc_feature (1252)..(1252): n is a, c, g, or t
  misc_feature (1269)..(1270): n is a, c, g, or t
  misc_feature (1302)..(1302): n is a, c, g, or t
cgcgtttggagacggaaaagtttggaccaatttcagttcggtgacaactgaaaatttgggtagggggaaggccagcccaacaacggcttcgtcggcaaatgtgaggttggatctatgcgatcgccgccctgactctcgtccccaatcaccattccatcgcggcgagactaacaccaaatttggccaaagaattttttatcgtggaggaaaatgtcgtaaagagcccgatcgtggaatgctaggagacggacgccggcacaagctgaactcgcccaccacctatttgatgccgaatgagcataaaaggcaggggacgcctttttcttggagggtcgggatgtgttagtatttgatttttggcgtttaaatttattttaattatattgtcccttcataattttgtctctttgtctgtgattgtactctctcgcctatcaatatttgccattcccttcccagcagaaatgttccccccatcttgccttcaattcattctgttggcagtgcactttttatattgttgtcgtcagttattttttcctcggactttcctttgggccgggcaaaataattattaaatttttcaaatttggggtagttttataggtgaaacttttaaatggaccgggacgctcccgttgactcccgggggttaaaaaaaccgggataggagccgggggtccagcaaatccggcggagccccggctccgtcctggctctaatcttttatttaatttaatataaaatatttttatatctgcgaaggcccctgaataaaatctattattatttacttgtccgccaatctgcgcaatcagaccaacaaatgtcaatgtgctcacttcttcaatgaattcatactgtagatcattgtaagacatatcaatacggtaagcaaaatcgaattcactcgcatttttgtacacacgggtcatgtcaattttctttgaaaattaattttttcataatttatttaattataaaaaattttcacttccattgaaaccatgtactcccatcgatcacaggccaacacgcacttaaaatttgcaaaattttaatttcggatgattaataatttttgggaaaaaaactattggagaaaaaatgaaaaacaaaaaattaattccaataatacctgaacaattaaatttaatcttatgttaaaagaaataaaacattaaaatagagaaaaaaccttatcattttaatttttatatttaaaactgtataaaaagagaccaaaaattcncaaaatataattcatannatatatttatgtttttcttcatttttttgtanaattattcatttttctcactg

SEQ ID NO: 31865 - DNA, 1218 bp, Heterodera glycines
  misc_feature (22)..(22): n is a, c, g, or t
  misc_feature (122)..(122): n is a, c, g, or t
  misc_feature (155)..(155): n is a, c, g, or t
  misc_feature (161)..(161): n is a, c, g, or t
actgcgagagttggtcaacatnttcaaggcccagttcgatcggggcctagcggcgatcggggtcaaagcgccggaagctgcacgactacgttgtatgatgctttcaccgtgcccactcccgnccagcaacgagatgtttggggcttcgatcgcanccgccncccagccgaactgcttcaaatcgcgatggaacatcttgctgatctgcgcacggtccgtcgaacactcgaggacgtggaaaagctatctcagctttcatccgggactcggtcaggaacaggggacagtctgcctgcgggagatgatctcgctatccgtcgcacgccgcctgcacagcaaatccatgacccgactgatcaccagtcggacgagtggctgtttggacaattcccaagacggttcgagcagctgaacatccaagagggacgtcgggcagtgacgcctgtgatgcgaagcgtcgcccaggtcgcccaatacccggtcttaaacgcaggaggagccggagccaacattcgagaatgggtcaatcaagccagtgatcggagggaacgacgacaagcccatcccgggcttcgaaaagcatcttcttctccttcgctgcttaaaggagggatccccagccaggagggctgtcgaggtctaccctccttcggacgggaattatcccgtgagtagtatatggcacagaaatccggtgtaaaattccggcccttcttacgcaaattccccctcccgcccaattcgaactctattttatgaatatcccttgtcatcccgttcctttgttttcttttttgaccactcgggagttaattgtttcactaattttgactcctttctcttagcattttttttgctgcatgaaaataccgaaaaatgatgactaaaaaaaagcatttacaaaattttccaatattgatcctaattataattttccatttagcaataataaatttcacgttaaatttttttctttaatttcaaattcgaatttaataaaatttaaaaaaatagaggttatttctaattttcataatccgggaaatttttgaaaatttcagtgcaatttattaacaaaatttgtaaaaaaattgttaattttttgaaaaaaaattcaaaaaaaatttccgactttttatcagaaatttcggaaatcggaattccgacgtccaaaattttttcggaaatcggaattccgactccaaaaatgtcggaaat

SEQ ID NO: 31866 - DNA, 1117 bp, Heterodera glycines
  misc_feature (118)..(118): n is a, c, g, or t
agtgcggacggactgctgctgggcccgacgactcgccgtgcccaccaacgcggagggccaattcgtctacgcatggtccgctgagcaggagcaggagcggaaattggcaccggtgacngactcgagtggacatctgctgatgccggtggttgatgcggaagggacgccgttggcacgcgacccggccagcggacgttacttggacccagcggatggcacaccaattgcggttgatgatcagggacgaccgttggaccgtagcggcaacgtactgtccaaaaacatttatgacgagtacgtgtgggtggatgtcggtcttgtgagtccggacgggcttccggcacggacggcgggcggccgaatcggtgccgaagcgaccactgccacacttcacgacgatcacgccgtggacggggctgaactcgtgccgtctgatgaaggcggtccggtggcggcacttccggatgaccgcgtgccgacgcgtgtagagaagggcgagtgccgcgtgcaggaggcggtcattgacctggtggtggcagtcaacgacgaactgctccaagcgcatggggaccgcttgcgccaggcgttggacgaccttttggaccagcatttggacctggcggcggatgccacccgcgtggcactgctccaatacggcaaaagtgtggcggttccggtcagtctgggcggttaccacgagcgtgaccaactgctcgaccaactcggccaactgcgctccactgcctccaacttgttgggactgcccgacttgtcggccgcctacgaagcgagcttacaacagttcgaaagtttcggccggggcggaaatgtaccaaaagtgttgctggtggtttccagcggggaggatatgtgagtgtttgcggcaaagggattttagaggggggggggcaaaggtataattagggaggataggtctcggataaggacgggggcaagggcgtagccagacccttggctttggggggggggctgaagtcaaaaagccgatttttaagggtgtatttttcttttttaaatcgatttttatgggtgtatttttcttttttcagtcgatttttaggggtgtatttttcgttttttgaaatcccgaattatg

SEQ ID NO: 31867 - DNA, 1615 bp, Heterodera glycines
  misc_feature (102)..(102): n is a, c, g, or t
tttgatggtgcctatttagtccgtttccggtaaatttggtaaattttcgctcccatcgtgtctcggagggaatgtaatcttttgctgggatttcatctcctnggtgatgcattaatttgaacgatttccaaaatctgccaaatgtgactttccatataatttaaccgctgaatttcccgcatttaaaatttgtattgttacattcttactatttcctggtgaaaccaaagttcgtccaacaattattccgggatatttaagcttaattcctttcaccaaaaaattttgttccattggaaaacattcgttgacttttgctgaaagtatattttcagaccttggctctaaaacttccgtcttttcaagtatcacagacggtggttttggcttttcagacccaattactgacacaatgtttgtccacacatcgccaagtctaactcttttctctcccagggaaattacaccttttaattccataagaagtggtaatccaataagcaaagggccgggacaatgttcgtccactgagacaagcaatacaacttcccattctcggacatttccagtcacattatcctcaattcgaagttttgccatagttttccccaaaatttctatgctcgaatcgtttgccgcagtcaaatttccttttccgtcattttgctccaaaattttaagtcctgcttttcttgctgttctttctctacagtaggatacactagcacatgaatcaaccaaggctgctgttaacaaatcattaagacggacactaatggatgggagtctcctcgggtcattcgtaatcgctgcaacccgtctcggaggaagataatccagaacataagcttcttcatcgattgaatccaattctggtgcggttggtaccgccaaaacccgagtacttcgtttttttgttcccatgattgctcttaacactcttgccaatactgacccagcacgaaccccggcaaatattatcagtctgtatttaattccaatgtatcccatcaataccaaaagaattaataatggtatcgcaatcagtgcatatgataggcctttcaaataacttattgcttccttggttttctccggaattttctttactatttccaaccaatctccggatctaccaattatcacaccaagcgtttcatttgcttcacttttaaccaatttaatagcttccgtaatgtttggtttttcaactaatcgtaatatcggtgtgtgcaaattattcatttttgagcgatattcacgaattgtttcctcaaatcgcacattgtctgattcaaaaagcgctccggcttttaaaattaacgggttttgtatatttcggtacttgggtcgaattttctcaatattttcacccattttttgtattattcccctttgagtctcattctgcattccctttacactgccattttccacacattccgactttttccccaaaatgctcaactcccttgtgccgggtttaacaaaaaatattgtgttttctttacagtactctttggtaaaacagatactgtagcattttgttcctttgttttcaaaacgttttcctttttaccaatttcacttttcagttgaacttcctgttttaccg

SEQ ID NO: 31868 - DNA, 1341 bp, Heterodera glycines
  misc_feature (1315)..(1316): n is a, c, g, or t
  misc_feature (1322)..(1322): n is a, c, g, or t
  misc_feature (1335)..(1336): n is a, c, g, or t
taagttatatcttttcataagattgcctcacatcagcaaatttaatagggatttggaatgattgtaagattcgtaaacttctaagaattggggagggatgctgatacgtgggtgggatgtatttaccttttggaatggactggtttcgatgtacctcccttcgatgcacaatgtaagaaccccatcaatttttaaattcctgtatttgatgaaaatagaatgcttgaaaagccatttcaagaaacggtatgtctcatgaaatgccattaaatttaattttcatttttgaaaattcagcttctctttgtttattctctccatttggttcattcttcgttgctttctgctctctggcgacttttctcagtgatttttcatcttccaattcataaatttcctttattttaagctgtcttttctcctatctttggtacttctttttggaaacacaatgcttctcaactcacttttcttcacttctcttgtctctctaaaggtaaacgagtttacaatcagcatttttcaaaattttgacatggtttagctaatattacttctccgagcgtttctgctacgttttcgctcattttctctagtcttcgctgtccatcttttgctttattttatcggcacattcggaatcaaattccttctccaacgcttgttcaacttcacatcggacaatcatgtagagcgtctttgtgcttgtttttctttgcattcttaactatttccaggtgtttgatttatttgttgccaaatttactggctctcataatttccacactcggctttacacctgcgcacctgaattcgactttctgagtctcgatgttagctatttttttttaattagttaagtttttctttcagactatccgtaaattgactgtctcttggcttttgccacttgcttttctgtccgttttactcttatccattgcactgtttggtgctgctcttcaactcagaaatcgccaaaataatccacaaaaaatgactaatcagaaaacacatcccgaggtatgtttttgggttcgacccgctcgacccttccttcccctgcagatggtgttcaacgccatccaacttggctgttttgttgcgatggctttgatggttatgagactgaaactgttcgccacccctcagttgtgcattctctgttcttgcgctctcaataaagtcagtcccattgttttaattttgtttctcattttgcccttttttaaggatttgcttggcattcgcttctcccgttttcgtgtctttttggctgttcttttttttgccggaatggccattccgggatggnnacaaantatacggggaccnntgcag

SEQ ID NO: 31869 - DNA, 1050 bp, Heterodera glycines
tttccatataatttttttttaataattatttaaaaattgaaaaagatttaagtctctgctccgatgtcatccttcgctccattggcggtgtccctcattttctctttttgctgctaattgccttgccgtctttggatggtaatttaagtttaattatcattcttaagaaggaacaacttttaaaataactgtttttgacaatgaaatgaacttattaaaaattgataaaaattcttagttttttctctgccaaaaacatattttttgagcacttcaatgtatggctgcagttcttccatccgaacggtgatgttcatgcaaaaattaaatttcttaattgggtaaaacatgattttttttctcctgaaaaacagggttagattattgctgccatatttgcatctttttctcattgttatgggttttttgattggtcgatgagtttttattttaaaaatgaacttttaagtttttttattggaagaatttgaaaatttaaatttattttgaacgtatcacatacgacttattttcaaaatctacccaaaaccggcaaaaggatgaagatctgttaaaaatatggccaaaatttctaattccttcccccggcggccaagaattttcgaatgataccaaatttgttcgagtttgaccttttaaacggttaggaatgccccattttgttattttttcagcattttgaaccgtttaaaaacccattttcttgccatttccgcacctcaggagagtatttttctgagcattacagggtacgagagaatgtttcctcataaattatttatcttctatttaaattttaaaaatgatatatctcaatactgatttggtttatgattttacagccctaaatttgaggctttttagtgcctattttcgatttttaatgtctatttttgggctattttggcaatttgtagagcttaaaaatatcatccttaataacgatgagtttttttgtactaaaataagtttttgaattgtttatttttgcacaaagattttttagtatccaaatgagtttttaaaaat

SEQ ID NO: 31870 - DNA, 877 bp, Heterodera glycines
acaataaataactaagatttaaaaataaaaataagtagcgacaactaaaatataaaaaagaaaaaaaaccaaatatctttattatggaaaaaatatttttaaattaaatgaattgaaaagtaaaagtgcgtgctctggaaaaacctgagggacagaaattaattaaatttggtgattcatgaaaatggcgaattccgttaaagatttcgcggaacggtaaaacattaaattagaaattataagagaacaattaaatgttaaggaaaatggaaaaatgttaagaaattgaaaaagggaaaatagggcaaatttctaattgccaacctggcaaacaacagaaactgatcgggtactttgtgccctgggacgtataaaaggagggtaaaaactcctatcaaattagttcaacaactatgtacctttgaggagttttatctctttcgctctgcccctttttctctccccgtttcccctcccgttgtgacgccccgtcgtgcttgcccgtgttgcccatcgtgctgccactgacgtgccatttcgctgtgccgcccgaatcgcgttgcccgtgacgtgccggcccaagcttttttccaatacttgattttgttgtgattgtgccacccgttccggttccctccgaagtttcccccacatttgcgatccccattttttcccatatttgtaccgttcaaatttcccccaattttttccaatttgtgccgttcccctttttcccccaattgttcccccttttttccccttcggggggtttaattacccaagtttgagctgaataataaagtggactattcctgcacacttgctccttgggcctttattcaatcaattcgctctgaatacgttggcatcccgcccc

SEQ ID NO: 31871 - DNA, 1428 bp, Heterodera glycines
gtaccggtaaaaaccggtaattttagaacataaaaatttttggacaaaattttccaaatacaaaatttttattcagttttcgcgtgagtacctgttttttagcattagaattgttcagaagtatatgtatattcaggttgaccaagttttttttttcaaattcaggacatacagtcatggtcataagtgttgtcccatcatgctttgaaaaaaataatgcgtataaaattgtcattttccaatttcaacagataagtagcataccattggatagcattttttatggactttccaatgataccatatttgcatttgtgacataaacatttatttgatttattttaccatattcacaatttgatcaaaatataggtggtcaaaagtgttgtcccatttcatttttaaaatattgcttctctggatcaacattaaaaaaatctaaaaaaattcaggtaagcataactttggatgctgatcaaaaaagggagcaacaccaagttgatcagatcactccttcatggtgatctgatcagcccattttggcggctgggaacgaggggtaaatttcaaaaaaaatttctagggggttgggaaaatttttctggaaattttgagtaggcccattttatagagcacaaaatttgctaccgaattgcctttggaatagtgggtctacgatttaggcccgctgagatacgtcgacttttatttcggtgcctataaaaagtactgtatttcttaagaaaatagtgcattttacactacgtcaaaattgaagtgcccatacctcagccggtataagtcatagagacatgcggttttttgaataatcagcggcaattttccaattttgcgaaggggtctccggccatgtaaattaatgtaaatcaatgacctttttttgctttcaacaccgcttttttcgcggcacgttttttccaagacttttgggggacaaggagggccggcggtgccgataggcgccgccgggaaaaattttctaatttttaatgcgatttgttaacagaatttgtaaaaaaatgaccaattgattaagttttgggtttttaggatgcttaacatgaaagaaaaaagttggaatattttttaaaattaaaattttaattaaaataattgtaaagaaaatgtgaggaatattctatccaagtggggaattgaacccaggcgaaaaattatgaaaggtagaaagtttaaccactacaccacatgtgcatgtgtgtaatccaatgactaaatgaaataaaatttaattttttctcaaaaatttctccttcttcatcaatttcctactcttttctcgaccagacccccattcttaccagtgcaaatttttaccggcggtaccggtactagacaaaccggtaacggtatttcatttttgaaaaaaccgggaccggtaccggtacc

SEQ ID NO: 31872 - DNA, 957 bp, Heterodera glycines
accggtaccggtaccggtaccaactttttcaaccggtaccggtaccaactttttcaaccggtaccggtaccggtaaaaaccggtaattttagaacataaaaatttttggacaaaattttccaaatacaaaatttttattcagttttcgcgcgagtacctgttttttagcattagaattgttcagaagtatatgtatattcaggttgaccaagtttttttttcaaattcaggacatagaacactaaaattcagattattgcaaaacaagggatcagcggccaattttccaattttgcgaaggggtctccggccatgtaaattaatgtaaatcaatgacctttttttgctttcaacaccgctttttacgcggcacgttttttccaagacttttggggggcaaggagggccggcggtgccgataggcgccgccgggaaaaattttgtaatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaacagtgcaaatttttaccggcggtaccggtactagacaaaccggtaactgtaatttcatttttgaaaaaaaccggttccgctcccggttccaaaaaaaccggtaattcccgaccagtcccggtaccggtaccggtcccgatcagccctaatagtaatatttgtttgcattttgtc

SEQ ID NO: 31873 - DNA, 1458 bp, Heterodera glycines
gaggagcagcgaaatcagcgcgaaatgttggcacaccagcgcatggagcaggaggagagaagcaaattggagaccaaactgatggaggtggccaacatcaattagcgaatattttggcttaattaattgagtcaatcgccaaatttgaggcccaacaaaatgccgaacttgccaatgccgagatggaattggccagggaaaggctggccaaggagcaggaaacggtgcgaacactcggcacaaaagtgggcatttatttatcatgttgatgatatcatacacttagagcctaaccagaaaattatcggcattgcaaggcacaagccgacggcattatttttttttgtttatcgtccaaaaaataatttaattcgggttcggtaatgccgacagacgtgaccagagaatttttaaatgaaatcggctaataaaatgctttatttcaccagtttttttctttaaatatttataaaattcagcttaaagagcgacaaattgaagaggaacagcgcggtaaaacaagtcaactgaattttaatcaatcaatggcattttaattaaaaaacaaataaaaaataataattcttttaaatctctccccccccccaccgcccccttaggctccgcgcgactgcgcgtccaacgcgagttggaggcggtacaaagcatgtcccaaatgatggccagtgagaataaagggcttagagaggagaagggcgcgctggaggaaaagctgaacgaactccgacaaagggtaaaaaaggagagaaaaaacggaaattaaaaattaaatttcaaaattaaaattaaaaaattggaatttcagttgcacgccaaagactcgcgcgtccatcggttggccgaacttttgggcgaatttttggaaaagtaccggcaaaatgcgcaaagggcgcgccaccaaatcgggcgacaaacggaagagtgagcgcagaagcgggggaaacaaaatgaaaatgagctataaaacagatgccaacagttggaacaaattgtggacaaaattcggcaaaccgccggcgccgcgccctttgccgcgtcgtcgccgccgcacgcgtcggccaccgcgacgacgtcaagcggcgggtcgagcacgcggacggtgggcggcgggtcgacgacgcggcgatcgaaaacggactaaattatattcagacaaaataattatgaaaaattggaataaattttaaaaaatgggacggaaaaagaaatgccaatttttaaaataaaatacaaaaaattttgaaaaaatatcgaaataaattaaataaattaattaataaaatgtgttgactggtgtaacaatgagaatgaaaaataggaaaatattattttcgttttaatttaaaaattggaattttattcttcgattaattggccaatttatccaaattcattttttgcattttttgcgattgctttttttggcggaagcgcatg

SEQ ID NO: 31874 - DNA, 1014 bp, Heterodera glycines
  misc_feature (992)..(992): n is a, c, g, or t
atgtggactaaaaacctctaataattttttaaaaattcaaaaaatctctccaaccaattcgatcaatttgaatcgcttcacagtctaggtagcgaagctccgaaagcgcgaagcgctttttcccagctaaatagccgacggttcacgcacccgctagttaatatatacgttatattgacaaggagtttcgttgctaaaaccattttctcccggccgaaggccgggagcgccctgaaagtggtggaagggtcttacaactttttgaggagaatccgggaaaactatagagaaaaattcagcgcggccaactgagtcccagcggctgatttctcattttttcgtgcatttgagggcccctaactttttttctaaaaccctgaccaaaaagtttccgctggtaggattttaagttgaagtgttggctaaaagttaaaaaaaattccaggcctctacctataataggaagggctgtagaagcgcggacaaattcagtaccaactttggccagttcagtaccaggcgaataactcgccagggtttgaactgagcgagggggtgccagcagacttattgtagagttcaatgagctggattttttcagtttttaaaattttgaaaattttcaaaaattttcgagctaggcctaaaaaacgattttcgggtttttgaattttaggaatttttaacgaattttcccagaaaaacggagaccacttccaaaacatagtttttcgagctctatcgattggtaatttttttggaaaaatttcgattttttcccggaaatagaaaaattttttggcctgagcgggacatttcagtcccgggcctataactcgtcgggggttggttctagccaaaaattgcctcagggcaaaattgtagtgttttttaagctctatcgaatggtgtgccatatggccggaaattttcaaaaattttcgagctaggccccctagaaattttcaagaaagtttttggggtcgaaaaangggtgtgaaaaattatttttct

SEQ ID NO: 31875 - DNA, 936 bp, Heterodera glycines
tttattctcaattcattacttttaataaatttaaatgtttggttttattaataataaatttttttagtttaattaaattattttttgatgaataatgattttcatttaaattattaattttttgtttaatttaatattgttttattaattattttaaattattttctgatgaataaatgttttatttaatttgaattttcgagaaattaattcctttcaatttcaataaatattctatattataaatttctaactttattttaataagtaaaaggatttttttaatttgataaatttataatacatccaataatgcaattttcttatcattttaaaccatgattgtacctcttctaatcacttttgtacctcttctaacaattttgtacctcttctgatcactgtgtccctcttctaatcattgtacctcttctgatcactctcgtacctcttttaatcacttttgtacgtcttttaagcacagtttgtacctcttttaatcacagttgtacctcttctgatcactgttgcacctcttctaatcacagttgaacctgttctaatcactgttgtacctcttttaattcagttttgtacctcttttaatcactgttgtacttcttttaatcacttttgtacttcttttaatcacttttgtacgtcttttaatcactgttgtacctcttttaatcactgttgcacctcttctaataacagtttacctcttctaatctgatgtacctcttctaatcacagctgaacctgttctaatcactgttgtacctcttttaattcagatttgtacctcttttaatcactgttgtacttcttttaatcacttttgtacttcttttaatcacttttgtacgtctttaatcactgttgtttaaaattgataaactaaagaattttatttgttttttttaattagaattt

SEQ ID NO: 31876 - DNA, 1146 bp, Heterodera glycines
  misc_feature (52)..(52): n is a, c, g, or t
  misc_feature (89)..(89): n is a, c, g, or t
gaagagccgagtgagtacctcggtgcaggaaaatattaaatttaaaaatttntaattgctttttaaatatgcaaaaaatgtaggctacntttttagtgaaattcgatcactcatatttttgctaattggagcagaagcgtaccaaactttgccagggatactccccggtaaaaggactacttacactgaaatgagcgccgagctagctggctcaaaaaaattttcgaaaatctgagtctttcgtttttatttgttttttgcataattaattcataaatatttttttcacaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggaacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattct

SEQ ID NO: 31877 - DNA, 1012 bp, Heterodera glycines
  misc_feature (1006)..(1006): n is a, c, g, or t
tagaaaaaagagctctttagaatggtaccttcacatcaaaaaacgactgtcatggagatgagctgcagaaaaaaattacaagccaagaacaagccactatagcagtatagtgacaaaaattaattgaaaatattaatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaagaccaagccactatagcagtatagtgacaaaaattaattgaaaatattgatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtcaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaagaccaagccactatagcagtatagtgacaaaaattaattgaaaatattgatttgtattccggttattcttccgtaaaaaaatgacgccaccttagccattaggcctagaaaaaagagctctttcgaatggtaccttcaaatcaaaaaacgactgtcaggnagctga

SEQ ID NO: 31878 - DNA, 1128 bp, Heterodera glycines
  misc_feature (1084)..(1084): n is a, c, g, or t
  misc_feature (1090)..(1090): n is a, c, g, or t
  misc_feature (1106)..(1106): n is a, c, g, or t
aaaatccccaaatttcagagtgccttccgcgccttttgccccgccattacacactttgctgctatttgtcggcacaacctcacaagcagcaacagttgcgtttccgcttcgtttactccgtcctccaaatgcccccgtcagtgataattgacgaatgtgcggaatttgagggccaaaaacaacaaaaacggtacggcgcatgcactcaatggttgttgcagcaacggactggccaaactgttcaggtggggacggacacccgtaaaatttaaaaaaataaataaaatatttgcggcgattgcaattattttctaattttgaagaaccctgacgaacttgaccaaaaatggttccaatttaccaaaaatcataattcggaattataaccgaaatgctttttctcttgcattccgctcaacctaaaaaattgtgaaaaatttcgaaaataattttattttttcagttttttttacccttttttaatttttgctatgaaaatttttcgtccaatttactttttttgacagttttttggttcataaagaaatccatttccatattgaaaaattgcagatcatccaaaaggagccgtccaaattccgctttttgccccttctttcgtcccctctcccgcttcaatgccgtcccccgactccacgatggttgaccagcccgaccatgcgctgttgttgctgaacatgccgttgatgatggtcggcccaggcactggtgttgctccgttcattgcctttcttcaaaaaatcaggtccccctttttcaccttttctgaggcctcaaaaatttccggaaattggaaatataatttttttttttggggctgtaggagcaaattgaatttatcaacttgaaattgacttaattctttctagaaacttttcacactatctgccctgtcttttttttataagaaaaaattctttcaaaaggtggattttttaaaatttttccaggcatttcatgcaacgaatgggcggcgattgtggacgagtgaaacgcgttctgttctatgcgtccagcaatttggacgacgaaattcctgttcaggtaccacgcacaaatattncatgcnagtttttccaaatgtntattcacacatttcatgtctga

SEQ ID NO: 31879 - DNA, 1941 bp, Heterodera glycines
ctcaggccaacattgaagctagcgcccagccttaaatactttttaaatttatattatctaatgaaaaaaaaaagtttaggccccgttctattctcgttgttttgccgtgttgagtgccgtcattttttctggtgaagcaaaaataaatgtgtagcaattaattacagtaacggatcgggctaataaatttcctggaaaagcgttaataatttcataaatctatacatagattgctgtgtataaaggggttgtataactcacgtagtaaagagggtaattcagcttttaaaatgctttaaggtctgaaacaattcttagaaaaacgaaggtgtgataaattaaaaaagatttttatttttactttttaagcaggctttgccaaatgattctaattgaattaagaaagaatgaagaaacaaaggatgtgaaagaaagaaagaataaattaattatattatttgtcatcagagaatgaaaaaaattaaagaaatttttttttgtaaaattaaataatttatttttttaaattaatctcttttgtcaccagccaaaagggttcacttgccctttttcagactgaaaatgtgccggaactgaagtgccaaaattaagcggggactcaactgaccactctatgaaaagcgccaaaattattgttaaacgggttttttattcagaggatatttattagagagcggaccggaccggatccggtaccggattttcctggatcaggaatccggtccggcgattttttggaaaaatagggattgaccggattacatagattgaccggattatgagagaccggatcccgaatccggtcatttttgaaaatgccaatccggtccggtccggcgaatttttgaccggatccggtccggcttggtctcaaccaaaaaaccttgacgtttgttcgtttttctttgaaaatatctatttggcataatgtctttaactttaaatggtcaaaatttcaatttctcccccgccggagcctgtcagcaccgccgggcctccaaaacttttttctttttaaaaaatttgcccaaaaaagcaaaaaaaaaaaagctcatttttggtgaaaatctgtttgcaaatcgcctcaaattttcaaaatttttcccggcggcgcctatcggcaccgccggacccacttctttctttcccaaaagtttttggaaaaagggcgccgcaaaaaaaaatttttattttttcattaaacataggttttcaaaaataaaaaactttaaaataaattttttaaattttttttgaaaaattgaaattttatatatttttttcggcgcattgtcttttctatgacgacattttctggtgcaccaaatttctacatataatagatgaaattttaagggttttttcccaaattaacatgtgaaatataaatttttaccaatccggaattcggttccggatccggcaatttgaaaatctggattgaccggattaccggattatgagagaccggatcccgaatccggtcatttttgaaaataccagtccggtccggtccggcatttttgagaattccggtctctaattatttgtctcgattttgcgagagtgtaatttttaaataattgtcgtcactaaattggtggaagtgattggcaaatcttaaattgaatatcgatccaattaaaattgcatcccttaaaacattgcaaatatttcttttttattattttctaaatgttttctctttcgaaaatgattctttcttttttgccaattctgatagctttcattgctcactttcgccttttttcttgtctaagtccaaagggcgaaaaattaacggataaaacggaaaaggaaattccgttgcaaattgtgagttaattttcttaagttccatttaataaatattctaaaaatctctgatttgaagaatccgtcgcattcttttcgcattaa

SEQ ID NO: 31880 - DNA, 1271 bp, Heterodera glycines
tcttgttgtacgtctcgaatttgattgtaaaaaacagctttctcgacagtaaacaactctcgaccatcagtcagtcactttgcccccctctcccccattaactgactctgtccttgaggcccttctccttgagccagtcgcacaacggtttgaactgttcctcgagcagtttgtgctgctcctccgacttgctgccctcgtccagcttcagtccctccttcgcaacattttggaactttttgccttcgaattcgggcatcgactaaattaaaatttttagaaaaaaaatccacttttttctgtgtgtgactcacctgaatacagtactcatcaacaggctcggtcaaatacagcacttcaaagcccttcttaagcagacgctccacaaacggtgagttctccacctcctcgccttgaaaacaaaaaaacattggtaaaatttcaaaaatataattatatccgcacgttggactgtactataatacaaaatatatgtaatccttttttcagatttttggataaatataggatccaaaaaagcacataatttctgcagaaactatcgaatggaatcgaaaattttttttgttttgatgtcatttttaaaaagatttttcaagaaaaatgttataaatttttataaaaaaatttcaagaaaaaaaatttaaaattttactaacgttttttttgaaaattagaacaatatattaaaagaatggaaatttttttggagtcaacaaatgggaataaaaattgggatttaatatttaaaaaaatgtaaacggtcactcgcaagaaaactctttaacccgtgccgttaatttcctttcaatttacacccatttgtttggcggaaaaccacaaaaagcaaaacgtacgggatgagccagcaatgtagtagatggcctgctgcttctccttcattcgctccacgtacgcctccagcgttgtctgtttggccgagtcggcggagctgtggaagcgcaacagtttggccaggcggttgcggttggacgggtcctccatgacgcccagcttcaggttggtcgagtactccttgaaatgttgacaagaaaataaaggttacacgttgtgctaaattacaaacccgaggagacagggttacttatggcatcaccacagtttttgtataaaaagcagggatatctaattgaaagtactcataaaaaagggttggccgcagaaaagtcgataggaaacataaagtgcaatagagcctatcgacctaataaactgatgattatcattga

SEQ ID NO: 31881 - DNA, 1624 bp, Heterodera glycines
aaatgaatgtcatattcgtgatcagcgcccatgaaaacctcagaaaaatacaaaaaaaaaaattattattttttttatgtggcgtaaagtgaaaaagtacccaaatatgttgaacagttcaggcatatccttttaactatgattaaatctgtcacctaaactagagtccggtaaaaaaaaatttccgggagcgggatcgggagttcaaaattttccgggacgggagtcccgaacgggaatcccgtaaaaatcccgctcccgttaaaaatccagttcaccgaaaaaagcgggagcgggactcccgtaaaatcccgcgggagatcccgccggactctaacctaaactaaacaaatatcaaaattcttatagagtaattaaaattatatttcaggtgtacgattatttctccgaatttattcctaaatcatttgacgataaagaatgggttcggtacgtttttgactaacacattaagtcagtcttcttttcagaacaatggaatgttcaagtgttgtcgaacgcgttaattattgggcttttttggcactttctcagcatcgaaaagacttggacgaaatgaaacataatcaaagtgtagaacatacggatagttttttcaaagaacaggttatttgttgttcgttttttattttaaatgtccttactcctatttttctcaatatttattgaaaggatcatttttcaatgggttttattgaataaattcgcatttattcagttgcgactttataatgctggaggcatgggatacagtgaagacgcgtactgtttgtatttaaattcctatcaaggcagaaattacgcatcgagaaaatgcaagtggtctttgtcattgtcgatccttaattcaaaattttgaaaatgaaaagccttttcagatcgcacaattgaagaatcaaagaaattggcccagcaattaacacttggagaatcaccgcggattctcttcgattgtcaatttttacctcaaatgacacaacgaatttacggcaaagtagcaaaatcggcagttcatgcatattttgtatggttttggaattttacaatgatttttatttctttgatttcgcaccaaatttaaaattcaacgcacccagagagcgtcattttgaaggaattatcaaggggcttttggacaaaatcattagtttaattttcttgtttattttttaattttgttgtacttaatatcatcgcatttacccgcttctcgtttagaaaaatcttcaccttccttcgccttttccttacgcatttattaacgtcaatcaaacggatcggaacacaatggacttatttctttagtaatattacttttcttggttattttgttcaaagaaaccgcttgagtgttaagcaaagtcgggcacatttccactgcaagaaattggtcaattcggcccgagctctactcaaacgatccttttcacgacccatacgaaactgatccccgtaaacaagttgtctatctctcaaagtattagcgcttcgttgtttcattaaaattaatcagttttctattttcgacatgcttctgagtttatggatggtcctttgatccacaaggcgtatattattccgttcactttcgacataaaacagg

SEQ ID NO: 31882 - DNA, 1000 bp, Heterodera glycines
gtgaagaactgtgttcctccaggcaaaaaattctaagaaaactctaaagcatttgaaattttatttacaacttaactgcaaaatttggtgagctttttctatcaaaaagggaggtgaataaaatgaaaaaaatttttaattcctttttaaacaggccaaaaattttaagcttgtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaattgaaaaaaaaaaatataaaaaaa

SEQ ID NO: 31883 - DNA, 1355 bp, Heterodera glycines
caataattatatccggtaaataaaatttgtattgatacatttgctcaaataaaagcaacataaaggtcaaaataataaaattattattagtcaatgtagaaacaatcatgtataaaaaaaaaatccattgaaaataaacaaaaaaaaaactaataaaaattttaattaaaaaatatttaaaaaaccaagtaaattatccaaaagaaaaaattgatttaatgtaatagatgaaaatttaaaaatgaaccttataaagtaaaaatttattgtaaatgaatgggaacatacgaaactttacgaagattgaaagaataaataaaggaattaaatattcttattaacaataataataataataacaaaaagagaggaaggatatgaaaataagatttaaaaagtaaataattaaactattaattaattaaaagcacttaaaaattaattaaattttttcaaaatattttttttatcactgacgcattttccgggggccattaaaattacaaatttttattacaaactatttcatttaaaaagacagcattttaggattctattctcagattagtaggaagtttatatatcactatcataaaacattataaaatgatcaaatgaacaaaaattcaaattaatttctgtaaataattaaaaataaatcttttggattgatttagttatgtaattgtatgcttttattcttttataattttcaaattttttttcatcattaaattaattaatttcaaataaaattaaaagaaagtgaaaataactaaatccaattaataatcttgaaattaagttttattaaaaaagcatgaaaccaaaataatatttttaacgaaatgacttgctataatattaactttatctcatattaaatacaaaataaaaattacaaaatccaatttatataatcttaaaaatatttaatcaaacaaagaagattacttattacaaaaaatgatatattggaccaatccttgaaatttaaaggtctagacagcgagtttaacacaaaaatcaaaacattttaaaatatattaaaaacaacaagtaatttttgcaatgatttaaataataaaattacactaaaattaatgataatagtaaaaacaactacaatatataagtaaattcaaaatctacaaatataaaaactgataatatttaatttaataccttttaacgttaattgactaaataaattatttaaataaatcaggaaaatataatatttaaatatttttgtcatttaatttaagcaataatattctgaattattttgtcagagactttaacattatttatgaagattggaaattgaattgtgaattgttttaaattattga

SEQ ID NO: 31884 - DNA, 882 bp, Heterodera glycines
cttgatagaaaccatcaaagtctcaacaactaccaaaaataaccagataaaacaaactaaataagaaagaataaatcttttttcacacttctgtttattttgcgaacagaaatatgtcttttaggcagagttatgttgaattttctaagttttcaggagaaattaagggccaaaaggctcaaatcgcctctaacatttgcccaaccgaatcaaactaacagcaatcagcactaagataacgtacagacatcctttaagcattttttattcattttatgccataaaaaaggcattaaacacaaaatttttgcgggtgaaaaaatacgaaaatctgagtaaattcgaaaaaaaattctagggggttgtgaaaaattttccatagaagatgaatatgacgaacagaaagagcacaaaattctctacaaaatggcctttgaatgattgctctatagcaagtattcgctgaggggtgccttgtaaataccgattatccaaaaaatgactcaattcaagccatttttcctcatttttgagacatccattctcccccgccgtttccctcatgtttcgtcgctgtggtcgtctgctgtgttcgctgcagttgctgaaatgggtgcagttgagggatcagtgccgccacgttcagcagccgtgcgatgcccgttggttgagctgcgaaactcctttcctgtcgcggaccgcgccaacaaccaatgatagaggcatataaattattattattattattattattgtatccaaactttgaccgtaaattcattaatttaatctaaactaatagaattttgtcatattgataaactaaatttattctataagagggtctttgtccatcactaaatttaattgcttgatctttat

SEQ ID NO: 31885 - DNA, 915 bp, Heterodera glycines
tggcaaaaaatgaaaagattttcggcacattttatttctttctgtccgttgtcagaccaaatcgcgccttcatagtgtcccgaatgctaatcccgcccattttcgtgctgaaatgtgctcatccagtttgggtgccaacaacaacttgatgagccgccgttgggcaaccaatgcgttgggttctgaaaaaatgtaataaaaattagaaaatattttaagcggattattggcacacctccgaaccatttcaatccaatccaatttatacgcgaaaagcgtgacaccgaccgataaataacaatataaataaatttggtcactgaatgagatgaggtggtttcaaaagtaaagaatcacctccgataggtgtcgaagaagtttagcgaaaagtccgaatggaattaagtaacctcgcctctttaggcgaaacacctatagaggcgagaggtacgaataaaaaacgaatgataccgaacatttggttgaacaataagcggttttaataataaaatcatttttcagttctgaatatgtttttgaaaaggaatcattatgctgaatatggatcttttccaaaattatatcatggaagagttttaaatctatttttattctgcgttttaagagggattcttgtttaaagagttggaggagttcgttatacccgggtatatcatccttattattattacgtctaaaaacaatacgtaaaaatgttttttgaacattttcaagagcatcaatgtcttttttcatatatggattaaaaatcggagaaccaaattccaaaattgatcgacaataaacattgaatatatttatgagaatttttgggcttttagtttacagtgacttgagtaaagcaaaagatgttcctattgcttttttagtaataaattctatatgtttttccca

SEQ ID NO: 31886 - DNA, 1223 bp, Heterodera glycines
cgctgctccaagttgagaaaacttttccgaataattgtgacgaaaacgctccaaatttcagcctaaattgaaagaaaatgcactcaaaaagcggcaattgtttgtggttgagtgccacctgcacattctgagggcacaactccaacaattcgatcatccgaccgatgttctccgagtcttcgatcacataccgcgactccaagtcaaacggaccgccaacaagctgtgaaaaattccaaatttcaatgtaataaaattcaataagtgtttatttaatctttgcatttatgccaatccgaagaaagtcagtcaaattaagccctaaattgatttttcaaaatttgattcagagtatgcaaattcaataaaataaagctttaaatggcattttgaatacaaaaaccggacatcccctaggcatttgattgtaatttacggcttaaaataattgatccatttcttaccgtgttgaacagactgtcaatgatgtctttgtacgggagtgtggcgttgatgcacgcctccttcagccgctcgaaagtttcgcttgggtcctcgtcggtcgcatggatgacgacggtctttccgaattggccattgatggaaacggcgagagattcctgaaaaaattttcaatgtcattaatttgcttgtagcgattctgatcaattttgccaatcatcaattaagaaaagttccaaaaaatgccaagtcggaatggcttaattgtgtttgggattttatcaattattcgtctgtctttgtacaaattggtgctgctggtcctcctcgtccgccgttgtctgagagtgtctccgtgccgtcgttttcgatcggctgtcctccgctgtcctttgtcctgcttccacttctgttcccccctcattttggctttcgtcctttttcccgtcaaatgatgtcggtgtattttcgtcgtacaattgcacatctttcatttctttctcgtcaaaatttgtcgaattcaatgtctcggggaatgaagtcagtccgtgcgattggggcggactttcctttcgctgcctttcgtcgtcccccgatgaatcagtcaaatttgttgttgcttttccaccgccaacaagcatctcataaaaggatacaacgctttccttgctttttaaataaatgaaaaaattcctttgactcgtaaaaatgaatcaccgatctttgttactcctctactactacatttttcatcttatgct

SEQ ID NO: 31887 - DNA, 1565 bp, Heterodera glycines
  misc_feature (99)..(99): n is a, c, g, or t
catttttttgttacttcatcacaactactcatgtaaagcacccgtgacttgtttgaattttaaataataagcagatatcaaagtacaaataaaagtagnccaaaataattaatatttatatgttttaaataaatacaattaggtgttaatccaatcaacataatgtaattttatttaagaaaataataaaaaaattttattataaattaattaacaaaattttcaaataattaaatggcaaaaacctagaaaaatttcgaaaacaattatataatgaatgaattaactattaatatagccaaatggatattttaaatgcatttttaaatccgggaaaaatataggttttccggtccaagggccaactgagtaccagggactgatttctcatttttcgtgcgtttgacggctcgtaactttttttctgaactctaatcaaaaaatgtccgctgtgagggggctaagttgaagtgttgtctaaaagtcaaaaaaaattccaggcctctacctatagtaggaagggctgcagaataggagaaattcagtaccaacttttgtccacttcagtcccaggtgaataccgcgtcagggtttgatctgagcgagggggctccagcggacttattgtagagctttgaaagctgaattttccaaattttaaaatttcgaaaattttcaaaatttttcgagctcggcctaaaaaacggttttcggtgttaatccaatcaacatagaggtaattttatgtagaaaataataaaaaattttaattaaattaattaacaaaattttcaatgataaatgttatcacttctaatagaaaatttatttactctcatgaaataccagattagaatccaggtgagacgaaaacaatttgccagactaaaccaagcctaccgttaataaacgaataagcaataaatttctgacgaataaaaagtgacactctgaaaaaacatttcgccataaattttaaattttgatgtttttgttacatatcatttttacatagaaatggtctttttgagtagcaaaaatcagcaaatcaaaaaaaaatcagcatttacccttgaaaagcagcaaaacactgataaatcagcagaattggctgccctgaataagaaagtgttttaatttttatgaattattttttatgaataagcatggtaaaaagggggtctggtttaaatttttggtggaaattttggaaagaaattttttttaattgaaaaatatacattttgccttgttaaaacatttttttatcataaaattccgacaatataatttggtaatttttatctattgccaatttttatgaattattatttttttccataaaattccaaccaagtttggtacagcataaactctaacgcatctttctcttttcaacctcttctctctctctctctctctatcttttcttacctatctcttttctcctctttttgctctcctatttctctcgctctcttattatctcactatttctttaattctctctctctttcagacaaagtctgaatttgcttcgccaattacattccgttgaatgtagt

SEQ ID NO: 31888 - DNA, 1448 bp, Heterodera glycines
  misc_feature (64)..(64): n is a, c, g, or t
atcattttgctgtccgatgggtgtaagacgacggtggaaagttcaaacaaataaaggagagccntaaggtgggagggggataattaattgaaatgtaaataaatttaaacaaattaaatatccaacaaacttgcgattgctgcaaaatatgcgaccgagtcgaatcggtccgttgtccaacccaacaaaaacaaccgacgaatcgtcgggcgtccaaacgcactaaatcaaggcaaaacaacaaatatttgattcaaaatgttaatagacgaataagttttcttcccaccgattggggcgtcagtttgtccagccattcctcttcaaaagtttgcacagtttggtcctcaattttgaacacgcaaagcatcggttgtttcacctcagcgcattgctcaccccacgactcgcgcagttggaatttctcacccttgggaaacgaagttcaaaccgagtaacacatgattttctttgagaaagttttgaattcgagttgtgctttgaaagacagataaaaaacttaagcatcgggtgaatgagccaaaataaattcaaaaatttagaggtaccaaacaaaagttgaaaagatgatgcctttttgtttaagttcttgccgttaggtaggaaacgttaatggggtgattaggagtggggaggaggtcaccaaacatattccacccaaggggagggggaacaaaaaactgacaatttggccaactgatcggatgccataattatgcccatccccaccaaccagcaatttcttctccattttgtccgcctcctcccattccaggcccgcgtcgtggaatttcgccagtcgctcagtcaatttgcgttccgccaagtaaaggagtcggtcctccccggaggaccaacgaaaacagccgaaagtgccgcccaaaattgtgccatgctttttcaagtccgtaacattggcacaacaaatttcatcacccgtacgattgtcaatcacctcaaagaatttgcaatagtaaaaaaatgcttaaaaagtgcaaaatattaatcgatcaacaaaatttcaccctgataaactgtttcggttcgccgtcagctgccgaaccatttccgtttttgtattcgaccaatgtggccattttggcacacgacggactcagcgaaacacgttgagaactaaaaaaatggcacgtaaaaagttgcatggattaaggagtcttgaaaactattaatttatactcagtgtttatcattggcacattaatggtggagaactgcttgagcccgtcgctgatgcccaacggtgtgtgcacgcgctgctgtcggatcattttctccacaaacggcgcgcgattggcccaaacactgacaatctgaaaaagagtgaaacgaccgttgtaaattaggcgaaagtgaaaatcgaatgcaatttacaagaccataagaaaatttgcacaacaataaaatga

SEQ ID NO: 31889 - DNA, 1104 bp, Heterodera glycines
gagaagcccgcgaacagcacaacatttcgcacgccgttactttgtcctcgagtccggccgtgtgaacgcccagcgagcggttctcgtcgattggcatgtaatcccagtcctcgttgtcatccgtgtccttgccatccacaagcgcaacagacggcttgaagtcggcggcggacagcacggccggcataatcatgtccaaatacttggcgaaacccttgccgaggattttgcaaatgcgcgcccacgcgctgatgaagtaggagatttgggggtcgtcattgttctcgaatttgactcccgagctgagcaacacttgcattacgctgtcggcgtccgtctcgaacagttccgcgccgactgccattccaatgagcgaaatgcattcgatggttttgccacgcaacaacttcaaattgtcatctttggcgttttcaaaaacttaacggagaaaggaaaatgatggagaaagggtcggttagcaatgagcatctttaaaatgaactgtatttgagagggggcatcaaattgccgtaaaatttggcgaagtgatcctgggcggcatcagctaccgaagcgatcgtggtgattatctgaaattgtttgaataatattgatccaacaaagggaaaaagacaataactgacctgttccaagacgagttttttgccattggtcatcatttgctggaaagtttgtgaaagcactgactccaatcgttccattatcttaacaaataggttaaaacaatgaacaaaatacacaataaccgatggcaaataaatactgatgattgacttgggacaatcttcgcaaaagttcacctaaaccaatgaaaatttggccgtataaaaccaccgtcgaatgcgtctcatgccattgcggccgccgcgtgcgcagccactcgcgggacggacatgtcggccatggcctcgaggagaacgggcacaatacgctcatggcatttcttttggatggtgggctggaagtcggtgcacatcttcacagggaaaagttgaattttgccaatgtgtatgtgtgggaaacaaaacctggccaatggcattgcaaacggcgtaacgaacacgaggatgctgaatttaaaga

SEQ ID NO: 31890 - DNA, 333 bp, Heterodera glycines
tccgtttcttaattttgaggcgacattcggccgcttcgcggcctcagacgggcgctttgcgcttctaaatattgtggactcattcggccgcttcgcggcctcaggacgagcgcttcgcgcccgtcttttaattttttctgatttcagattcgtgatcagcgtcataaataacccctaaaaaactaatattaaataactaaggaaaattttttaattaaagattaaaaatcacatgcattttaatttaaaattttttataattaaatactcgttttattaattaaaaacaacgttgataattaattcgtccgtttcacggcctcaggatgggcg

SEQ ID NO: 31891 - DNA, 1283 bp, Heterodera glycines
  misc_feature (294)..(294): n is a, c, g, or t
aatcttagttattcagctgcaaaatttacagtgtatcagatttgttttggtgtatagaccacccaaaacaacacttaaacaaacagaaaatttgtttaaattcttacaaaaattttttaatgaaaattcagtgagattttaatttaccgaataaagatttggtatggaaaaatgggcatccctattcaatgagtaaatgtggtgaaatattttgtgactttttcaatagattttcttatgttttggccacgaatgagccaacaaggattaactcctggctagatttgatttttncggccaatgaaaaaattattactgattgtactgttaaaggaggcatattttcatcggatcatttaacacaatttttcacattaattactcctaaaacaaaaccgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaacaaagaaagatttgactcctaaataaccacaacattattagcatccgtcaaagaaaaggctaaattattcaggcaagctaaaactgacccatctaaaaaagcactatacgatagcatttctttacatataaaaatacaaacaaataaataccataaccaaattgagaaaaaggctatttcaaagggaagaaattcaatttataaatatatacaaaaattcaatgtcaatccctttgaaatacctaatctgatttatgaagataaatgctatcataacagtgctgagaaatgtgaaatatttgccaccttatttgccaattcatttaataatagtgaaaccacccaagcattccatgcttgggtaatattatagaaattgatcaatgctttatatcggatataaattttacatcatcgagacccaaaatcttatgaaaaaacttccgaacaaaaatggcacttctccagataatattagctataaaattttaaaaattgccattcttctctgtcaactgttattactgacttgtttaggatctcattagacactggttcacttccagacatctggaaggaatcaattgtttttccgctttttaaaaagggtgacaaaaataatcccgaaaactataggccaatttcattaacctgctcactttgaagggtaatggaaagaatttcaagcagacatatttacaatt

SEQ ID NO: 31892 - DNA, 934 bp, Heterodera glycines
tcagtaaattcctcttttgagaacagcgggaagcgaattttgaagagagccggaccaagcatttgacgaagattttctgcggtgcattcaatgccattttcacggcacttttcatcggcccaatggagtgccgaaaaaacaattaaaattaattgggaataatcaaattaattaatgaggatttaatgaaaattactgcgttccaaattaaaatttcttcatggatttgcaattcttcacgttccaaaatttcgcacaacaatttttggtcaatttgcaaaaatgaatcagatttgatcagagtttccacatttgtatcaatgtacaacaaacatcgttgaacaaaatcctaaaaaaataattgataataattaaatcccatcccttttttaattgaattcccgtttcccgtctcacaaatttaagccagggcttcgatcgaaaatttttaaaacaaagaagatcaagattttgaggtcaaaaacagaagattttgcgaaatttgcaacaaaagttatccagtgaatccggatcaaaaaaccaagtttttaacagttttttgcggcgcattttttattttgtgcttttgagccaatttttaagaaaataaaggattttagagtccgacaacgccgagccgtggatagtttttaacagatttttgtccaaaaagcatgtttagaaatcattaaatttggtcattaccctcaaatcagaatatttcttagaaaaagaacaaatcgaagccctgatttaacccaactcaaattatattaaacgaatgcttttgtccaccttcagcaaatggtcattaaagcgagcgacggaaagtgctgcgaaaacattggacagtttggaaatgggaaaatctccacacgctttgaccaatccgatgacattgaattttagggctaattaaaaatatatatatata

SEQ ID NO: 31893 - DNA, 1413 bp, Heterodera glycines
  misc_feature (30)..(30): n is a, c, g, or t
cttttgcatttgcgaatgctgctcaacaantttgcaccgtttttctccaaatgcagcaattgatggcttatcaaatcgtcgtggtcaaccaggcatttccggcgggcaacgaaacgaaggacagatttaaccgtgccaaattattaaatggtgagcaattaaatcgaaataaatttattttccgctaatttttctccaatttaaaatttagtcggtttcgttgaaatgcttaaacaattttgcaaccattctgctcaatgttgggattgtgttgtgttccatgacgtcgattttgtgccagaaaatatcactaatatttaccaatgcgaccgaaacgcaccgaaacggctaatctcagccaccgacgaatgggacaattacaaatatgagtcggttttcgaatttaaaatattaaatattttaaaaagttgaattttatgcctggcgataaagcatggatgggcggcgtcgttgcgataacgccggatcacttttcgctggtcaatggcttttccaatgactattggggctggggagcggaggaccaaaatttgcgtgaaaggttttttgggtgccaatggaaattaattaattaaaaaaaaataaaaaatattttaattaattaaaataaaattgggaaaatattttaatgttaacatggattatacataaaaattcttgtaaaatatttttaattaatattatatttttggattttaattaatgcaattaatctatatataatttgttgcataatgcctaaatgcctattttatgcctatttcgcgagttatagcgcctttttcaggattttgaaaatttctatttcctattatagtgcatattcgggggtttttgtgcctattttgcgattttttctgcctttttaggtgcctatttcgctcgcagcactatttataacttccgcgcgtcacgaaaattttccattttaagatttaaattggcaaataaatcggtgcttttcgttcacggacccatcggccattacaaaagcattgagttggcccacaaagacaacgacacgacaaatgccgagatggactgcgcatgtcggcagcttttgatcaacaatttgtccaacacttggaaaatggatgggctatccagcttaaattatgcgcatctgagcacaacggatgagattttgtacacaaatataacggtgaatattaaaaaataataattaaaaaacagccattgcttaattgtttaggtggatttgttaatggacgaatcactgaaaaagggccatccatgcggaaagaaaattaacggcatttatgggtgtgaaaatggggagaaattccatcataactaagcaaatgataataatatttttactttctttaattttgaaaatgtgtcatattattggtattaaatgtaaaaaaa

SEQ ID NO: 31894 - DNA, 893 bp, Heterodera glycines
aaactaaatcataaatttttaacaaagtttttttttatacaattttggccgtttgtaataaaatagttaatgcaacagtactttattttagaaatactgtattactgatggcttttccactgacgcattttcccgggaaccccattttgaaacattaccatcaccgccgacggcacgtccaaaacgtaggaaattgttatttttggcacgtccaaagcgcagaaaggtcgggtcaacgctgccacctgctccgccaactttttgtcggccaaaacggagaaaatttggctcagaaacgagcatcgatgatttgcctataaaattttccaagaacgatagtttaagtatgaatggatagcgattagtagagccctgaaattctgaacaaaaacccggacccgaatttccgggaggaacccggacaggattccgaaagctatttcaagtatgaatggatagcgagcgattagtaaagccctggatttgggaaaaaatccctgacccggatttccggaattaaccggacaggattccgggttaaaagtcacgttttataacgggactccgcgtccttttgcatttttcaaaaacaaacaggactcagacccagatcctgggaaaatcctgtagatataacatgtccgcgctctagcgattacacgattaagggaagaaattcttttataccgaatctgagaaaatttgaggacgtccttgtcggtgtctgagatgcactgttgaattcgttcagttggccattacttcttccaaagcctgtccatgtgacggaattgattcaacaaatttaaaaaacttgactctttacagtagaaaaaaagaaatacatacctaattcatatatccaaaattttcttgaaatcgaatcgaccctt

SEQ ID NO: 31895 - DNA, 920 bp, Heterodera glycines
tatttattcgcaattgaaaaatttttaaaaataatttctttttatgtttatcacctcccccccccccccctcttaaatgctttttttaaaattttttattagcaaatttgggactctgaattcacaaataataaaaattttttgcttttatatgtttcacgttgcgccgaaaaaatttgaaaaaattctcaaagaaatctctcatatgtaagcattgtcaattttagtcaatttccgatcactttcaaaaaaatattattacgaaaaatgcatttttaaaaaaagctcagtttgggccacggttggcaaaaccggggcttttttttggcatgctgttgcccgctggcatttccctttttttctgaggccaggagcggaaaaaatttgcacattttttgaaatgtttttaattttttcattgagaattttattttttaagttagaagagagaaaagcccgttttcaggtgccagtagtccgtcccatccggcgggtctctctctatttaaaagggtatatggcattttcaaaattataaaagtctcagtttcgtgatcagtgtcctaaaattagcctataaaaatatttaaaaaaaccatgagggggggggggggggagggaaaacttagaaataccatattaaaaggagaaatctcaaaaattgtaattttctgtctgttcacacctaattcggcaagcccatcagcagtctccgtgtagaagtagaagccttgcgagatgtacccatgcggcagtcgatgctcttcgatcggcaaaagtctaataaacggttggctgatcacactgatcactgatcagagttactttttgcaacaacaaaaaaaactaaaaaaagaccccataagcttaaaacatagtttaaaacattttttgcgcatatggccatagaaaaagcgaaa

SEQ ID NO: 31896 - DNA, 739 bp, Heterodera glycines
  misc_feature (658)..(663): n is a, c, g, or t
  misc_feature (665)..(665): n is a, c, g, or t
  misc_feature (670)..(672): n is a, c, g, or t
gagagagagagagagtagcgagagacgagagagcgagagagagtagagagagagctgatagagagagagagagtgtagagagagatgatagagagagagagagtagagggagatgattagggagagagagagtagaggggagatcatagggagagagagagtagaggcagctgagagggagagagagagtagagggagatgatagggagagagagagtagagggagatgatagggagagagagagtagagggagatgatagggagagagagagtagagggagatgatagggagagagagagtagagggagatgatagggagagagagagtagagggagatgatagggagagagagagtagagggagatgagagggggagagagagtagaggaagatgatagggagagagagagtagagggagatgatagggagagagagagtagagggagatgatagggagagagagagtagagggagatgatagggagagagagagtagagggagatgatagggagagagagagtagagggagatgatagggagagagagagtagagggagatgagagggggagagagagtagaggaagatgagagggagagagagagtagagggagatgatagggagagagagagtagagggaggggccccccccnnnnnnantacannnagatgctctttgacgaagagtagagggagatgagcgggggagagagagtaggactctagacctcccc

SEQ ID NO: 31897 - DNA, 1222 bp, Heterodera glycines
  misc_feature (23)..(23): n is a, c, g, or t
  misc_feature (1190)..(1190): n is a, c, g, or t
ttagtcatttctcattggtgtgnacgatccaccatttcagtgtacaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgcagttaggcagcgcagttccaaaatttattccatgccacagatattatgggcaggacacgccaagtacctcaaacttgggtaattaaaccaaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttagttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttatttatagctatnttcctaagccaacgccccttttctccctcttt

SEQ ID NO: 31898 - DNA, 1647 bp, Heterodera glycines
  misc_feature (166)..(166): n is a, c, g, or t
tttttatcgatcattttttgcttgttttttttgtttatggactgactgtctaacctcgattttataaaagcgaattggtcaaaaggaattaattttactgtcgcccatttttgaattttttgatcaaagcaaactcaggaattttgacacaaatttaaaagggttntaaaatatacgattgtctattgtgtatacagtaagatttttaatgatattccaaaccacccatttgggttatacagtattaatagttgttccctcctaaatatactgtttgccagcagtgtactgtattctcttccactgatcatgatcacatttttcgcctttcagcgatgtggccacacttttggccgacattcaacgagtttctgcacatgatgtgctcagccaaccgctgggcactgatgttaatgcgctgagggcacaacaggaagtgctcaaggcaattcaaatccggcaattttcgtgccaataaatttttctttaattttaagatgctgaaaaacgaagaaatgtccgagctggcggaccgcaaagagaggacagaatgggaatgtaaggagctgatcaaaggagtcggccccgggatcagcacggacaaattggtgggaatattttacattttggaattttaaacagagtcgggactggtgaatctcggttatggataggtaaatcgatcaattcgggaaattcatgtaccatatatggcacatttatggccaagtatatatgtcaggaataaaaaatggcgataaaatggtgacaaatcgggccgaagcgaggccattaaattatgcgcaaaattttatgggccttccaatcgaaaacttttttttaacgcccaccatttttgatacccgcataaaattaaattttgtttttggatggaatcgtcatacaaaattttgcgcttcttgcgaagaaaattgttcatccgatcaataaaatatgacttggtcgcggcctccaaattccataataaaaatactactgtgagttgcgcctgaggtccgactgagtgagtaccgcacggtttagtcccagaaaatggtccattttttcttttatttaattaaacgatttcacttataaaattatatcattacatgtccccattctcccaaaggtttttttggaaaaagcgccgtaaaaaagtgatgatgaaaagtaaaaaaaaaaaagtctccgcccccggggggaggtacccccccccaagccgaaatcctgggagcgtccctgggaattccgaccctaatacggcacttggaagtcggaattccgttcatccatggaatacagacgccagtcctgggtatgccaatgattgtcagagaggatgagggcgaatttgctaatgtcaaaatgtcccttatatccatccacacaaaatgtttatcttgagtttttggattaaatacccgatacttttttgagaagaggctcttgaaatcaaggctcgagagttttgttgggtcgatgatacccaagaaaatcaaagactcttacagaccagtgatgaaggagatatctattttttcttattattgactttttccctaacttgcagctcaaaattcgtaacttgtttgttgtatgcatgtgtatgtttactcttttgatcactcctcgtacggcaggtta

SEQ ID NO: 31899 - DNA, 943 bp, Heterodera glycines
gttttgattagagttgagcgggaccgggaaatttgacaaaaaccgggaccgggacttaccgggaccagaaaagtcgggaccgggaccaagtttttcgaccgggaccgggaccgcgaaaaaaccgggaccgggaccaaccgggacttttcccaagtgaaaattttttttgaaaaaaattgaaaatttaagtgtactttgttacgaaaattgccaatattcaaaaatgtacccataaaattttgtatttacgttttgggggacgagttcgaggaaaatttttaaaaattttgttatcagggggggttcttggaattttatgagtcccaaaattctgtattttttaaaataaattaacaatcttttaaattttttgcttttagatcgctgtttttgtggcaatgttttttcaaaaaaactttttggaacattgtgggggggggggggggggtccggcggtgccgataggcgccgccggaaaaattttgaaattttgagcgagatttgttaacagaaattgtcaaaaaatgaccaaatatttggttaatttatgggtttttaggctattaaaaatgaaaaaaataataattttaaattaaaatattttttattaattaaattcaattaaaataatggtaaagaaaatataaaaaaattttctgttccatcagggaattgaaccgaagagacaaataatgaaagtaaaaagagttagccacttgaccacttatgcatatgaacatatgctataatgataataaataatttaatttatttttatcaaaaatttctgatcctcaccaattcccttctcttttctcacccagacccccattcttaccagtgcttatttggtcccgccgggaccgggatttctgtttttccaaaaatcgggaccgggacctgaaaaacccgggatttcccgccccggtcccgctcaactcta

SEQ ID NO: 31900 - DNA, 1277 bp, Heterodera glycines
  misc_feature (32)..(32): n is a, c, g, or t
  misc_feature (99)..(99): n is a, c, g, or t
aaaaaatttttccaaaatgctgattttgaccncaaatgatgaatgatttgttgtttgaaaaatgattattttgaaaattttcatctgacaaccttggtntaaagcttctatgatggagcttccatatccacatttttccatattccactatttatgttcatacttccatatttgtccatatttttgaatttttacaaaagtctctattagaacgacccccatcagctattggtctttttgaaccttaaacacggaaaaattttcaaaatcatttttttagtgtagtatacataaagttctaaaaataatccataaaaaggcgaggccacgctggacaccgcccgttccatggtcgtcacgcctggcggcacttcggacaattactgctcctcggcagcggagttggagcagtacgcggaagacggcggcgatgactgtggcgatggggacaacgatggcggggacagtgttattgtgcatcgacggtgcagcagtgggctgagcactgaaattgtcaacgacgcaatggcaaatgccattcgggtaaaaaaatgtttggtgttttttttaactattttctgttctatctactataccatgttttgggggttaccatatgaaattttatgggagcaggacaaaacgtcgccggccgaaacatcgccgggacaaaacgtcgcctgaaagtttttatagagtttgtgccatatcacattttgaatttgcaatgccaattttttcgggctctttgtactataaacatattttgggttggctcatgtcattttttaatgatttttcgtgcaaatttgtgggaatatccaatgccatatttttctggttttggccatgctatttttttcttgctcactttgccatgcgaaatttttgtttacaaatgccatattttgcgtactccttaagaatgtttcgcgcgccagcaaagcttcggctacaacagcagaaggacaacaaccggcgactggagatgaacagccgaaaatgcggcacgggcgcgaatttcaattggaattggacaaacgcgtgtcagcgcatcgggtgaaacattttgccaaaaaatcaggcattttggcgtaaattcaaatccatttacaacatttgaaatctttaaaaaaaacctgcttctgcgactagaaaaaatttattaataaaattaagaacgaataataattagtaaaaattaaaaaaaatagtaaattaataattaaattaaaaataagaatttcactaatatggacgatatcactgacacgttt

SEQ ID NO: 31901 - DNA, 982 bp, Heterodera glycines
caataactatttcctagtcctcaccaactgttactacttttttggtgcaaaaaaatgtcgcggtcaaattgcgaaaatttgaccaattaccatttaattactccccccccccctccaaaaatgcaaatttaattccggaaagtgctcattttgagtccccttttcagtgtatgccctccgtgtcccaggaaattgtgcagcgctataagcagtggaaggacgaatttggctcgcaataaaattggctgactgtgtacattttcagtgggctttataggacgacagcggaataattcattttctggccaatgattcctttttcccttcccccgactcttttccctcccattaacacttttcattccatcccaaatttgcatggcaaattcccttaatcattcactcacccagggacggtcccaggattttggcttggggggggcacctccccccgggcgacgaccttttttttttttttttgcttttcacacccgttttttatatggcgcggtttttccaaaaaaaaattttgggggacagggggtccggcgggggcatataggcgacttctcgaaaatctttgaaaaattataagattttagtttatggattataattaagaaatgatcacactactagattatgaacgatattagcatatattagttcaataatagttgacgtctagattgatgacgatacattacagtgttataaacatttccgctgatcagtccccggctctgatcactttttgctgattaattttatttgtgaccaattttggaccttatttgatagtgaactatgatatctcttttttaaatttaatttagaagttaaaaattgacacctcatcactgtcggtttcaacaagtaacaaatctgttaaaaattttaaataataatgaaaattatgggcaaaacactcaccaaatggcacagctgcaatcatctgaaaatggcaaaattagtgcctttt

SEQ ID NO: 31902 - DNA, 1667 bp, Heterodera glycines
aaattaaaatcaatttaaataaaaatatcgcatttaaattaaatttatttaaaacaatatcgtttttaaattaattatttgttcatttccaaattctcatattcctaaactatgaggatcgcttagcggccaatagatgctttttgcacgccccaaattatatctcccactagagccagcgttgaaagcgcccccggcgctttcacagggcccgcagggccctggttcaatttaatttaaaaatgcgttttttatttaaacatattttttatttttaaggtattgccagaagaagtttaacatgctgtatgtttaaaagaacaatttatattttctcagttttataggaaattgaacaatttgtaaattcaaccccccgccaaaaaattttttttgttgctaaatttattaaaattagaggcagtgaatcggtttcaattctcggtaaaacacttcgcacatcgttactataaaaaaaaacatgaaatcggagaaaaatgatgtggggcatagggggagtcagagtattttatttgttgcgctagtaaaatttcttatttgggtcggtggtcatatatgacaccaaaatctatgcattttaaatcaaatgattgattttcagcagaagcagccaagaaaacgcagcagtcccgcttcattgtcctaaagttctctcctaccgctgttcctggttcagtttcagcaccttgtcgtcctctgcaggtattttttccataaccatttaaaaactgcgctaaacgaggatgaaacccaactcgtaataggcaaactcatgctaaccctactcatattattttttgacaaaaaaagataatttttgtcaaaatcgaccaaattaaacattcttggtatcatttgatagacattaaagttctctctacctgcaaaatacaagaaacttttattggtttacaagtaaaatatgagcagagattttataaactcaaataatttcaaacataaattttgcactagagaatatttttataaacttgttagggatttacatggatcttattgtgagaatgcggggccgacaatttgcgacagggacggaggaagggacgacccgtgtgtgcacggcacttgccgagttggcacgacggtggacgactttgtgtgcgattgtcagtacggatacacaggtgggagaggcgaaataaaattcaaaatattttttaaaaattgtgcaaaatgccataatttgcatttttaaaatgtctttcccttctctctttgccccaccattcattaatcattcaatgagttaggggtgtaccgtaatctctttttttgcccactgttgtggcattcattcgcgcactttcacatttgcacagcggggcgaaatggcgaaagttatttatgaggggggagaaaaaagggaaaaaataaatgggcagagcgatgagaggagaaaactgtggccaatgggcgagcgaaatgcgattcattccaataaaatgtgagggaatttctgatttttggaaaaattatgtttaaataataattatttttttctggatttttggaacattatctgtttaaatttggataactttcatcagagaatcgtttttttggcatttcacagtgatcagacagacttttcgttagaagcacccccaccatgtccctctccccct

SEQ ID NO: 31903 - DNA, 1530 bp, Heterodera glycines
ctctctctctcactctctctctatcactctctctctccctctctctctctctctccctctctctctctccctctctctctccctccaatctccaatcaatccgtcttctgatcagtcaatcactttgatctcctctatctctctctccctctgatcaggtcaaatccactcgtgatctgttccgcgtccgttcttctgatttattcgaattctgggccgattcttttgtgctgcgacagcgtgtctctctgctgccaaatgtgtgcctttctgatcacttctcttcacttatagactttgaacggcgaattcctcaaattccaaaaatggaaaaagtgaaaagcgtccgtttggagggcgatgtttggctgggcaaaagcataacgatgagggtatttaatagttaattgacaattattgatctcacatttgcaaaccgaccaatatataacggattaaattggtgcgttgttaatgaaaagttttttaagttaaacaaaatccgtccccatttagagaatttaaaataatgaaatttattcccatggtttggcattttcccatttttgccaccccattcgcattattaaatttcattcgcgtcacaatgccatttccgctttttggttttctttgtttttatttgttcacttattcaataattggccccagggcatcgttgaggtacgcgccgactcaaaagttcgagttgaagacaattcgattattggcctgattgagcatgcggaagaaggcgacgacggcgatggcaaccaatgaggaggaagaaaataggaggaggaggaaagggaaggaaaggaagaaagagtgacaaaagggagacggaagaggagaggagaaagaaaagagtgaaagggaggaaagaggaaggatgaggaagaggaaaagaggtggaggaggaggatgaagagaggaggaaagaggaggaggataaagggaggaaaggaagaaagtgagagaaaagggagacggaagaggagaggagaaagaaaagagggaaagggaggaaagaggaaggatgaggaagaggaaaagaggtggaggaggaggatgaagagaggagcaaagaggagtaggataaagggaggaaaggaagaaagtgagagaaaagggagacggaagaggagaggagaaagaaaagagggaaagggaggaaagaggaaggatgaggaagaggaaaagaggtggaggaggaggatgaagagaggagcaaagaggagtaggataaagggaggaaaggaagaaagtgagagaaaagggagacggaagaggagaggagaaagaaaagagggaaagggaggaaagaggaaggatgaggaagaggaaaagaggtggaggaggaggatgaagagaggaggaaagaggaggaggataaagggaggaaaggaagaaagtgagagaaaagggagacggaagaggagaggagaaagaaaagagggaaagggaggaaagaggaaggatgaggaagaggaaaagaggtggaggaggaggatgaagagaggaggaaag

SEQ ID NO: 31904 - DNA, 1729 bp, Heterodera glycines
gccaaaaatccaagcagtgattgaagtgccttctttgacgttggaattggcaattccataatcggacgtactttgtttacatccatttttattccttcagtagtgagaatgtgcccaagaaacggtagttcgtttgccgaaaaatggcacttgctgatttttaattttagtcctgcttcccgaattcgttcgaacactatttttaagtgctcttgatgcttttcccacgactcggaggcaattaagatatcatcaatatagatgaagacaaaatcgttgattaatccttcgaaaagctgtgacataaatcgttgaaaagttgcaacggcgttgcaaagtccaaacggcaaaacgacgaattcatgaagcccaaattctgtggcaaaagccgttttgtcgatcgattccggtgacattttaatttgccaataaccggaaataaagtcgagggtcgaaaaaattttcttgcctcccagtgccaataatatgttgtcaatattcggcaaaggatatgcatcctttacagtgactgaattcagtcccctgtagtccacacaaaaacggagtgtgccatcctttttcggcacaatcacaattggtgaagcccatggagacgaagaaggtcggatgatgccacgtccaagatagttttggatcatttccgcaaccttttccctgtaggcataggggacgggtcgcatccttgaacgtatcggtgccgaatttcccgtggcaatttgatggctcaccaagtccgtttggctcaattcctcatcggaaaaggcgaaaatttgaacaaaatcattcaacaacgccattagttcggcttcgcttcattcggaatgtgtccaactttcagcgacatttcatctccaaattggatatcgttttcaccttttccaattagaaagtcttttgtcggcaaaaacgaattgccagaatcataagacgattccacctcttcaactcttccgatcactgtgttcccgtcaattttctccacatttgaactcaaatttgaaatttggccgacaattttcccattttcaactttcccaattgactgatcaattttgactgcttttttagcaggcgctggacatattagcacgtcctggccattccatttttcatcaacctccatttcgacgaatttgctagtccttggttagaatttcgtgttgaaaataatgcggacggtgtcttcgctttttgtcgctttttcgaaatggatcatttcattattgggctcatcgtaaagggagaacccgagtgctgacaatgaattcgttccgaaaagcatgtcgaatccgaacggtgcactggttacgtaaaaatgtatggccacttctttacagcctttacggagaattggcaatgtgagtgtgccaaaacatcggagttccttcccattgacgtcggcaattcggtcatttgtgcgtgcaaaatttgttttttgcaaattcaatcctttttctctgatcagcatatacagaaatgaggcaccaatcaacgaaatttgcgctccaccatcaatcatcgcttccgtttttgcaccaaatgtttcaattttgatgaccaaaatttttccaactctgtcggaactcatttctcgctgattgtttccgtctttcctttctttgaactcgttggcgaaaaattcagcgatttctgatgaaagctgaacaccacggcaaaaagcttccggtgttgcttcttcttgcacaac

SEQ ID NO: 31905 - DNA, 1308 bp, Heterodera glycines
ttgctccccataattgtttgagtaccccaaacggacacttgaaaaaatcgatttttttgttttcggggcagtcccccccgatacgatgcgcccagatttatgggagaccgaatctttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaatttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggg

SEQ ID NO: 31906 - DNA, 1680 bp, Heterodera glycines
tcgtttcctccgtgcggatttcgtccgccgtcgcctttccgtgcctttccaccaatgccatgctcaacacacacgcgcactgcaccgggttgagcactttctgctcagttccttccgaaaaaacaattctttccaaaagagtgtcgtcgccgctctcacaattcttgggaagttcactcggcgatggcgccaaagaaccgtcgccattttgagaggaggaaagagtcacctgaaagagggaagttagaaaatgggtgacagtctaaacacacacactaattcaaaatgaaacaacaaaaaaaggaattttaaaaaaatgcaaataaaagtcacaaattatcagaaattacacctgtaaaaacaattgtgggacttctttttgttgaaagcgtgtgcgacgacctaaaaaattgaattataaattgtgaaatagacaaatggaaatttaatttcttgcattgcttttacccaatgctccgccaaattcgactttttcaatgccggacaattctgaagcttcacggagcgcttctttagctgcggaatgttcgaaataacgcaaatgatgccacactttttccaaggcgaattcggcacggcggtcatctgggacggaccaatgggaaaagtggcgattgatggaaagaagctgaaattgccaaatgaaatggtgttttaagaatgggtgaaatgaccgtcgcttcggcgagtgttttcagttggctttgcctttccaagagaatggcggaccaaacggagacaagtcgaaagcgccaaaagtcgagctcaatcagtcgctggtcattctcgtcaaagtgacaccaaatcgaagaaggcccttttggagagccaaagcttttcaatggatcgaaaaagagagaaaatcaaaaagaaaagtcaaacggagaaaggcaaaccgaacggcgaagaaagggacgttcaaaccgaaggaaagggcggacgaagcgaattgggaggaaacgcacgacaggggaacatccgaagaagtgccattctcttccgattctgaaaaaggaaatgacaaattgagagggataggcactgattgtgaacccgtccccgatgatcccgccaaacctggcaaaagaccagcaaaatttgcaccgataaaggaaacaaattgtcctacggcccattcaaacagttggccattttcagctttgctcctaaggaattggtcaacaaccaattcgatttcatcagaattattggtcatcgttaacgatgaaaattagccaatgacaaaacaatgagaaaataataatggtgaattcgtttgactgatcaatttcagctgagttttggataataacaatttatacttaaatgaaattaattaaactttcgaagagtaataaatccaaaaacaaacagctgcggaaaagagcgaaagaaattgggcggatttttgtgctgcctttaaatatataacaaaaagaagacgcgttttattccattttggaattttatagagtctaaagtttgatgactaacaaaaaggtaaagaacccaaaaacagagaatgaatggtaaaaaaaacaaggaaagaaagttgtgctgtataaattgaagatttccggggaaatatgctcggaataacaaatattaaaaagagaaaaaaatgcgcagacaaaagaatacaataaaaggaaaagacga

SEQ ID NO: 31907 - DNA, 1314 bp, Heterodera glycines
  misc_feature (19)..(19): n is a, c, g, or t
  misc_feature (24)..(24): n is a, c, g, or t
  misc_feature (53)..(53): n is a, c, g, or t
  misc_feature (62)..(62): n is a, c, g, or t
tttcgctgtcatatttttntgttnaaattattacactctggggcacattttcncacctgacnacatagagaacgggcgtattgctggccgatgcgacgagagtcagctgaacaagcccagcggcaaaactgatgctgttctccggcgacagcttcaaaagtggcacataaaaggtgctcagtccgttcagagtccagccgaacatgacgaacacaatgatgacagtgagggacttgagaatgtgcatgttgctggtcgaagtgacttagccattaaggaatgaagcaattaataatcaattatttaattagttttatttaagaataaatattatttaaacaattaacaataattatttaaacaattaattaataaataaattattatttattagattgtcgtttgcccttcttacttttgacttttttgatcgccctctggccatttggacccaaattaggcaataaaaacacactgtgcagatttccatggagacgttgacacgaaagctgtacagcttggagaatgtcgaccgattgtctcccaagaagcacaacaccaatctgatggcagcagaaaggaattataaatcaatcaatgaattgcaatttatgaggccatttaccaatcaattaccaataaatctagtcaatttaataaaatggccaacaaaatttggatgatttcttaaattattggagagcaattaaaactttaaatgcaacttgttttgaaattcgttcaaaatgccaatgtagacgatggagttgttgatgagtccgtaggtaaagctgatcagattcagcacaattttgtaccgtttgacattgcgctcaatttttgacctataagcacacaattttttttttgatcaattgttttttttagagttgctcggtaccggtaccggtaccggtactggccggtaattaccggtttttttggtaccggtatcggtaccggttttttcaaaaatgaaagtaccgttaccggtttgtctagtaccggtaccgccggtaaaaatttgcactggtaagaatgggggtctggtcgagaaaaaaataggaaattggtgaagaaggagaaatttttgagaaaaaaataaattttatttcgtttagcaaccatgcatatgtggtgtaatggttaaaccttttgcctttcattatttttcgcttgggttcaattccccactgggatagaatattcttcatattttctttaccattattttaattgaaattttaattaaaaaaaatattccaactttttttctttcattttaagcatcctaaaaccccaaaaattaatcaa

SEQ ID NO: 31908 - DNA, 950 bp, Heterodera glycines
tgtttgcctctcttcccataaaagtgcaactaatactcttaattaccggaacattcaaatcatattcaaatttattacgcataaatttttttttaccgaaaattatggaatttttaattttgttttcattactcaattaatttgtccatttggttttaaagaggttgcgaagtaaatcatttttgcttttttcttatttcttcaacaaacagttgtgaaccgcgcatccaacatgaacatccttcgacataaaaagtggcacgtacggacgaaagtgcgtttttggtgtttttttttttactcgagatttcctggtgatggttgatgccacggtctcgaaaacctagcgaatggataccgcgaggtcaaacggcactcaaattcatccaaatttggtccacaattagcggtcgtctctcggcattttgccaactaatttcttcccttaattgtttattcgagagtctcgacccgataaaatggtttttgattcgtaggtcaaaatgatcattttttggttgttaattgatctgcctttaacctgtcaattgatcacaggagaatgtggcacgcgtgcgacgtgacgaggccaaagcggcggaggaggaatgcgcgcgggcggagcgtgccgcacttgcggaacacgaggtgtgccgcacttttttccctattttttaaatgatggtatggcacagtgccgactcaccagaccgttcttttcaaggacgacaagccgggattttaaaaaaatggtcgaaaacaagacaagaagaaaatgggattttttcatgaatttattcccgagtcatgaaaatcattctgacccaaaaaatttgcggaaatgggaatgaggccttaaaaataccttaaaattcgacaaaccaaaaccgtgaaaatcggaatttccatcaaaaatttccggtcaacattcgtaatttttgttacatcca

SEQ ID NO: 31909 - DNA, 1292 bp, Heterodera glycines
  misc_feature (110)..(110): n is a, c, g, or t
  misc_feature (119)..(119): n is a, c, g, or t
  misc_feature (162)..(162): n is a, c, g, or t
  misc_feature (1088)..(1088): n is a, c, g, or t
  misc_feature (1110)..(1110): n is a, c, g, or t
tttttttactttaagaaaaaccctcaaatttttattttttgccaaaaatgttaaattttgatcataaacttggattttctttaccctgacctgataattagtgctaaganaattaactntaaaaatagtccataaattatgcaaaaaaaaaaattcaaaatntaagatgcacatttttttgttgcgcataaatttcataaaaactaaattttcatgaaacttagaagtttttaaatgtattcttttttaacatttttttttgtccaatttttgtttttctctttttttcaaaaaagtccatttaagggagcgctaaaatttaatcaaaatccttgaattggtagattttttttgccaaaatctaatttaaaaaatttctttttttttgccgcggcacattattttgtaaaaattggtagcttttccggcaattttgtccgatcactgatggatcatgctttttgctggtttgatcactttttccctcaaaagtgttctccgaatttgatcagatttctcctctctgatcaatcacaactcactctttgtgcgtttttcagttgggcgacctccgttcggctgtccgtgccgcgtacactcatctgatggccaaccccacggacgaggacacattggccaacctccgcttttacatgggccaacccaacttccacaatggcatgttggaagatgtgtggcaaagtgagcacgaggtaattaacatggcatgccaatcaaatcccggagagagtttttcagagggatttcatcagaatttttttctactttttacggggaacaattacaggaggagggattgatttcgtaggaaacagatcaaaatcgatttacgaggcccaaaattttttggaagaaattttaatttataaaatagtaaaaaattttaattttataaataaaccatttggcagttatattaaaaataattaaaaaaagatttcttttcaaaattttataaatgatttcccaaaaaaattcaagaacgtgaagtttgttttttaaaaagcacattgattccttttttgaattttttttgagcatttaggcgccttagttcttttaattanagttgtcccccgaaatacatcnaattgggatttttaaaagcgtattgtaaacacactgttttagtgatatactgtaatgggtctttactatacgtactttcattaccattttgctttgttataaaagcgcattaaaaagtacagtatcactgacgcacttttttgctgggtgtattttctgattactatttttaaatttctgat

SEQ ID NO: 31910 - DNA, 1191 bp, Heterodera glycines
  misc_feature (136)..(138): n is a, c, g, or t
cggaagaggtccaatcggaaggagaggatctggcaaatgggacagacaaaacgtctagagtcagtgggacggaagcgaatggggtaagagggaggggcaggggaagaggagggggcagggggaggggagggaagannncagcagtggaaaggtagggaactcggtgacagaaagcaacggaagacgggactggcatttacttatcagagtgatgctaggcaattaataacagttaattgtctgtctaattgcttttcagcagtcaaacggtgtcacaaattgcagcaccttcgaaacaacgactgagagaaaagtacactttaatgttaaaacgatagttgaatatttctgctcgtccgctatccctaactgattcagtgcctttggctctgtttcttcttatggcgggtacggagtgccgtcgccaattggcacgggcgaagccgaagagcaagcgcaagcggacggagtcaccgcattcggaccgggatttttatctaatcaattgggcgaaggaccactccgagttgggcgcgacccaccgggtgagaagagagctagtaagaagcaatttgggttagcactggactgatcagggagaacggaatcaccggacgaatcgaatccgacggagccatcggtcggtggactgaagggacagccgcaggcggcgatgagtgccgagttcgaaacggaggacgagctaatcagcaaaacgatagtggacaacatgccaacgcctgggaggacattcaccgacggcgcaccaatggcagagaatgggaaaatgaaagacacggaaagagagacagcgaaaacaacggagagcggacagaagaaaggtcagcagagaaaccgatcaaagccaagcaaaaactgatcaactgacagtagattattcggattacgagacggacgtgacagtgccgcccaatctgacggatttgctggccaaccttcagccggcggatataagtgcgcgaaacctgcaaaggatgttccgagactcagtgaccgaccgaaggacacttttgcatggctttgatctgctgattagaaaagtgatcagaacgaaaaaagaataattatcgaaacaaagttgcagataaagaaagaagagggagagaaggaaaaacaaaaggcccaaagaaaatggggcgaagggacaaagagaacggaggagaggcgaca

SEQ ID NO: 31911 - DNA, 1759 bp, Heterodera glycines
ttaccgaaacttcatcgaacctggttctttctattctctttgcaatcgccccagattttttttacggcttaactaggccctattaagcttatttccagaaaatctcgcatgaattctcatttttaaattttttatagatctttaaatgtttgcattttttttggcttaccacaacttcatcgaacctggtactttctattctttttcaaatcgccccaaattttttttacagccacgaggccgcgaagcggccgagtgaggaccttgggcgcaggaaaattattaaggaggagggttcattatttatttatttttgcaaaattaattcataaatttttttcagaaactgttctgaaacgcaccaaaatttatttacgagtcgaataaggcactctgactcttatattatcaaaaagggagatgaataaatattttaaaaatttctaattcctttttaaacaggccgaaaaagtttaggcttaactttttcagcgggtttaaaaaatctagaaaaaatagtaagcatttgtagtgctccgatacgtatctctgcaaaatttggtgagccgctgatcaattacaaattatttatggacgatcaaattttttgaaattttttaagtgcaaaagtggtggatgtctgcaaaaaattttcagccgggtttaataaatctaggaaaattaataagcttctgtagtgttccgatacgtatctcagcaaaatttggagagcccctgatcaattactaattattttttgaatttttttatgtgcaaatgtggtgggtgtctgcaaaaaattttcaccgggtttaataaatctaggaaaattagtaagcttttgtagtgttccgatacgtatctctgcaaaagttggagagcccctgatcaattacaaattatttatggacgatcaaattttttgaaatttttaagtgcaaaagtggtgggtgtctgcaaaaaattttcaccgggtttaataaatctaggaaaattagtgcttttgtagtgttccgatacgtatctctgcaaaatttggtgagcccctgatcaattacaaattatttatggacgatcaaattttttgaaatttttttaagtgaaaaagtgttgggtgtctgcaaaaaattttcaccgggtttaaaaaatctaggaaaattagtaagcatttgtagtgttccgatacgtatccctgcaaaatttggtgagccgctgatcaattacaaattatttatggacgatcaaatttttagaaatttttatttatttttgcaaaattaattcataaatttttttcagaaactgctctgaaacgcaccaaaatttatttacaagtcgaataaggcactctgactcttatattatcaaaaagggagatgaataaatatttaaaaaatttctaattcctatttaaacaggccgaaaaagtttaggcttaactttttcagcgggtttaaaaaatctagaaaaattagtaaaatctaggaaaattagtaagcttttgtagtgttccgatacgtatctctgcaaaatttggtgagcccctgatcaattacaaattatttatggacgatcaaattttttgaaatttttttaagtgaaaaagtgttgggtgtctgcaaaaaattttcaccgggtttaaaaaatctaggaaaattagtaagcatttgtagtgttccgatacgtatctctgcaaaatttggtgagccgctgatcaattacaaattatttatggacgatcaaatttttagaaattttt

SEQ ID NO: 31912 - DNA, 1318 bp, Heterodera glycines
tgcaggtccaaaaatctgagaattcactacctgactgtccatttttaatgacttcctcacatttttataaaatttccataaataaaatgatttttcatcatacattaacaaggggtgcgccggcgcaccccccccccccccccccccccccaattgctgccatatgggatcgttagccgaggaatttacgttttatttaggatgttgaataaaattaaataaaatacaactcccaacagcaaaccagtgataaagtgcttacaacaacaattgatggtaaataattttagaaattttagagggaatgcaaaatttacttccagcagaagctgatgatggacgtgacaacaatccgatcagagacatacgccgtagagttcatttcagcgatcgctcccaaagggttctggacgactcggaccatttgctgaaatccatccgaactcgccgagcggcacctctcgccacttccatgtccatgtccacgctacccacctcgttggagcgcaacggtgatcaaagtctgcaggaccatgcgcggaaaacactgatcagagcgcagcgatcggtcagccccgaagagccactgctgagcgcatcaacgtaagcaatttacagcattaaaatataaaataaaaggtgaaaaaaacaaatgaaaagtaagcgaaataatgaaaaatataattaatctattaaagtattaccggaaaccggggctaaaatcccgagtttgtaggaatcacggtcctgggtatcattttagggcatgattcgggatttgtctccaaaaatgaaaattccagcaaaattttctgaaaatgacgaactaatagagtaccaaataattaatctcttctagtattttccaaagcattgaaaatgccgataaatgtcactgaaaaaaattctaaaactggtttgaattgagaaataacttttgggtgcggtggtgaaaagccggggccgttgtcccgagaaaattgcggcgagatccccgaccccgcccgggctattggttttagaaggcggttatatagcagtaaattttatctttcattaatttttagtagattattttttactcaggagccgttatctgcagcacaccccgaaatttccgagaatcgattttgacgattggattgaggaggaaacgcaagcgaaaaagccggcatggaaagtgctccaagagaatgtcaaatcgtcctacaacaaagtgcgaaatgttgttgctcataaaactatttcattaattttatgaaaaaataatattaaatttttaatttaaatgtccaatttcgttttgttttaagccccg

SEQ ID NO: 31913 - DNA, 1007 bp, Heterodera glycines
agaaagtggaagaggaacaggaagtggaagagaaagtggaagaggaacagaaagtggaagaggaacaggaagtggaagaggaacataaagtggaagaggaacaggaagtggaagagaaagaggaagaggaacagaggaagaggaacagaaagtggaagaggaacagaaagtggaagagaaagtggaagaggaacagaaagtggatgagaaagtgaaagtggaagagacagtggtagagaaagtggaaaaggaacagaaagtggaagagaaagtggaaaaggaatagaaagtggaagagaaagtggaaaaggaatagaaagttgaagagaaaatggaaaaggaacagaaagtttaagagaaagtggaaaaggaacagaaagtggaagagaaagtggaaaaggaacagaaagtggaagagaaagtggaaaaggaatagaaagtttaagagaaagtggaaaaggaatagaaagtttaagagaaagtggaaaaggaacaggaagtggaagagaaagtggaagaggaatagaaagtttaagagaaagtggaagaggaacaggaagtggaagagaaagtggaaaaggaatagaaagtttaagagaaagtggaaaaggaatagaaagtttaagagaaagtggaaaaggaacaggaagtggaagagaaagtggaaaaggaatagaaagtttaagagaaagtggaaaaggaatagaaagtttaagagaaagtggaaaaggaacaggaagtggaagagaaagtggaaaaggaatagaaagtttaagagaaagtggaaaaggaatagaaagtttaagagaaagtggaaaaggaatagaaagtttaagagaaagtggaaaaggaacaggaagtggaagagaaagtggaataggaatagaaagctcaagagaaagtggaaaaggatagaaagtttaagagaaagtggaaatgaacaggtagtggaagagtaagtggaaatgtatagaaagtttaagagaaagtgaaaaaggaatagaaag

SEQ ID NO: 31914 - DNA, 1022 bp, Heterodera glycines
ttttgtcttctgttgtagcgtgaataaagcactaatagtgtgttgaaaacgcacgaaaaatagttcttgagaaaaaatggctatctctgaaagtcactattaaatccctaccgggaattggacaccaacttttgtcttctattgtagcggtgaataaagcactaatagtgtgtttgaaaacgcacgaaaaatagttctagacaaaaaatggctatctctgaaagtcactattaaatcactaccgggaattggacaccaacttttgtcttctgttgtagcgctgaataaagcactaatagtgtgtttgaaaacgcacgaaaaatagttattgacaaaaaatggctatctctgaaagtcactattaaatccctaccgggaattggacaccaacttttgtcttctattgtagcggtgaataaagcactaatagtgtgtttgaaaacgcacgaaaaatagttctagacaaaaaatggctatctctgaaagtcactattaaatccctaccgggaattggacaccaacttttgtcttctgttgtagcgtgaataaagcactaatagtgtgtttgaaaacgcacgaaaaatagttattgacaaaaaatggctatctctgaaagtcactattaaatccctaccgggaattggacaccaacttttgtcttctattgtagcggtgaataaagcactaatagtgtgtttgaaaacgcacgaaaaatagttattgacaaaaaatggctatctctgaaagtcactattaaatccctaccgggaattggacaccaacttttgtcttctgttgtagcgctgaataaagcactaatagtgtgtttgaaaacgcacgaaaaatagttattgacaaaaaatggctatctctgaaagtcactattaaatccctaccgggaattggacaccaacttttgtcttctattgtagcggtgaataaagcactaatagtgtgtttgaaaacgcacgaaaaatagttcttgacaaaaatggctatctctgaaagtcactattaaatcc

SEQ ID NO: 31915 - DNA, 1057 bp, Heterodera glycines
tcgtcaagctccgcttgaacttcgcaaaatccgctttgtttggtttttctcggcctccaattgacttcttaaccaccaatccgctcttctattgctctccgcttcaacttttcttttcaattatgccaattcgttgccgatgtttggagttgatcgttgttctcttcgataattgtctcctacaaattgttaaaaaatttaatttaatttaaaataaaaattaattgtaatatatagaaaaaatgctttaattgtcaccttctcttgattttcattatattcctgttcgtattttgcatagataattttgtgctggtcgctaagcttttggtactttttgatgcaatcatcagaaccgcattatccggtgaatctccgccggactgcattaagtcgagaaaagcagattggattttaaagaaaaaaaacaaaatctattagaaataagtttataaaaattgtatttggctaatggagaagtgatcagagatagcttattaaaaaattgtatttggttaatgaagaagtgatcagagatcatttggctaatgatgatgtgatcagagagagccatacatttcaagtttaaaaaatggtttaaattcatgaatttaaaactttaaaagtgactcccaatgccaatgtgtttatttgcatggtttgttccatattttgtatataaatgcatagccgaatcaagaaagttgaaaatttttggaaaacctgacaccatttatggaagaaaaaattttcgtatcagtgcaaaaattcccaatcaaatttgcgggttttaaaaatttcataaatgccgaggcacataatttcatagagagtcggaaaaaaacatttatttgaaaaaagagtgaagaattaatgcttttgagcaaattaagtgggaaatgaaatgaggcagtcgaatgagacaaataaaggtcaattaaacagaaggaaaatttaaataaaaaatgaatctttttaaaagtgtataaaactcgcttcattcccaactaaacagaacaaatttggtatctaaaaaaagcttttgaaaagaaaaatc

SEQ ID NO: 31916 - DNA, 1040 bp, Heterodera glycines
  misc_feature (20)..(20): n is a, c, g, or t
  misc_feature (39)..(39): n is a, c, g, or t
gtgcgcaaaacaaaatttgnccgtctccaatgctgaatntatttgcatttttctgcttttcaatccgtgccacctgcgcaattaaactgcccaacgaaacgccaaaaattccggcaacgcaagtgatcactcctgacaaattaagagttaattatacgccgtaaaattgaaggggaataatttgcaccaaaaattagcgcaatttgattcttttcggcaggtctcaattttgaggtgtcgttcaaatgttcgtccatcgctttggcgtgttccatggcggtgggaccccaccaaaaataaaagaagaaataaaaaagaaattaggaaattattaccatgacaaagttccggtgacaaaaaccacggcggtgtaggccaaagttgaccacacgaaggtacggctaaagcacgaaggaagcaaatgttagtccaattaatttatgtaataataattgactgtcccattattttgcataaaatggcctaattaataaattaattggctgttaatgaattaattagctgttaataaattaattggctgttaataaattaattggctgttcaattactttgcaattaaatgtccaatgtctgcgcaataacttttagtgtgagtgcgtatccgatggtaatactccttccaaatgttctcattcggtgcttctgctgatgccactgttcgccttgaacttggactgatcgttccgctgtttttaaattttttttctcttttttaaattttcctttttcaatacgtttcgtaatttgtcggcatcagttgtgccacactttgttcggattgtcccctcacctgcgatttaattaattaatattttaattgctttctttgaattgttttccatttaattaattaattaattgaccggttctttgacaaaaatcagcaaagtgattatgcagaagaagccgagcaacggagtgacgcgaattccccactgccaacagaagggacagtcgacggagccaagcgcacttttggccaacgaagtggcggaagaaccgatcacataaccaag

SEQ ID NO: 31917 - DNA, 1164 bp, Heterodera glycines
tcactgacgcattttccactgacgcattttccactgacgcattttccggtcacgcggaatagcaatgatcaacgacagccaccaaaacttgttcatccaaaatcaatgcgaaattttccgggtgtcgggtaagccttaattaggtatttaatttattcacacgaataaatattgattttaatcaccgaccgttcaacggcttcgctcagaaggaggaaaacgcatttcgtttgtccgttcgaaatggtgctaggtcgtttcgtaaattccgccactattggcgtttcgtaaatccgccaacgtgggcgtttcgtaaatccgccactatgggcgtttcgtaaatccgccagggcgtttcgtaaatccgccagggcgtttcgtaaatccgccagggcgtttcgtaaatccgccagggcgtttcgtaaatccgccagggcgtttcgtaaatccgccagggcgtttcgtaaatccgccaaaaaataataattcatttaggccaaaattttcataaaaattatatttttgaattttatctatagaacatttgtcggatgcacaaatatcagtctagacataattattagcaaatgtttgtttttcacgaaaatttaataaatatttgtcaacattattgccaacattatctcagttatgaattgtatatattaacaaataaaatcaaattagaagttaatgctttaataaaaatttttggtgttaataaagttcatggctgcattgtgcactacatacgcgcagcagttcatcatatcaaatcgaatttttcaaatttatttaatgaatttaatcaacaacaagacgtgtggaaatgggtaaaataaaattatgtttttaaaaatttgttagatacgtcgaatctttgctcttccgtttcttcgtaaagatgaagctacaaaaatgtggccgatattggtttcattcaaaaatgattttgaaggaagattaagggaggaaatggatagctttgtaaattatatgaataatcaatggataagaaaaatggagcaaggaaacttattttcttttaataaattaactagaacaagatctatgaattccgtcgaagcatggcacagtgttatcaagctggtattgtagcaaaagtgaaaaaaaaataattgtaaattacagagacgcagcaag

SEQ ID NO: 31918 - DNA, 1621 bp, Heterodera glycines
ataaagtgcattagagccgatttttcaaaaaatcgctgagaattttttgaaaaaaattttttcttagaattttcttaagaaaactttctaagatttttttcttgaaaaatttctaagttagcaaatttttttaaatttctaagttagcaaaaattttttttttatttctcggggggggggcaaccgagcgtgggggagggggggaactggtttaaaagatgacttttttggcctttcaataaacaacacctgctgacgccggatttgtggccatagcagcagctgaatttcgcacatgctgttgttggttgggcatgaaaatgttgttggccattgccgacggattggcacaagcggcagccgccgccgccgcgttaccgccgctgccgccacctatgagtgattggaatgaggaggccattgcggccaaataaaggtcggccgagttgagtgcggcagcggccgacgacaacgcgttcatgtccgcagcggaagcgctggcgccgctttttgcaatgccgccgccgccagtcgtcgcagcagcgcttggcaccatggagccaatagacggaaagccggcggccgccgcagcggcagccaacgcggcgatcgcctgctgctccaccatagcggaggaggaagcctggtgttgctgttggttgtgctgctgttgttgtgttacggatgaaagcagtgccgaagcggacaaggagttggtggtgttgctggtgccgccaccgccactagcgacagtgccaaacaatgactgctgctgaccatttttaatgctgaaaggcacaagtgttttggatacaaatggataaagttggcacaattttttgaaaagcggtggtgcgtataggcgtttttccgaaatttttaaaagtgccgacagacatcgtcacattaagaaaaattattgaaaattttttttttgtaataatacgcccgcattcgttcaacaaagacaacgataaaacacactcgaacagctcggccgggttctgctggtagagaaatgatgcgtacggatggttcatcatactgctcgctgtccctccgctggaattgcccaacccgcccagtgccattgtttgctgcagcaacatcatttgttgctcaatgcttttcatgctgtggctgtgctgctgttgctgttgttgggcagtcgaattgctgttgctgttgttggcacaactgctgctggtcgacgaagcggcggcggcggcagccgctgcggacgttgccaacgcagttgcggcagccaaattggtggccttgaaatttaaaaaaaaataataatattgtataagaaatttccgtccggtacaccccaaaacacagccgccgaaacacagccgacacataaaacgccaagaataatttttcaaaaattttttctaacttaagaaatgtttcaagaaaaaaaaatcttagaaaaaatttttcttagaaaataaaagaaacaaaatttcaaaaaattttccagcgatttttttgaaaaaacttagtaattcatcagtaaatttggaaaaaatcgctgaaatttttttttttaaattattcccggctgtgttatgtctcgactgtgtttcggcggctgtgttttgtcctgttccgc

SEQ ID NO: 31919 - DNA, 1091 bp, Heterodera glycines
aaatctgggcgcatcggttcggggggactgcccccattaaagaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggctgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaaggaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaaatctttcgcaaatttaaaaaggaattaaaaatttttaaaatatttattcatctccctttttgatagaaaaagcatcagagagccttatttaacttttaattaacatttggtgcgtttcagagcactttctgaaaaaatatttatgaattaattttgctaaataataaataattaatgaaaaagtgagaatttctaaaaattttaataacaacaa

SEQ ID NO: 31920 - DNA, 1267 bp, Heterodera glycines
  misc_feature (8)..(8): n is a, c, g, or t
  misc_feature (21)..(21): n is a, c, g, or t
  misc_feature (46)..(46): n is a, c, g, or t
  misc_feature (66)..(66): n is a, c, g, or t
tgcactancaataaattcaancctaactgaatttttttaattcaanacagaaattttccagaaaanaataaaatttatagcgttattccttgaattaccaatttttttcaaatgtttccaaagattttttcggaggatgggacgaaacgatacagtgagggagtggaaacgagctgcccccgttaacgacctgctccgaaataaaactttttcgatacaaattcagttttttttttgtcaaatacacattttttagcctggcacattccgttacgtgttcctgttttgtttggcacattttatgcacggagttggcgcaactccactgtacaccattggcgtgtcctacattgacgaaaatgtgtctattattaaaattttcaaatatctctccaaactcaaatggttatttctgaataaatggagcaaaaaattagaaaagatcaaaaaaatatattaaaaatttttaggttggaccactgctctcttcactgtacatcggcgtgttctatgcatttgcaatttttggaccagccattggattttttgcctcaagcaaattccttctctggcacaccgattttctcgtcactggccaaaaattacaaaaattgtatggaaagcgagcgcatttttctggctgcaatttttttttacaaaatttatattttatacagaatcatcgacctagacgagacagacccaaaatgggtcggcgcttggtaccttggttttctgttggcctccattcttggcttaatggctgtttttccaacactcatttttccaaaattactgccggaatcattgaaatggcacaggttggttgtcctaaaacaaatttatgattcatttatagaatttttaaggtttttcaagaaaattcattctgattactggacattccagaatatttaatattttttgttcatcttttttccccctacagaactcgtcttcaagaagagacgttggggcagaaaaaacgttcacccgaatgttgtggtattccgccgtcgtccggcaatcgaacagcaatcgtttttggcgctgggagcgccaattttgatggtacctatttcattcaatttatctccaaaatttcttctggctatggtgcctgacttcgattaaatttcaaaaaaaaatttagaaatttttatttcgctccttttccgttcacagaggatggcaatgagaaggcgccaatggtacaatttcagtcctcagcactaaagcctcgttcgggccccatttggtaccaact

SEQ ID NO: 31921 - DNA, 867 bp, Heterodera glycines
cgttttttaattttgttgataaaattcgaccgcttcgcggcctcaggacgggcgcttcgcgcccgtttttttaattttttgcgggacattcggccgcttcgcggcctcatgacgggcgcttcgcgcccgttttttttttttgtggggagcattcggccgcttcgcggcctaaggacgggcgcttcgcgcccgttttttaataaattaaaaaataataaacacggcctgggtccgaacatgccgcccacccctcagaatccccatcctggtcacccccctgtggtcacaatttccaaaatgacttttatttctataacttttttcaaaaaagtgataaaaatgccaaataaaaaagagcaaaaaattgtggattttttgagtatattatttttataaaatactttttcagaatggagttaggaatttttttctgaaaaatcgaatttttccagaaattctggaataacttatttattttggaagataggaattctaaataaatcccataaaattctcttaattttttgcttttcctgaatgcgccgtcaaaagttgcccccaaggtcgaaatttcgaacccctcccggcaaaccgtaaggagattttgtttttggaaatgagttgccttgttattctaaagtatataactagcgggtgcgtgaaccgtcggatctgggcttgagataaagcgcttcgcgctttgggagcttcgctacctagacaagctatgggttgtgaagatatttggaatttttaaaaaattatctgggacttttaggccgcttcgcggcctcgaacgggcgctttgcgcccgttttttaaattttgttgggcggatacgggcgcttcgcgcccgtttctaaattt

SEQ ID NO: 31922 - DNA, 998 bp, Heterodera glycines
  misc_feature (980)..(980): n is a, c, g, or t
tttgcacatacccatgtttttataagcttaataaaacggaaataaataatgttattattatttctaacatcagcagaagaaagcaatcatataacattcataaagaaaaaaggttttcttttagatagggttcatattttcgtgcattttttggcacattgtctaatcatcccctatttttcatgcattttttgtaaattgaccaatgatcgtccctgctgaatgtctgatccattctaagtgccttcattaatccatttaccatacccaaattttatttttaaactaattccttggttcattttttaaaaagaatttggtgtccacttttccggtgtccaattttcctttgatgtccaaaattccggcggtgtccatttttccgcttggtgtccaattttctggtgtccaatttaccggtccccgtaagcaatcattaagacacacaaagttgcgcaattcaaatttgacacaagcaggattaagattatttaaatgttggccgtaccggtcctcaaagcgtcccgtgcccatcgatgcctttttgggatcagttggctccgaatcggatggtcgcaaaaactttattttaaaaaagtgattttggcatttcaatttttgattttggcattttttcttacccatgcttccaatgagcagttgcagtgccggatgacgaaaagtctcatcgtttgttcatcccatgggatcatgtccaagccgagcacccaaaagcccacaaaatctctcaatttggcaccacttaatgacttattcttatactgctcaacctttgcatcttcaacttcaatcacttcttctaaaatataaataaattttaaaattaaatttaaaaataattttaaattatataataattttataattttaaatatttttttaccatcgaccgtaatgtatgcagataaattgtttttgttacccaaatgaaatgtgaattgacgaaacacttcgggcancatgtaacaaaattgtta

SEQ ID NO: 31923 - DNA, 1203 bp, Heterodera glycines
  misc_feature (1130)..(1130): n is a, c, g, or t
  misc_feature (1139)..(1139): n is a, c, g, or t
  misc_feature (1154)..(1154): n is a, c, g, or t
  misc_feature (1189)..(1189): n is a, c, g, or t
cattttttgcttattgaaaaggcgaggttaaagaccactggcgagtgtgcattacatataaaaaaaggaaagaaagaaaagtaatcaatttttattcaaaagtactttgctccatattttttattatgcctttctttctcttttaactcactcataaaattcttataagaaaaacattaaaaacaaattttaaaacgaataatttaaatataatatttgacgtgaaaatcccataaattaatgggactcgaacccacaacatcccatgaccaaaggcaagcgcactaaccacttgacaaccgggtcgcttgcttcctcccggtttaattcccttttccttttcctacttttttggaagaaatcccgaccaaaagtgcttgagctccctttttagggcacttcccggacccggacccaaacaaccctggtatcattcgaaagcccagactttgtagactgaggcaaattgtttcatttttttcttcattcactttcccattctcttcctattccactcctgttcttttccccattatctacctcttcttctcctgttcctcttcccttttctcctcctctctctctctcttccactttctgttcctattccactttctcttccactttctatttctcttccactttctgttcctcttccactttctgttcctctttcaccatttatgttcctcttccactatatcttccactttggcattctcatccactttctcttactcttccacttattttggcattttttcaaaaaacccctattagaacggcccccatcagctaaattggccgttttaaccccaaagaccggaaaattttccgaaaaagacattttttagcaaaattttgtcgaaaaaattcattaaatttacactttcttaaaaattgataaatttgcttcaaaaataagcaaaaaatggaaaattttggtttttggttgttttctctaaaaaattgcattttttcttctaaatcgagttattataccggatttagccattttagatgtattttactagaatttaatgaatttgaagaaatttttaaaaatttacctctccatatttaaaatttatgtccatatttttgcgattttatgtccatagaattactangagctcggnattttgaggcatatngcctttttttctcgcactagtttgaatatattaangcataaaacgcatt

SEQ ID NO: 31924 - DNA, 2460 bp, Heterodera glycines
  misc_feature (82)..(82): n is a, c, g, or t
tgttttgaaacgtgctgttaccaaaggcggttgctcaacctactgagctccgttatcctggcagcaattttaattgcctttnagagctgagggtagtgcgttaaacatttctaaattttccgtgtcgtttaggtgccctgtcgtcttgtgcttcatgggtggcagtgcgctgctcttcgggtcatagttggttacgaattttacaaattttatgctaatttgtttgataatgcatgtccatgtccatgcgtgtgctataaaaatgaatattttcggctcacctaatcattcacaacgtcatttccctcccatttaagatttttgaaaaaaatgcaaaatcagcctcccaaacgtccctccaatttttctattgaatacctgctgtctatccctaataaaaagccgcggcgcggcttcctcatcaaccaattgttgggagaaatggtgcaagaaggtgctggaacatcatcatcgtcatcaaaaacgagtaaagactatgttcgaaagttggacaacaccatcgaacatgtgccacgcttccaatacaccaaagtcaagtcgcggttcagcattgaagacgtgccagccaatcccgagggactcctcgccggaatcttccaatacagtattgacgcagcggtggcggacagtcatgagcgtggggttcggccaacacatctcggctgtctcatcagcagcccattgctcactggcggggacattccaatccccatccggcaaatcacggacaacacggtcaacaccatcttgaaccaattcctcaaagtggcccaaagcaagaaacaacagaacgttacgctttggggagagccattcaccgttattgttacaacagttgatcgccgcggactccctaccaaaagatcacttaaaggtggcgcacgacgggctctggcacctgttcaccatcgggtcaatgatcggagtttgataaaggtccgcatattcaaaaaaatcaattctgatgaggaaggtttaagataaacaaccctgatgaccgtaactactgcctcttttatgctttgcaagcaacgatggtggcaaaaacccgaggctgggccagttggaagctttacgactatacgcacagcaggaggggacaacagggatgtttgcagcgagattctctacaactgatgcagcaaattggcgtacggcttgggctcaatggttatgatgctgaaatttgtgtgccgcgggtggtggatcattggaacaacacgcagcaacagcatcgttttgcagtatttatttttggatcaactggtcagtacaagccactgtacaaatacatcaacaacaataactacgacacacccctggtattgtacctgaacaatggtcattttgacggcgtaaagaaagagtatggattgtttggtcaacactactgccttgaatgtgagaagccataccaacgaccagcaacacacctcaattcctgcaaagcacgctgtatgctgtgctcgcgagtcggtccagcattcccatgcgctcctcgtgatggctttttccatcaatgtgcgggctgcaacaaaaagtttcgcaacaacgaatgccatcagcaccatttgacatccaatttttgcgcccagtcaaaacagtgtaaagagtgcggggtatttgggacacacgagtgcatcatcgaaatgaacgaaaggtaagaagcgtaaataaatttaaaaataccattcgttggcttcagggtcacaaatgtcacgaaacgtattgtcaattgtgcaacacgtaccacaatccagagcggggttgcttcatccaaccaattgaaccgaaggaacatgacccctaccgcattgtggcctttgacttggagacgatgcagcaccaaccagtcaatccacgtgagcctgagaagaaggaacatcaacccaacttcatcgctgcgagagttgcgtgtccagactgtattgagagcggaaagtggcggagagcaacggcaggctgccaaatatgcggactacatcgaaccgtcgctttttgtcagcgccgttttatggacactcaggtggacaagcaagtagtggctgacaacccgctggaggcatttgtggattggcttgtctaccaactgccaaaaaagtacgacacctatgcctactctcactttggcggccgcttcgacatggtgctcgtcttccgcgagctgttccggatcgggttcaaccccgagatgctgagacgggtacaatgctatttttctaaatttggttaatttaaaatttagggtaataaaatgtacgagatgaaagtgcggaagcagaaaaagcgaaatcccaacgtcatcttccgtgattctttcaacctgatgccatgttcgctggcagcattggtcccttcaatatggacttgatgtggaggacaagccgttcttccctcatggaagcaatagaccggagaactacggcatagaaatccacc

SEQ ID NO: 31925 - DNA, 1026 bp, Heterodera glycines
gatttaagtgattaaatactgaatttttggggtcatcaactcctttgtttttgccatagtttgtgtgccacaaataaaaaatgcgggaatagaggaagaagaaccaaacaaagatgaacgatgaaaaacactttcaggaggcgctaggtgattattggagcccagaaaaattgtagattcagaattttaatggtaataatagaagaggcacaaaaatttagaaataagcatattgcagtgattgggaagaaagatttaagtgattaaatactgaatttttggggtcatcaactcctttgtttttgccatagtttgtgtgccacaaataaaaaatgcgggaatagagaaagaagaaccaaacaaagatgaacgatgaaaaacactttcaggaggcgcccggtggttggttattggagcctagaaaaattgtagattcagaattttaatggtaataatagaagaggtacataaatttagaaataagcatattgcagtgattgggaagaaagatttaagtgattaaatactgaatttttggggccatcaactcctttgtttttgccatagtttgtgtgccacaaataaaaaatgcgggaatagaggaagaagaaccaaacaaagatgaacgatgaaaaacactttcaggaggcgctatgtgattattggagcccagaaaaattgtagattcagaattttaatggtaataatagaagaggcacataaatttagaaataagcatattgcagtgattgggaagaaagatttaagtgattaaatactgaatttttggggtcatcaactcctttgtttttgccatagtttgtgtgccacaaataaaaaatgcgggaatagaggaagaagaaccaaacaaagatgaacgatgaaaaacactttcaggaggcgctaggtgattattggagcccagaaaaattgtagattcagaattttaatggtaataatagaagaggcacataaatttagaaataagcatattgcagtgattgggaagaaagattaagtgattaa

SEQ ID NO: 31926 - DNA, 2183 bp, Heterodera glycines
  misc_feature (27)..(27): n is a, c, g, or t
  misc_feature (48)..(48): n is a, c, g, or t
  misc_feature (2056)..(2056): n is a, c, g, or t
  misc_feature (2104)..(2104): n is a, c, g, or t
ccccgattaaaaaaaaaattcaaattntagagatgagtggaccggtgnagtgcccattttgctgatcggttctccgtttggtatacggtcgaccgcgcgccaggcgcacattggaaatattcggagggatttatcaatgagcaaatgatcgccgcccatttgcccactaacaaagtcggaaccgccgtttttatgtgcggaccgcctccaatggtaaataaaggacaacgtaaaaatgcaattacaaaagttaaaccaattaaaaaaaaattttagtttttttctgaaaaatctaattttttaaaaacataattatgtaagtttatgtttaaaacccattttttaatttttaaaattcattcgtttgtgtcacgacatttcctgttcaacttttacgacccatttcttaagggctattttcggatattttttaggcccgactttttcaaacccaacaaaaatataggacatttaccaaaaatagctttttttctttaaatttatgctgcacttaatattcgtagtttctttctcctcattttgtagcgcacaaaagtttttgttcgtttttggttgcggtcgtaaaagttgcgttaatgtcgtttttggttgggacgcaaatgttggaccgaaaatgtcagggcactgttttccaaaaaaagtttaaaactttcctaaattcccttaaaattgtctacaaattgtttacccccatttttgccagcgtcaccatttattatctcgcgggacgtccattcgtaaattttctcaaaattcctctttttcaggtcaacttcgcctgcttgcctgccctcgacaagcttaactttcccgtagagaatcgctttgtcttctgattgattggaatgtaattagcttttcgttatacaattagtcctttgcccgttttgtttccatacatttgcaagggatgtctcaagacttcgggaagggaacaaaaatttatgttttcttaacaaatttcgtttaattttcttcatttttgtcagtagaccagttgatgaaaaatttatcacaagtctacactcaaattttcaaaaatttggcttcgcccccggcgttttttgaaattgaaaaattcaaatttcacaatagttaaacacatcagcctattggtaaaaatttcgtgcatatgaacggccgtcgatcttggacaccatcccttgcgcatgttcggttattttgccatttaaccggttcaccacaaatttatagtaaaaaggataaacattaaattggaaaccaaaaatgtgtttatgcgtcgacatcgaatgatttaaggtctttcttctttcattctttgctttcctttttctcttggctcggtttgccttttcgtcttatttttgttcggctgttcccttaattttgtttgttcctttaattgttctactcttcacatgacaaatccccgtgacgaacagtgaaaatctgtcaaaattcggtcccccccgtggcgattcatttcgttaatttgattattttccgctgattggggattggttgtcattctgcgcttaattaatttttactccgttttgtcgaattctttttgctctttttattttgtttaaatttaatcagacagaatggttaaaccattctgttaattcgctggactggaaacacttcaattgtcatcagccaattctttgtcttatgtttgttgaactcgtagagagagaaacatggcatacggaggacacaaaaatattgcaaaaattgaggaagacacaaaaaaatgtcgcattttttcgaaatatttcctttgatttgtcctttagtttttttctgcccctttaaaaaagccaattgccatgtgattcttccgtacttttgccacaacaaaataatataacccacgtggaaagtgaaaagctaacgaacggagtcatcaacagacgaacaaaggctttccccgcggctgttggccatttttccgttcgcaaatcgccgcgtccgattttcttgcgttcgaagtgtaaaatgtgccaaatgaccccattaattgtgcaaattgagtattaattaaggngaggggggcaaagtccgtccgaactttcgctttgccctttcggaattnctttgttggactgtcaccttcaccttatctatttttgtaatcaattagtgatgttgtaatgtttgttctgcccatcatt

SEQ ID NO: 31927 - DNA, 1525 bp, Heterodera glycines
tagagtcacatgggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatattttggcattttggtccatattttggcatttttcaaaaaaaactctattagaacggcccccagcagctaaattagcctttttgagcccaaaacccgaaaaatttttcaaaaaatctttttttcgccaaaatttctcgagaatattgaataaatttaaattttcttaaaaattaataaattatgtcaaaaataagcaaaaaagcgaaaatttcgcttttgttgttgattttgcgctaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttggcatttttgccatttatgtccatatttcgcgatttttgccattttatgtccatattttgcgatttttggtccatattttatggccatatttcgcgattttatatccatataattacactccctactgattacgcatctgagcttaggttttacaaaatcattgattttatccatcatttatatcagtactcgtttttttaccaaaatttattttttatttttagaaaaatttggcgtcatgttcaacacttaaaaaattttatggttgtatttggaaatttggattcatttgttttgttccttcattgtccttctcattctgggattttgtgttataaatttcaaaaaattccttctccataaattcaaaagctcattcgaaagctctttttaaactttacaacatccgtgtataagttttacgccaaattttactatttttccatcgggaccacaattccacaccattgccagtctgttaaacctgggtttagtgtttgtgcataatctttaatgaaatctggatagaggaaataaagccggaacatttttacagaaatgacttcgacttctgctgatatttctagtgattttgatcagccgaatcaaaaacaggacccagatgactccggagaatttcaacgtgaccctgatgaattcgttgagtctattcagaatgaagtaactcaatggcttgacgaattacggcgaatcaaaaagcctggcgaaagggatgggccaaaactcggcacgcttgagaagtctctaaacgatttgcaggctgcagtgcgacatttgaaacagaacattgaaatcccacaagttgtgcttgaattcgattccaatattcaacagattgtggatgtggcaagaaaagaaaacagaaaacc

SEQ ID NO: 31928 - DNA, 1395 bp, Heterodera glycines
  misc_feature (28)..(28): n is a, c, g, or t
agtgaacaaaataattggggcattattntgcgtaaaacaaaagcattttttgttagagataaaatgggaaatttgccggggtgctttgtgcataatggacaaaacaattccctccgccccccccccccaattttggttttggtgtccgctcgtcgtcttcctcatcaagtgcccttctcaggaagtgcccaattcttcttcttcaatcaccccgccgcttttcctctgttgttgccgatcgcgctttgatcgtttttgcacaaatttgtgggaagaagacgaaaagcattgggcattggcagatgaagcatttgttgctgctgttttgacgaagaaaaacaaataaaaatgttaccaaaatacgaacaatgttggagaatggaaacggaatgctcaatatacgtattttttcttcatacttcaaatcattttttgatcaatggtcaattgcatttgttctttttttcgaaacatttatggagaaaaacatttattttgtgatgtggtcagctgggttgaacctaattgtaagaaaagtgtcgatgatagtaataattaaattaataaaaatttagactcttagaattgattgaaaaataattagtttaacctttcgttcaaaaacttcggcctaagaaaagattcttttcttttttttaaactttcgatgatatcaaaatcgttttgtttacattgagataatgcgggttatgggctgatcaaaataaacaataaaaaaggtaatgatgtattttttgaattaacacacttttggcattatgactgaccgttcattttatttttgtcaaaccgtgggagtgggtccatcgtccatggtgaaattagagttggtcaagctgagttttttttttattagcactatagcgggccctgaatttctaccatgatttaccgtctttttcgtttttgagcgaccccagcctagaaccaaagtttcctgtccctggttttccaaaaatccctgtctcgactaactctaggagaaatatttgaaatacgtgaatgctgttcttcaattttacaaatccataggaacttatcgaacaaaaatctaaatgggaacatttttaaaattcttatttgtaaaggttcatttgaaactatgtaaatgtaaataatcattaattgaattaaaatcaggatggtaatcctaaaatttttaggtttgatctcacattcatacattgctttctattttttacaaattaccaagttcataacggtttcgaagatgttcaacaacggttaattttcaatgcctcacaaattccttatatattttatttcactttagcatacggctcttacggtggcggccccggggcatattcaagcgcttacggcgccttgtcttcgtaaaaaatttgaaatttt

SEQ ID NO: 31929 - DNA, 1306 bp, Heterodera glycines
ttttaaattttttatagatttttaaatgttgggattttttttttggcttaccaaaaacttcatcgaacctggctctttttaaacatgccaaaaagtttaggctttactttttttaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggctctttttaaacatgccaaaaagtttaggcttaactttttttaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttcaagaaatctcgcatgaattctcattt

SEQ ID NO: 31930 - DNA, 1987 bp, Heterodera glycines
ctttggggaaataaattaatttcttgattgagtgcccttattatttttgtacttttaccgtatttttccaaaagtaaatcaattgcaatttggtaaccatcttccgaaattggtattccctcaattagctccttagcttccccttctaaatttgactccaataaattatgcttttcaattttggtaaccgaatcatcctcgtggacatgtactctgaatgtctcccaaaatggtatccatttttcaactgacccatcaaattttttcaattgtatttgtggaattttcactcttttgattggctgatttcttggagtaagaattgtgctatttagtgaattttgagggtttatgtcaaaaatatcttccaattgttcttttttgttttgccattcatttttcttaatcactgctcgattaatttttgcctcaatgtcaagctgtgtacaaaagtctacataaactctttccttattttcgcgcgctgcaactgcaattttttgcaaactttctgccatttctacgcgttttctcttaatttcttccaaaatttcgcttagctcttcacacgcattttttgctctgtacatatgtctttgtactgtatttggggttgcattttgaccgggatttatcggaatatctcttttaattcaacctctaaccgattgactagcccgtgaattatatccaatattggcgaactcattttaatcttttgctagccaactagctttttagaaatttaacaaaaattaatttgtccacctttaaacaattcggttcgcaatggccaaagggtcgccacgtgtcggagatcggtgtccgtccgctgttctcttttgtcagttcgtccaatgacagtagaagaatcaaacaatcaatcaatcaatcagcctttgtttggtggaacaaattagagtttgccaatcacttcttaattcctggtgagccccttgatttttcagattttgttttcaaaaagtccccggtggaccaatctcccgtttcccggtgaaacaaattttagcaccaaattttcccctaccgtaaccttcaaataatgtcccggtgacaagtatttattacggtgcgaaaatacgaaattgacaaataatatttttttcaatcggagagcaagaacgttgaacagattttttaaaaaagttaagcgaatgaataacggatttttatttttcatctttcccccttttttcgctcacggacattttccgccttttgttaaactctgtgaaattccctatcgctctttttcttcttgtctccaacgactttaccataaatgaataaagtgatcgcaaaggcaaaggatgaaagatatggatgataataataaaatggagaatgaaatttaaattaataaataattaaatgcaaatttgttaaaattatttcctccgtctcttctgtttttggcatttaattctttcggcattctcggcattctctggcatctcggctgcgtcggtcgtgggcgccgacaatttgtcacaataaatagaaaatctaaataaacaaatatttatttttagaaaaaagataaaataaacagagaaattaaattaatttgactaatgctaaaattatacgcaataaattaattaaaattaataaaaaagaaaataaataataaaatgaaattgagttaaaaaactaaaaattaatataaaaaacagaaactaataaaattaataacttgctagaaaaggtttaaaaaaatatattgattaataaattaccataaaaatttgcgggtttgacttccaaaataagcatctgcaagaagattataataattatactataagaaacgtagtaatatataagcgataaataaataaaattttgatgattttttgatatagtgaaagatatttatgataaaaagtattttaagttaatagtaagattacgaaaaaattgaataaatcaataaagggtttaatcattagttatgattctgatt

SEQ ID NO: 31931 - DNA, 1743 bp, Heterodera glycines
taattaataatctacacataattttaaataacatgatgtttttaaaaaaatttgctgacggactgtttactgatggattgtcctgacagattatcaatcatcattgatagatttacactgaacaattgtccgggggcacaaaaagtaccaaatttttttatgagcaaaagttgatataatctttttatatgttaaaaacttgctctgtgtcaaaagaaatcagtttaaaaattctatatgtaaaaatataaaccgagactcgatttttatgaataaagattttcttgcatttttatttttatgcaaaaaattccattcattaattccgaaaactttactctagttatttattaatttcatttataaataaaattttatttttctaaaatttatatcaatttttatagtataaaagtgccgtatttgtatctttcaaattaagccgagaccatgacacgagtcgagactgagggtttttagcacacaattattttttactcacccaattgttttccgtctatgtgtaaatgatttccatggaagttaaattgactccacaaccgatggtgtggccctctccaaacggaggaaatcctccgaaaccatcggtgttatgaccaaaaataaagccatggctcgaataaaaaaaatagtcatcatttgacgtccaaatgccaactccgatggtgctttcattgaaaattaaattttacaaatcattagcaaaatatgtgtaagtcataatggagcgggactgaaacatgtcattcaaattagaaacattaacttctaaaccgagtctataaacggaagtattcattcataatatttaaaaaattttattcaaaaggaagtattcgttcaaaatttttattaatattaatctactatttaattcccaattttcttacacaggttgctaaaccgtgaccatgaatataatttttcaaagattaagtccaagagacatgaattcctgtcgggccacactactataatttgagtttttgacatacccgctcccgtaggacatttgccttcggattattttagtctcgtaataagcgatgccaaaacgcgggataaggtcaaactcagcaattaacatccgataatctggaaaattttctgtaatttaattttataaaaaattgtaaaatcgaacaaaaattgttagttttatagcatttcatatattaaacatgcattttataccaataataaacatttgcatattctattattcaccatttattttcccgacgactgttgcttttgtatatgtaggcttcaaaattaaaaagccactgtgcgatttgtttacgctccaatggtttggcttaaaaaagtttaagattaaaaatgccagatttaaaagactaatagtaagctcaaaaagcatctcaaaactacagatataaaaattagtgtaatttgccctaatctgatcgcacctctttttgcggcatttttccatcaaaatcaaagcctccgctgaggtgcgataacgacagctttgttttgctcaaaaaatcgagcgtcggcctaacgatattattgccaattttgtcaataatattcatttgtggggccctaaaaattcatttatttttttatacagtttcattaataaatgttaaaaaatgtgtttgagcaatacttacaatgagtttttcgattttcgtgatgttctgccgtaatcattgaattgtttgttttgatggcctttaaatgtaaaaattt

SEQ ID NO: 31932 - DNA, 977 bp, Heterodera glycines
  misc_feature (823)..(823): n is a, c, g, or t
actttttccccacatattttgccacaaccgggtcccatccggttttttactcattttgggtatttgctcctcttcctcctcctcttcatcatcttctaatatgacttcgtccacttgttttaacttctctttttccttatttcgcttttccagttcaatttttcgcttgtttgtctcttccaatttcattttcatcatttcaaattcattcaaaagtcgtttttcctctgcacttaactgttcatcgtcgaatggcaccacttcaggcgcttttggtgaatccatgactaaatttgatatgatattggttcagcaaaatttggatcattttttttcgatttttcggcatttttatttaattctgtatcttttgaaatttccgcactttttcaatgtcgtagctttgaaaagttacttgatatttctataaccgaccctttaatccctttgccttcatcattccggttaatgcgctgcaatcagttatcacttttgttattcctgagcctacaatgtatggtgaaaattctttgaccgaataaacgagggcaagagcttctcgttcgatggatggataattagcttcgtgtcggttaagagcccgagaagcgaaagctacttgcccattttcctgtagtaaaactgccccaattgcctttcgggatgcgtcacactcaatgataaatggtttaccaaaacggggtgattgtaaaactggtgcggttgttaacacatttttaagggtttctaaggcttcactttgctcatttccccaatgttcttttattttcccttcaaatttgtcctgtgttaaaatttgaangtgtctcgcaatgtgcgcaaaatttttaataaatcttctgaaatatgtaagtgcgccgagcaatgatttcaattcctgtaagctttttggtgccgtaaattttgaacactgagactttgtttgggtcattctcacgcccttctcacttaataaa

SEQ ID NO: 31933 - DNA, 1287 bp, Heterodera glycines
caaaaaaagagatagccattttctgggatagagtataaattaaaaaatccctcaaaaataaaaggtctattgcgcaccgccctccctatcatgctcgagagcatttgtatgtgtataaaatttatcaaaaaaagagatagccatttttctgggatagagtataaatataaaaattctctcaaaaataaaaggtcgattgcgcacagccctccgtatcatacgcgagagcttttgtatgtgtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaagagatagccatttttctgggatagagtataaatttaaaaattcctcaaaaataaaaggtctattgcgcaccgcccctcctatcatgctcgagagcatttgtatgtgtataaaatttatcaaaaaagagatagccattttt

SEQ ID NO: 31934 - DNA, 1491 bp, Heterodera glycines
  misc_feature (83)..(83): n is a, c, g, or t
  misc_feature (1479)..(1479): n is a, c, g, or t
gccgttttctttgctctgcccattttgctgctgctgttcgtcctcgcgcttctcttcgtcggtatggtccacctgatgcaatntgatagggacgagcactctctgagggaattggccaattaattaattaattgagtaataaatgctgttaaaaatgattattgactaattgcctgatggccggacgaaggactcgtcaggaaaaagcctttgtgagtgcgacccgcgcgattggccacgtaatttttgaagaacagaaaaaacatggcgaaggtacaaattgctaaagacattttttaaagcaaagttagtgattaataggacaaaaaaaaacattttcgattaatttcagcaaaaattggacatttataatgctttataaaactttaataatttccttttttgttttaccgtataacggggcataaatcagcatcagagagtacattgctatcctgacaaattggaaatggcttttgaaatagcattagaacattcaacaaatgcctggcattttgcacaatttggttggaccgctccaactcggcctgcggattggtaatgtcaaattgggcacttcgaattcgcacgtcctccgtgtgaattaaatatgccataacaaaaaacaaaaagagggacagaacaaaggcagcagaggacaaaacggtgcaaacaatctgaaaaagagggcattaaaatggtcaaaaagcgaacggacggaccaacatcggccgagttctgagccgacggagatggagcagtatgagcacggaatggagcagcaacagaacaccgacgagggagccgagccaatggccgtcgaagaacacacaaacgacggagaaaatgagcagctgaagggcggtgccgagttggacggcgaaaagccaaagcagcggccgatggtggacgagcagaatgtggttggtgctcagctgctcttcaacctgatttaaattgggaaaatggtagggaaattggaacgtttgtagctaggaccgggttccagaattcccgaactttgtttgggcctgaattgcggatttatggtgataattccataaattgggcctcggaatacccggatttcggatagtcttgggaccacccttggcttgctgctgatttgtaaggttggcttgtctatctgagtttgcctggaatgagtggctaaagtcggactgttccattatgtcgtggccccccgtgcccccgccgtggtcgccctgttgctgctgctgttgttggctaatgaccccggagaagccggactgcttgcgacgctggccgaacatcagcagccgattgagcgacgggccgggcaccgacggttgggggtggaaaatgcgaatagtgtgccgaactgacaaagggtggcaaaattgcgaaatgcaattggttaatcgctttaaattttgacccgtcgattttgtggtcgccgtttcgtctgatccgacggatattcgttcttccgtctgncaattctgctcg

SEQ ID NO: 31935 - DNA, 962 bp, Heterodera glycines
cccatttttcgcaccgtgaatgttatttttattgattctgaaccgttttgagtagattagactagaaaaaattgaaaattttgaaatcatgttttccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctccctcgggtattattttgtagacttttttctccaataaacttgtcaaaccccatttt

SEQ ID NO: 31936 - DNA, 1349 bp, Heterodera glycines
  misc_feature (306)..(306): n is a, c, g, or t
  misc_feature (697)..(697): n is a, c, g, or t
  misc_feature (1331)..(1331): n is a, c, g, or t
cagggtttctatctcaaaattttcaaaataagaacatcaaggccaaaaaataagattttagggcaaaaataagaacattttgcaaaattgctttaaaccagatatttttcgatttattcgatcaaaaatgtattaaattattatatttttcgtctcccattatcgaatttacaattttggggaggaaataagcaaatcgtaaattttcgtgcatttttcggggcgcatttttctaaaaaaaactgttttgaaatgggcgaggggagagggtccggcggtgccgttaggtgccgccggaaaattttngtaatttcgttctgatttgttaacagattttcatcaaaaaggccaattttttcacttagaagccaagcggtgatcctttttttgcttataaaaacacttttttggcggcgcgctttttccataaatttgggggacatagggtccggcggtgccgataggcgccgccggggaaaaattttttgaaaatttgagtataatttgttaacagattttgtccgaaaaaatgaccaaattttgcgattttgggctaatttttaagaaaataaagtatttttggggttcggcggtgccgttaggcaccgccgtggaaaattttgaaaatttaagtgacattacgccataaaattacaaattttctgaagaattttaagaaataagattaacatatttnttctgcgcatatgctataaagaaaggggctcaaaaatagcatttctgcgttaaaattttttggtttgctgaaggtttttagtccatataaatccatatttgggggttttcggaataaatccatatttagccatttttgtgtttttagtccatatttcggccatttttggcaaattttcacaagaaaatgcaagaaaagggaaaaatacaccccctaaagattgattttttggaaattttaaaatttacagcccaaaaaatatgaaaaatttgaattttcgtcgtcattttggcatttttaataaatcttttcatcattttttgcgaacttttctttttttaaataataatttttttttaatttttgcaaacttgaaaatatttttatacaatggacgacaataaatttttttgcatttttatgttttaaatccattttttgattgtttattgttttttttaaatttctttaagcaaatattgaattcatacaccttttttggaatttttgagggtttaaaacatatattttggcagtttttagtccatatttggctatttttgagctttttagtccatatttcgtgcttttttagtccatattttatgtccatattttgggttttttagtccantataatttaaaaccctac

SEQ ID NO: 31937 - DNA, 894 bp, Heterodera glycines
taagccaggaatcataatttattctgttattggatcagaaactttttttatcaatttttatgctgttaattcttggtcatcataatctatcaatgttacattgatggtattattgaaatcgtaacatgtataaaagcgttgtataagctattgctttatgattagacaactgctaaagaagttatacatgaaaattgcgaaaagaatgaaattttgaagttcatcttaataatatttttcagagacttgagcatcgcgttgatgtctgtcaggataatagagcaaaggggtaaagaggggggaggggataaagccatgccaagcgcatttcctcacaactcacggcccaaccaaacattgcttagcttcttctacacgcatttgcacggctcccaactccgtcctttccctttccttctcgacacactcaaataaatcttctgtttggttaagtcactctctcttttgactttgcgggagagagagaggaaaaattgtataaaaagaaaagcaaagggaagggcgaggggaattatttggtggagacggaaatgggagaaggaaaggcggcaattggcagagagaagggacaagcaaagggaaaaggggggaagagagagaggaaagggagggggggggggaaggcagtgaatgattagcaacgaacaaactcaaactctcggaaaccaatcttaatgcgcgagattaacgacatggagaggagccgcttgaggtgagcaaaacaaaaggaaatggcggacaaaaaaagggggcaaagggtgggaaatgagacgacatttgaaatttgtccgacccgcgcatcccaccagacaaattgtaaacaaacgaaacaaagccatcagtcagctcattaaagttcaacgcaaaggcaaa

SEQ ID NO: 31938 - DNA, 1379 bp, Heterodera glycines
ctttcggggatggtgcgtggactagagctgagagctgcttgtggagcgcttcagctgcatgtatgctcgtcagggtattctcttcgcttggcgctgaacgaccagtttagaactggctcgagctcgggtaatccgacggtctaattaaaacagaggagacggatggtccttgtggacgttgtccgagtctgatttctgctcagtgctctgaatgttaagccaaggaaccttgattaagcgcgggtaaacggcgggagtaactatgtctctcttaaggtagccaaatgcctcgtcggctaactaccgacgcgcacgaatggatcaacgagattcccactgtccctatctactatctagtgaaaccacagccaagggaacgggcttggcaaatttagcggggaaagaagaccctgttgagcttgactctagtctgactttgtgaagaatcatgagaggtgtagcataagtgggagcctcaaggcaccagtgaaattccactactttcctcgattccttacataatcggtaagcacgggagtgcgcccgaaagggtgtccattttggcgttaagtcgggcccgcccccccccccccgcccttcaaaattttgaaaaaaaaataaaataataggagacgcagaattttgaaaattttttataaaaactgatgacaagctaatgtgataaaacaggttaattcttttcctttcagtatccctgcaaagtttggggcgcttctgatcagtttctgaaaaaaaagttaagcctaaacttttttggcctgtttaaaaaggaattaaaaatttttaaaaattttattcatcctcccttttcgatagaaaaagcatcagagtgcctaatctaacatgtaaataaaatttggtgcgtttcagagcattttctgaaaaaatatttatgaaataaaaaaatcgattttttcaagtgtacgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtgcgtatgggatactcaaacaattatggggagcaaaaatccaacgcagaattaaagtacaggctatagggaagctattcccgaaggattcggtctccccataaatctgggcgcatcggttcggggggtctgccccgaaaacaaaaataaatcgattttttcaagtgtccgtttggggtactcaaacaattaaaaggagcaaaactccgtcgcagcattagagtccagtataaagagaagctattccggaaggattcggtctccccgataaaa

SEQ ID NO: 31939 - DNA, 1035 bp, Heterodera glycines
aaaacaagataaaaatttaattttatattattttcacttgaaataaattaaaattagattttttttgaatttttaaaatttcccggttggtcctggttcccggtcccggacaaaaaccgagggcccggtcccggcttctcaggtcccggcaagtcccggtcccggttttgccaaaaattcccggtcccacgccactctaataaaaatgccataatatggacaaatatggaaatatggacataaatcgcgaaatatggaaaaatatggaactccatcctagaagcttcaaaccaagctaaaaacatgtttttcgtgcatctcaggccccccacagtccaggaattccccgccctacttataaccctaattattaggtatagtccattttgcttaatagtatttttttgcagaaatttaatgattgcagaaaaaattaaattataaattaagagaataattgcaagtttttagaaagaagtaccagtccattcattacttaaaaaatcaaaataaaaattggattttttttggggtaaaagctctaattcatgcaacaactattattttttgataaaataatgcttcaaattgttattgggtaaaaatgcgcggtttatgccagaatttgaccgatttgaacgtatatttttgaaaaaaaatttcaactttttgttcgaattcgggtccggggttcggaatttggcaaatccgagttcagattcgtgatcagcaccctcgaaaacccctgtatacctatttttagctcaaaataaaaaaagttaaattagggacccccattcttcaggattccttattttcatataaaaacaacaatttaaaataattatacccctaaatatggaactttttcgaccttattttcgcccttatttacggccttattttggacttttcgtccttaaaaatcccagccctaataataactagggcttatattttaggcaaatgcctaaaatttttgcgcacttgatacgcacaattaaagcaccaaaaaccccgttttcccgcttgggg

SEQ ID NO: 31940 - DNA, 1276 bp, Heterodera glycines
aaaattacccaaatttaacaaaaaggggaaatggtggggggatttataaaagccactggcaacttccttaaacgaaagaaaaatttaattttaaacatattttaattgtaaaacatttaatattggagtttttttatccgggcaagtgccggtcccggtttttctccaaatttcagatcccgtgctatttagttgatatttatactgactgatttgaagataattttatcaatccaaaacattcaaattgcattctctaagtgttagccaattaagctaaaaatcaaaaatgtcctatgtttacataaaaaaatgttctgaaaaacaggcaaaatttaaagtcatcaaatttatagattaatgattttctcaacattaaacaaaattggaaatcaacgatttactaattttcatcatcaaattttcttaataattttataacattaagtaagtctgtaaaattgagcataataattataaaatttgtaatactttttgctattgttataatataatccaaaatataaatcattttttaattgcattgaaaatattattttagatcctttcagactgtcattacagaaaatgaaagtattcttaatgatttctttatttgtgtttttgatcatcattttaattaatattaattatgttggatcagaaaagaataaattggaacagaaatcatttgaagaaatatttggagaaaaatgggaagaaaaaagaaacgaagaacagaaaaaaagagaaataattggaaaatataataaaataaaagagaaaattaagcaaaaaggaagaaaatacccaagaaaagaatggagtaaaattgaaagaaaaatagcaaaaaaattgggcacaaatcgccaaaatatttatgaatggatcaaagaattaggattaaatcaaaaaacaaagaaatgctacaaatcaaaaactgacgaagaaaaactcgaaattgtacagaaattcattgaaatgtcaaatgaatataaacaaaaaggaagaacatattcgaaaaaagagtggcaacaaaattatgaagaaatttgtaagaaaaacggagttagccttttcataattaaaaaatggatgaagcaatttggaattagccgaaaaataatagcggaaaaagaaaaaacggagaaaatgaaaatttattggcaaataaaaagagaaatgccgaaaatgagtgacaaggaaattggaaaaacattgaaaattcatataaataccattggcaattggaagaaacaattaggagaagaaataa

SEQ ID NO: 31941 - DNA, 1372 bp, Heterodera glycines
ttcgctttacggtcgatttgcgacgcctttcgatcgataacgaattcattctttcgtcggcggtgttccatttctgatcagtgcacccgcacgaccttccgaattcaattctctgtgctcatcaaattatttgttgtttgtattgtcccccccccccccctccaaccgtccacaacatttgcgggagggacccctcacccctctccctccctccctgttgtccattccctcgtcccccgtccgcacggctcccgataatctcatcgaccccattcccaacccaacctcaccacatcactgtgtacaatcaacgcattttcgaccaaaatcgaacggactcatttcactcatcagagttgtcgaccaaattatagaccattgcttgccaatgaatgaatgactcacaatgattcaatgatttccattggcacaattcaaagtgcctttgatgccgaaaaatactgctaggagccaatgccaatgccattctcttctccgatttatttgctcatttcatcgcttctcttttccctttgcttacatttgcattcccacgacaggcgttttttctggcgacccagggactttttgtgtccgcggaacaatcaatggaaccgtcgcccggagggacgacggaagggacggccaaaacggaaaggaaaagtgcggaagaggaagaagaggaggagatggaaaggaagagggagaagaataaaaggtacgatcatacggaaagtggaattgatactgtaaagcgggaaaggggtacgataagggaagcgtggactaatcaaatggggaagactgacattgatcaaatttggcaaggtggcactgatcaaatggggaagaaacaaatatgtaattactaattccgtgtgctaattatttatttttttggatcgaaaaggtcgtctccttctcgcccttcgtcttcttcctcatcatccgatagagaaggtgatcatccggcagataagcaacgcattggcaaagtgccgcttaaaatcgacactgaaaagcttttgcacaccgacacaatgccaaaagaggcgagaatttaaagagcaattttcaaaattaattgaagcggcctcaaaggaaaatccttgccacttaataaagaatgaactaattaattcgatttattattatccattgattgggttttggcactcggccaaaagcataaattaattaaaacaaaatttatgaatgaattcccttctaactttagaccattgccttagtgcccgagtcgccgccaattgaaattgaaactgtcggagtccggagggataaaatctgtgccgaattggaaaacaaaacggcaaaaatgggagaagaaaacggacaaacggagactctagag

SEQ ID NO: 31942 - DNA, 588 bp, Heterodera glycines
ttcttttggtatcaatttgctgttgcttacgtacggaataatatttatatctattaaattttaaaattggaatttatagtcgcaataaaacattttaataaaaaaaaaaattaaaaaattgttggaatattggcgcccaaacgtgccgcgcccaaacgtgctggcgcccaaccgtgcgcgcccaaacgtgagcgcccaaccgtgcgcgcccaactgagcggttccgggctggacatttcgacaatgaccgtttcgcctttaaaacaattttaatgactcatagctacgcataattatattttaacaattttacgatttttttctcgcagataattcaaatttccattaaaattttcaactcattctccaactgtgttgacaatgtctactgtccaatattcttggtaagactttggcatttattggatatttacaaaaagcattccgctaaatccacaaattcagcaagggctaaatttcggatctcagataatacatatgactaaagccttgaatttttaaattgttggtctctggattagacattaaccggttccgggccgccccggtaaaattctcatttattat

SEQ ID NO: 31943 - DNA, 1179 bp, Heterodera glycines
cgaagaaaagtaataatttcatcagacccttcaaccttctagacacgagagaactgaaaagcgaccaaagcagcgcctttattagtcagctaattgtgagagggatcagccataaataacttatcaccaacaaacaaatattttaaaagctaaaggaaaaaagggcggcgcctatcggtaccgccgccccccccccccgttctccaaaattttttttggaaaaaccgcgccgaaaggtttttgaaaagtttaatgtctcaattaagattgaccctaaccgcgaaaagtacatattataatatatttgaaagggtgaaacgaacgtcgactgcaagataagtgctgtagtaaaagttggttgagaggggaatttggaactgaaagaaaatgcattcagcagaaggaaatgacaaaacggtcactcatcgagagaaaccatcggaagattcagaggaacacaccgcaaatgcatcctcttccttcgtcagtttgactacgtcgaaagggcaatcacagatcactttcacaatctcttggatttcgtaccgactttttgctttaacgaattcagcagaaaactggaaaaaagtgccgacttccacgtcgtgcttacaattagcccagataaaagggaaattggtgatgtgagggcaatagacctgaaagaaagaaaataccgtaatttgccgataataaagataaaacaatgatagccggaagcaaaagtttaccgttcctcgtctgttcagcaaaaatcccgacgaaataaatgagtctttctgaaaattttggttttataaaacataatttcaattgaaaacaatatttcacaatgtgggattaactgggccagtggtattataggtgtccgaaatttacgttcttaatttttaaatttaataaaagccttattttgaaaaaaattgtttcattcaaaaaaaaaccccttaaaatttgaacaaaaaatttaaaattgaggttattttatataataattttataaatattcgagttttgagatggattcgatgttatgattttacacttaccaagaattttctcaatttaatcttcgttccatcctcattcgtgcgctgttctttttcagcaattgacacaacttcaaatctcatcgggttttttcgattggctttctcttgcaaatatttaacccaaaca

SEQ ID NO: 31944 - DNA, 1132 bp, Heterodera glycines
aactttttcatttgcattctttattaatctagcgcagatacaattaatattgtaaaagctaaaaaaattattaataaatggaaattcatatttaaattaattcataatgcaattaatattgtattatctacatattcattcattagcgtttgagatctatcattaatatggatcttccgcttctaattcaaaaattcacacgccactccgatttctcataatcattgtgataatatatgtaataaaataaactataacgatcaattttgtattaagtatcagacttccgacgcaaataaaaagaattaaaatattttttctaagtttaaggaacatatttaaatttatagaatgaaatggttagtgaatcagctctgctaaagcatgattattatagatataaccctatgccgcatttttacacatttatgctgttggttctggttgtggtagtggcagaactgctctctcatcttttggttgagatgtctcaggcggtggaggcggcggaggaggtggaggcggcggtggcggcggcggtgctccgtagcttgggggctgcggtggctcatagcttggcggttctggtggctcgtacgctggtggtggcggaggcggtggaggaggcgggggcggaggaggtggcggaggtggtggcggtggcggcggcggggctccgtagcttgggggttgcggtggggctccatagcttggcggttctggtggctcgtacgctgggggtggcggaggcggtggtggtggaggaggtgggggcggaggaggtggcggaggtgctggcggtgctccagacgcgtcgcgttttcctctgccgtatttgccgtatcctttagatggaggctgcggttgaggccttaaaataaatataaattttaataattatttatttttgagtgtttttacggttgtttctttccgcaatcgcttgggtagttgcacacttggtttgcctggtcgaacacaagccctttcgggcagttcagcttcgtggacacaccgcctgagcatgcgtagtaaacgttggacgcgcaatatttaggcgccgacagtccctctcctttgcctaaaatataaataatggctactttaataatcaaaagaaataaattacatt

SEQ ID NO: 31945 - DNA, 1536 bp, Heterodera glycines
  misc_feature (1485)..(1485): n is a, c, g, or t
aattcttaaccaagtaaaaggtgactcaaaaattttccggatctatttaaaagcatatttcgctttaaaaaattattcaacgattttcatcaaaaattttaccttttttcgcggcgcgttttttcaaaattttttaaaacatcggcgggggaggtccggcggtgccgataggcgccgccggggaaaatttttataattttaatgcaaattcttaacaaattttgtccaaaaaatgaccaaatttagcaatttgaggcaaaaatttctcaagaaaaataagattttaaggtccggcggtgccgataggcgccgccgggaaattttttgaaaatttcagtgcaatttattaacaaaatttgtaaaaaattgttaattttttgaaaaaaaattcaaaaaaaatttccgactttttatcaaaaatttcggaaatcggaagtcggaattccgacgtccaaaattttttcggaaatcggaattccgtgccatccctgctgtacaccgttcacatgaaccaaagccaataatatttacaaaaaagtttattattagggtggtcgaacttgacatgcacgaatcaaatgggcatcgaattgccgttgaagcagatgaggaagaagaagccgcaattgctgatgaagaacgaattgagcgagagaaggagcgaactacctagttaaccgcattcaactagttcgtttatagaagcagcattaagaacaatttacagcaaaaggaagattgccatagagccaccgttgaagttcacgtacgtcaattgtttcaagaaactatattatgattacaacaaaagggagtggaaggaatatgttcaacaagaacgagctggtcaaaaactttgtcgccttaaaacagtatctccatcacatatgcaactttttgtaccattcattaattaatgagcaactttacaaatattttttatatgtgaactataatttgttaaatatatttgaaattgaatataaatatgatttttacatttctccattgacacctttcgccgaatttggggagatagaaaagagtcacttgtgtttagttcaggggtgcgagatgcggccaaaaatttaatatttgatacctttttgatcgaataattttaaaaataaatgttttgaagcaatttcgcagtgttcagatttttcgaccctaaaatctgattttttgattatcatttttttatttaactttgtttctcccatagaaatatttttgaatatttgctggttctaaaattcattttatagctagctgttttttgaatttacattttttattttcgaacccattggcagatttaagaaacgcgccagcacgaatggaaattcgaagcaaaattggaatttttggtttttcaccaaaatgaatttttcttgttttcggttaacattttttttctatgttgatatgtgccggcgtgaaaatttaaaattatttcagaaatttattcgcaaatttatccgnaattcaatttcttttgaatttatcgataattaattttggaattttatggga

SEQ ID NO: 31946 - DNA, 1101 bp, Heterodera glycines
  misc_feature (140)..(140): n is a, c, g, or t
  misc_feature (1052)..(1052): n is a, c, g, or t
  misc_feature (1060)..(1060): n is a, c, g, or t
tatcaaaaagggagatgaataaaatttttaattacttttaaacatgccaaaaagtttaggcttaaatttaaaaaattttcttcgactctagctctttcaataagcaataaaatcgtaccaaattttataggcatactccncggtacaggactaacttaacctgaaaaaatgacaattgtaattggttttaaatttttttagaaattctgagtttttaactgtttatttattttttgaaaaattaattcataaatattttttcagaaagtgctctgaaacgcatcaaattttatgtacaagttaaataaggctctctgatgcttttactatcaaaaagggagatgaataaaatttttaattgctttttaaacatgccaaaaagtttaggcttaaattaaaaaaattttcttcggctctagctctttcaataagcaataaaatcgtaccaaattttataggcatactccccggtacaggactaacttaacctgaaaaaatgacaattgtaattggttttaaatttttttagaaattctgagtttttaactgtttatttattttttgaaaaattaattcataaatattttttcagaaagtgctctgaaacgcaccaaattttatgtacaagttaaataaggctctctgatgcttttactatcaaaaagggagatgaataaaatttttaatttgctttttaaacatgccaaaaagtttaggcttaaattaaaaaaattttcttcggctctagctctttcaataagcaataaaatcgtaccaaattttataggcatactccccggtacaggactaacttaacctgaaaaaatgacaattgtaattgattttaaatttttttagaaattctgagtttttcactgtttattattttttgcaaaattaattcataaatattttttcagaaagtgctctgaaacgcaccaaattttatgtacaagttaaataaggctctctgatgcttttactatcaaaaagggagatgaataaaatttttaattgctttttaacatgccaaaatgtttaggctttaatanaaaaattntcttcggctctagctctttcataaagcataaatcgtaccaa

SEQ ID NO: 31947 - DNA, 1876 bp, Heterodera glycines
aatttgacttttcgaatttttgttcgaattcgggtctggggttcggtgattggtagaaataaatgccggaaattaatctttaattgatataaaactcaaaattcataaaatttgacttttcgaatttttgttcgaattcgggtctggggctcggtgattggtagaaatagatgccggaaattaatctttaattcatattatcaaataaatatatttgcatcaatcaatttttatattttatatacgtaatattgttctggaatttttcattactaaaaacccgtgcgctttattagctcgaattttaaaattagacacccaattcacaggacgaactcaacataaaaatcgaatgtaacggagaatgtgcgctctattaacatgaaggaaaatgggaaacgatagaggaacggggagagcactaattaataatcaataaatgcgcaaaagggtaattgataaatgataacactgatttgcaatcactaaattatccataattttattctgaaatgagaagtgaaaatggaggagagaattggcgagaactgttacatatcacaaaaaacatccgatattgttgaaaagcaaattgacaaattaaaaataattcttttaactgatcgaattttcacaattgcgatatcttcatcagtactgtaaaatgatgtagagggcatggataatgccggggatgtagccgagaatggtcaaaatgatgttaatcaaaatgtggatggagcagcccgtctccacaaaaacgccaagggagctaaaataattgcaattcaacagtaacaactaacagcacagttgactattgttgcattatcattatttaattcgattacaaatccaaaagccatacccatttaaattcaatttaataaaattatattttcaaaacttagcatatatataataaaaccaaatcttactccaccgcacaacattaattagaaattaataaattatttaaagagaaacaaaccggtaaaatgatggcacaaatgactttaaagaaatccgcaaaagtcactgccatattggaatgagaaaagggataaaaatgattattaggaaggacagaacctgtggaaaaagcgcatttggtaatatgaaaacaaacatgtgcacacaaatgtatgtacacaacacaaatgaaaaccaaaataattcgtttaatgggaaattttggatgagtcatccatccatttctgttgttaatagttaattacaaaacacaacttcgctggccaaatcaccactctgtatgtctgtcctctcactgtctgcgcactcgaaaagtgaattggccataagcttattgagctttcccctgtttataaatacttttgaaccaaataggtattcaaatggagccatagcagaaaaagaggacaatggtaatggaaatgataaaatttaacgaaggacagagaattgcaaagaatgagcaaatgtgggggatgggccctgggaattattcgattggatgttgtggggggggggggcgggggtcctttttccttcgtttcctttccctccttttccctctctttccctccctccttttcttccttttctgtgctgtgctcattcattttctcttcactttctccctattttagacctctctctttcttcactatttgtttgttttcgtgtgacattaagctaacaacaaacagttcattgatcaaattttaacacaaaatgagaggaaatatcagggctcccaactgaaaattttcaaaatcagcatttggccggcaaaaaatcagcatttggggtcaaaaatcagcattttggtaaattttattccaaatttataaaactcaataaaaggtttttgctgcacgctttatccaaaaaa

SEQ ID NO: 31948 - DNA, 1106 bp, Heterodera glycines
aaagactttacaaaataataccctggggagaaggggagtgggaaacatgatttcaaaattttcaattttttacagtttaatctactcaaaacggttcagaattcaataaaaataacattcacggtgcgaacaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaaactttacaaaataatacccctgggagaagggagtgggaaacatgatttcaaaaattttcaattttttctagtctaatctactcaaacccggttcagaattcaataaaaaataacattcaacggtgcgaaaaaatgggggtttga

SEQ ID NO: 31949 - DNA, 1801 bp, Heterodera glycines
taaaattcatatgaaatctgtcacctaaactatataccttacgatttttcatatgaatagaattttttataagggattataaaaattttgttcaaaattttttttcttgcataacttttccaaaaaaatttcgtttaaaaatgacaattttgttaaaatctggctaaattccactcaactttttaaaattctcgcctacctcaagctggaccaaaaacacaaatttattattaataataggctaaaaaaccaaaattttgtcattttttgacaaaatcagttaacaaattgcaatcgaattttcaaattttttttccaggagcggacaccaaaataaacactggcaaaaatttatttacatcataatctcaaaatcaaaatttaaggcattgaaaatataaattaatttgctgtgacaaaataaaatgatgcacaaattagaaaattataatttaaatgaaattttctaaaaataataatattttctttttcctcactaattaggcatgagtaattgatgctttttctgtaagtgccgtctcatatccgatgtctgtctgtcccgctgaattcgaatttccttgccacatttggtgcatttagactgtttggcatttgttcaaaaaaagtccacacttcggatgttcggtgtctagcttaaaattgaatgaattatttaattttttattgaatataaaattaattgagacaatttttaaaaattgtaatctccttcttaattacgtacgtttttttgtatgtggaagatctttttttaaatctaaaaattgaattgaaatttatattaaaataaaaatcggatatttcgtctaaaattagatattattttacgcgataatccaaatttgtccatccatctgtaaatatttgcaaggcttacatcaagaatttttgcaatttcattcacatttttatatttgcgttttccattttcgtcaaattcgttacgcatttcacaaatttggtgaacaatttcaattcgttgttcatcagttctcattttattatattccaatgatttttttctttgaattattaatattttgttaattatttgcgagtttttctcccctttttctgaacattcgtcataaatttcttcaagaaattgatcaatttgcttttgatcagttttgatttgaattgccataatcttatcaccatttgccgatggcaaaacattgctcaaatgagcatcagcagcagaacgattagaggagtcaattagcgaatcattttcagtatttgtccataattttgctgagaatgtcgtcggcatcaagcgaataaaacaaaagaaaatgattaaattcatctgaataaataacatttaattaattttttaagtttatgatttttttttgtatttcgcgaaaaatttatatttaaaattaatatatttataaaaaaaataaataaattgttaaacgaataataaaaattgacattattttttcggagaaaaatacattcattgaattttcaatattatgactaatccattaatgtagcgttcaataactgccaacatttgtcatttttctacaattttcggaacatattttatgcttgtattttttaagaatttttataaaaaaatttttaaatatatcttctaaaagatggatttgtttttcggtggcaaaatgctaatgagtacaattgagtaccgaagtcccggttttttcccggttttcccagcaaaaaattcccggtttttcaacccgaaaaggtcccggtcccgtttatcccaaaattcccggtcccgctcaactctaat

SEQ ID NO: 31950 - DNA, 1277 bp, Heterodera glycines
ggagtacgcctgtaaaaattggggagtttatattcattttagagtgcgctagattcaatgaaacttttaaaaattaagcctaaactttttcgcatatttaaaaaacaattaaaaatttttaaaattttattcacctcacttcttgatagtacaagcatcagagagcattgcttaacatgtaaataaaatttggtttgtttcagagcagtttctgaaaaaatatttatgaattaattttcaaaaaataaataaacagttaaaaactcagaatttctaaaaaaatttaaaatcaattacacaattgtcattttataaaaaaatcgattttttcaagtgtccgtttggagtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatatgtaaaataggttatttctcttcattaaagtatccaggctatagggaagtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaatatttaagaataattttgcaaaaataaataaa

SEQ ID NO: 31951 - DNA, 1448 bp, Heterodera glycines
attgataatagcagcagacaactgttgggacgacgcctttacagacaacccattcggtaatgaccactgtcttttgctcttccacctttgtaatttcagagtgagcaagtcgagaaggcgcgccaggacaaagatgatttccatatggagtctttggactcgcccgcttttaagctcgaagcggatgagtcagacgagtcgggtgattatgtccaaatcaacaagaaaatgcgcgagtcgccatatgttaaagtgcgtccgaagcggtcgcggtaaggacaaattgggaggtggtatatatattttagcaaatttattcaacagtctcaactctccgcgcttggagttttctcgattcatcccgaagagttccctcaaattgtctgtttcgagtcgttccgttttggtgtgtgttttcttagtcagcagtttgacctttttatgtttgcaatgttcagaaaagcccagatgacgctggtccatacgtcaactccccgattactttggattagattgctgatggtttgtttcccaccgtaatatacctaattgtaataaagtgttttttgtttcccaccgtaatatacctaattgtaataaagtgttttttgtttcccaccgtaatatacctaattgtaataaagtgtttatctttttggccttatcgttaacataaactgaatttacttcgccacattttttcttctactcatacaatttgaactaatttttgcataccgttatagaaaattcatcgatttctagattagttttttgaaattaatttgttagtttattagttaaaagaaaaatttcagaacatcgtttttctttgctatattgggtaaactgcttacaattaacatttgcttttgaaaagttctcctcatcatgcgtatttgattttgaaatgggagcctaaaattgagttggtgtttttaagatgtatttttttgacaatgtgtttaatggtcgaaaaaattaattagacgtgagcttttagaatttgtcggtcacctggcaaaacggtctttgaaacggacaacccgggttcgtttcataatctaagtaagttcggacccgtccccaattgtaaagttccaactttgattttgaatttacaaaatatttcttaagaacgaacattttttaaaatttccttgtttgtgttttttccattgctgattttttagcctgtgattttgaattgtcttttcaatgaatggaattggatttggagttccgtccattcaacaattacccgacaatgtcttggagttgattttcacctatgtgtcgccttacgaggattacaattccataaaattggtgtcccggcgatggtattatcttgcgaccgcaacgttgaggcgaatgaatcattttttcaacaaatgcataaacttttcatggtttgttaataagaaattcaaatttcgttcctactt

SEQ ID NO: 31952 - DNA, 2209 bp, Heterodera glycines
aaaaatatttatgaaataaaaaaatcgatttattcaagtgtccgtttggggtactcacgcaattatggggagcaaaaatccaacgcagaattaaagtacagactatagggaagctaatccggaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattcccgaaggattcggtctccccataaatctgagcgcatcggtaggggggacggcccgagaagccaaaaaaaaattttttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatataaaaagcatcagagtgcctaaactaacatgtaaataaaatttggtgcgtttcagagcattttctgaaaaaaatatttatgaattaataccacattgagtattatttttcgaaaattatttttttcatttgatcacccaacattctagactgatcggaagctcaccaaattttgcagggaaactgctgagaaccctacaaatgcttataaattttcttagaattttttgcctggaagaacacagttcttcacacttagcacaccagcattattttttttaattatttttttcattttatcacccaacgttctacactgatcagaagctcaccaaattttgcagggaaactgctgagaaccctacaaatgcttataaattttcttagaattttttgcctggaggaacacagttcttcacacttaccacacaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaatatttatgaattaattatgcaaaaaataaataaataatgaactctcttccttaataattttcctgcaccgaaggtactcactcggccgcttctcggactcgtggtgggcccccgcccccccccccccacgcccttcagagcactacaaatatttcaacaaaaatttttaaaaattgactagagcaatcgaacgctaacggacgacctaatggaaaaaaatcccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgcccaggaaacaaaaaaatcgattttttcaagtgtccgtttgggg

SEQ ID NO: 31953 - DNA, 1548 bp, Heterodera glycines
tcacctcactctctctcttttttcctcgttttctctcttctctcctctctctctctcttccctctttcaacctgcctcctctctctctctctctctcttctccccatctctccctctctccccatcactttttttcacaacactctctccctcttttttctctccattctctctctcccttcctttgtccctctgttcatttaactcactcactttctctcacccttattttcttctttgtccctctctctctaacgtctcaccatctctctttcttttcctttctcttttctccgttctgtctctttctcgcatttccttttcttcttctctccagttcttccttttctttctctctcttattctatctctattttacttttcttctctaccttcacattacatccactcctacacacccatcacaaacataaacaaactcgcacgcattcaaccctgcgggagaccgcacgcgttacctactctacctctcccacccgcgcggacagagaaacaaaatccaattcaaatttgtttcactttttgggtcatctttttgcaccataaattattttatgcattcgccatcaatcataaaattatataaataagacaaattcattgctcttgtttaattattctttttgagttaattatttggcatttttatgttgtggaaaaatcacatttttccaaattaaaatggtgaacactccattttaacgcagttgtaattagggctactatttttaggcacaaaaaatcgcgaaattattttttggggatcagtttttttaaaaaatttttcaattcttaagggtatattttttgaattttttcgggtcgcttcttaggggtgtatttttcatttttacaacatttttgttaagcacttccgaaaatcctgaaaaaggcgctaaaaatggcgaaataggcaaggaaataggcatttagacattaagcataaaaagacgaaaataggcaaaattatgtttaaaaagtaaaattcgattttttttttaaattttattttgtcatcccttttaatcgtgcctcatttcacagctaattacctaagacaaaaattttgattaaatttccgagtgcaattttttttttatataaaatgccatcgtcggtggaactgatgaaacatttgttgagcacgggtgagcattcggatgtgcactttttggtgggggacggagacgcaaaagaggcgagtttaatttaaaataaaaatttaattttatttttcaattgcaatttcattaattatccacgttttttaaaggttttgccagcacatcagcttattttgaagagcgcttccgatgtttttgaggcaatgttccgttttgacgccaaaaaagaaagaccggaaaatggtaaaaaaaaataataattttaagggaaaataccaattatgttatttgttcttcattttgtctctgctaatttccctaattaatactacaataggcacctatctttttttttttctggtagcctacagtacccttttggagcggtgtcgggcgggggggg

SEQ ID NO: 31954 - DNA, 1535 bp, Heterodera glycines
gaggaaattgtgtacattgacattgtgagtttcctttttaattttttttgttcagaaatctgttttgccaaggtgtcactgtacccgttctgcatgaagacgcggccgtttcccatcggcacgccaagtgtgtggaccggtgagcagctgtggcaccagcagcagccacaaacggcaggaggccacccccacactgattgtggtatgtataattatagttttatgatcatgactaatttctgccccctttttctacagctggaccaccaccaccggttctccgaccacccgcactgccatggtgccgaccggaggacaaccccttccgcggcttcctcttctgccgtgtgctgccacccagtgcggacgagctgggcgaccgcgagccgctgctgccctatcgcacacaggcagacggacgactcacgttcggcttgtgcgcacgatgcgcggagctccgacagcagcgtacctgtcgtcacacggagcgtgagcgcgcgtggaccgccgcctacacgcatgtggaagtgaatcgcgcgatgctcctcggctaccgtgtgctgcaggtgcacgaggtgtggcactacgagcagtgggcgtcgccggagagcgggaacgggctgttcagcgactacgtgaacacctttctgcggctgaaggcggaggcgagcggctggccggccggctgtgacgacgagccggcccgggcggagcacgtgcgtcagtttggggagcaggagggcgtccacctacgccgcgacaacattgggcacaacccgggcctgcgacagctggccaaggatttgctcaactccctgtggggcaagatggcggagcggccggagcgcgacgaggtggtatacacggacagtgcgcgtgccttccacgagctgttgatggatgcgcggcaggaggtggtcagcttcacgcacatcaacgagcagctggaccgctgtgtggtgcgcaagcgggagccgtttgcacgggcgccggagcacaacaatctggctgtcgcctgctttgtgacatcacacgcgcggctcaacctgtacgaatggttggaggaggtgcggcgggtaggcggccgagcgctgtactgcgacacggacagcgtgttgtatgtgaggcgactgggtgcggccggtgtgcgggagggcaacgcgttgggcgacatgaagcgggagctgcccggccgccgcatcatcgacttcttcgccgctgggcccaagaactacgggttccagcacgtggacgcgcgcacgggccaggacctgagggcggagcgcaaggtgcgctcctttgagctcacctacgcggcggaccaacagctgcagtacggacggatgcgccagctggtcatcaaccactttggcaggtaatggaggtcatggatacaaaagcacttcacaaccaccaccaccccacttttttaggcccgagcagcgcgccaaccatggtggtgggggcggaggcgacattgcggaggcggccaccaagcagcggaccattgccgtgccctgtcaacgctttgtgcg

SEQ ID NO: 31955 - DNA, 1190 bp, Heterodera glycines
atcccctcacgaaaatctgcagaggcgacctttgcaacccggaagtgagcacgtcatgtccctacccggaggcgagtcacacccgaaatcactacctttaaattggtttccaactgtcaacttcagtattgtcaacggactccgttgggcaatcaccgatgcctttgtccgtcttccttttcgcgcgactcccaaactggcgagtgcgtgtcgtcgcgcgtgccgttgccgcccgcctcgccatgcccggcggggaaaatgctgagtgcacggacaggtgaaaaaaccattattaagcaaaaataattgctgaattctttatgcaaaattaaggcaaatgtttgctgcctggctcctgcgaccccaccgacgcaaattcgtgcgatttgcggaaacgcgagttgtgtttgcgcactacgccgcaacagtcgcagtcgcacccgcaagttcagcaagttcggttgcccacggcaccgccagcgacagaccaatcgtacagaaagaagcaccgcgacacagagacatatgagacaagtaggaaagcagaagaagcagaaaggggctgagggaaagagaaagagagagatagagagggggggggggagacagttcgtattaaaagaaattttcaatttttttttgaacagaatttttctaaaggcctctgatggacttccgattcgaaaatttttctctcggtccatcccccgggggcaattgacaaaagtggacacgcattcactcactcattcagagaacccgataagttacgtgtcctcacaattgcccgattacacgtgccaatgtgtgagcggagagaaacggcatccgatcacaggagtgtgccgtaagaaatgaattgaaatgttgcaaataaaataaatgttatgattgatgttcagttcggaatgaatgtcttcggaaggaggacaacgattgcgacacgcacgcccaatgcattgacacggacgaagggtttttgtgcatttgtctgccggggttcatggacaacagtcaggacaaagtgcagcacacacaagcatggcttaatttgattccatttctctttgcagttgcgtaaaccgggccgtgtctgtacgcctttggtcgacgaatgctcctcgggcattgcgaagtgttcgccccatgcgaaatgcaccgatacgcccgaggggtaacaaattggcatt

SEQ ID NO: 31956 - DNA, 1204 bp, Heterodera glycines
  misc_feature (1166)..(1166): n is a, c, g, or t
ttactggtttgttctgtgactttcatgtgagacctctcgtgtgtcatgcttttgataaaacattagtggtttgttctgtgactttcatgtgagacactaatgtgtgtcatgcttttgaaaaaacattagtggtttgttctgtgaccttagtgtgagacactaatgtgtgtcatgttttgataaaacattagtggtttgttctgtgactttcatgtgagacactaatgtgtgtcatgcttttgaaaaaacattagtggtttgttctgtgaccttagtgtgagacactaatgtgtgtcatgttttgataaaacattagtggtttgttctgtgactttcatgtgagacactaatgtgtgtcatgcttttgataaaacattactggtttgttctgtgactttcatgtgagacactaatgtgtgtcatgcttttgataaaacattagtggtttgttctgtgactttcatgtgagacactaatgtgtgtcatgcttttgaaaaaacattagtggtttgttctgtgaccttagtgtgagacactaatgtgtgtcatgcttttgaaaaaacattagtggtttgttctgtgaccttagtgtgagacactaatgtgtgtcatgcttttgataaaacattagtggtttgttctgtggccaaaaaacaagaagagatgatgaaaatgccaagaatgttgtgccataaggaaatgccacaagaaacaagaagagatgatgaaaatgccaagaatgttgtgccataaggaaatgccacaagaaataagaaaagataagaacaagaagagatgatgaaaatgccaagaatgttgtgccataaggaaatgccacaagaaataagaaaagacgaggaaaatgttcgatgctggtgggttgagtcccagtgattgaaatgttggtgggttgtcccagtgattgaaatgtaggagaattgagtgccagtgattggaatgtaggagaattgagtgccagtgattggaatgctggtgggttgagttccagtgattgaaatgttggtgggttgagtcccagtgattgaaatgttggtgggttgagtcccggcgattggagaaaaagccaagaaaaggatgcgaggccgcgaagcggccgagccagtcgattttatcattcataatcctataatacaatcgtactaccntagcgggggatgcgccgaaggcgctgaccccgctagtt

SEQ ID NO: 31957 - DNA, 950 bp, Heterodera glycines
  misc_feature (905)..(905): n is a, c, g, or t
  misc_feature (907)..(907): n is a, c, g, or t
  misc_feature (911)..(911): n is a, c, g, or t
ttctcaaaaattacatttttaaatgacataatgccatactttaaataaatattagttgaaaattacaaagatttttcaaatttctttgatcttttttaaacttttccaaatgctcattttcaaggacgtccttgcatacaaggacattttttattttcaagaaagagggcccattttcaaggacgtccttgccattcaaggacggataccatccctgatttacattaaaacaatttcattaaaaatattaaatatgaaaaaaaaattaccggatcatgataataattgaaattgacgaaaacctaaaaaaaaaaaaaaaattaatttttaatttataaataaatatttattattgtaaataaattaatttgatgaaaatggttgagtgagttataatgaggaatatccatccaaaatgtgaaaaaataagggataattttctttttcttttttttcaaaatgtgccataaaaaattttttgttgacgcctttaataattggggccagttcttcttcacccatcaataattaatttgtttttaaaaaatctttttttacaatcctccagcctctagagaaacaaaagcatttacatcgatttttaaaacatttaaattttccaaaaatttgccagacattaactcattaataattaatcagtttttaacagtttaatgggaatttaagaaaaaattttgccattgaaagtaatgttaaaactaatataaatatttaaaaattaaaaaatccccaaatttagtttctcccacttttttcggaattcctaattgatgataggtacccaaccaattttttaaaataatggtgatacccaatttttggaaatatttttaaaattcccaatttcattattatattttttaaaaaataattaaaaattcccnanattnggctctcccactttttcaggaattccgaattaataatgg

SEQ ID NO: 31958 - DNA, 1062 bp, Heterodera glycines
acatatactcaaacgccctgaaaatcatttttagagcatatcaactgatgacagtcactgtcattgtttccaaagagatttctattaccagattgccaaaaaaagagatagccatttttttggaccgtccatacctcacatatactcaaacggcccgaaaatcatttttagagcataacaactgatgacagcccctgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacaatatactcaaaacggccgaaaatcatttttagagcataaacaactgatgaccgccactgtcattgtttccaagagaattctattaccgattgccaaaaaa

SEQ ID NO: 31959 - DNA, 1026 bp, Heterodera glycines
  misc_feature (992)..(992): n is a, c, g, or t
gtaaatcgcaattgtttctttctgcagtacaaccacgaatggtccaagggcaaaaaagaggacgataatccttggcgaaattcgcctctcagaatcaacacagcttttctgttactacttgcttcgtttaattatgcaggtttcgccattaggctattcgctcgcgatacaattagccctatagaatcttggagcaaaaactagtaatattttatcctttagaaagcatgcaaaatagttcgttatagacttgtgcaacaactatgaaataattcgctgaaattagtgtcctttcgacaatatgaaattaatttcgtttattttagaaccttaggttctgatgaattaggtaaaattaagttctaatttattattaaaattatgaataagggtcaaaaagcaattaacaggtggtaaatcgcaattgtttctttctgcagtacaaccccgaatggtccaagggcaaaaaagaggacgataatccttggcgaaattcgcctctcagaatcaacgaagcttttctgttactacttgcttcgtttaattatgcaggtttcgccattaggctattcgctcgcgatacaattagcccgatagaatcttggagcaaaaactagtaatattttatcctttagaaagcatgcaaaatagtttgttatagacttgtgcaacaactatgaaataattcgctgaaattagtgtcctttcgacaatatgaaattaatttcgtttattttagaaccttaggttctgatgaattaggtaaaattaagttctaatttattattaaaattatgaataagggtcaaaaagcaattaacaggtggtaaatcgcaattgtttctttctgcagtacaaccccgaatggtccaagggcaaaaaagaggacgataatccttggcgaaattcgcctctcagaatcaacgaagcttttctgtactacttgcttcgtttaattatgcagggttcgccattaggctattcgctcgcgnatacattagccctatagaatcttggagcaaaact

SEQ ID NO: 31960 - DNA, 1058 bp, Heterodera glycines
  misc_feature (928)..(928): n is a, c, g, or t
  misc_feature (985)..(986): n is a, c, g, or t
ttttcattttttctagtctaatctactcaaaccgggttctgaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgngagaagggagtgggaacatgatttcaaaatttttcatttttctagtctaatctactnncaaacggttcagaatttcataaaaaataacattcacggtgcgaaaaatgggggtttgacaagtttattgggg

SEQ ID NO: 31961 - DNA, 1241 bp, Heterodera glycines
aaaaatggacatttgccccactctcttgaaaatatattttaaaatatttttttaccaattttcaacgaattttattcaaagactgtgcatcagcaaaaaagcaattaaaagaaacgcaaaaaaaaaaaaaaaatcacaacgatagacacctatttttttttgttaatgcgtacatcaacagcaaaggcaaatttgatgccaatgaaaacaaaaataataagcaacatttatatatacaaattttaattttaaaaaattaaaaaacttttgaattacttagaacggtgcaaatgggttttgtagggcggcgcaaatgtcgcggcgcaaaagtcgggtcaccgccaccgactaggaaaattggaattttgaaaggaattagtgagaaaaggaatccattttccataatcttttgattttaacataacaaaaaattatttttaaatataaaaaatcgtttcataataatttcctttttaaaaattttgtcccaaattccgcgaatcgcggattcaaaatcccgcggtacggatcgtggatgtggaaaacgacgcggatcgcggtcggctcctcacctgctaccaatcacaagacatcgtccgaaacatccttgttgaattgaacaatgtataccagtggagatgaccagacaatgaaggataaaaggcgccctaatttggatttatgtgtttcaacttaacaaaaaagggaatatggcaacgatttgaaaaaaatgtttgtaactgacggtttttacgatgttaaagggttcatgagctggcttaattatttataattggcgcttgacctaattttcctctattctcgagagaataacccaaaaagcacccataaaaactccgactcctgtgctatttcaatcttcctttaatgcagggctgggatcgtccaaactctctttccaagtacagggatgccattttccaagtagataatgcggaaattttgttaaatccaagtccatttaaaaaattttcaacacataattaaaaaggttaattttaaatgtatccttttaaaatattttttgtttttgctgatcattttcctcatttcgctgcatgtgacttttttttgctgtgcgcttttttcgaaaaaacttttggagaacaaggggggttcagaggtgccgataggcacccgacggtaaattttttgaaaatgaagcaatttttaacagattttgaattaaaaaaataatttattcatgaaaaatgccaaag

SEQ ID NO: 31962 - DNA, 1152 bp, Heterodera glycines
  misc_feature (8)..(9): n is a, c, g, or t
  misc_feature (22)..(22): n is a, c, g, or t
gcctgcannggtcttgaactanagtgaggatcaattaataaaaattctgcacgattataattttgttagtttctgagaatatatccataattgcaaatttgctcttttgtccatattttaacacttttatggattttcatttattctgatttatgtttttcttgtttggcggcgagtccaatctgacaaaataaatatttgagactggcacagtcgatcttttgattggtctttttcgatcgtttttttgttttaatatcgaaagaaaatcagtcgaaataattttaaaatcgaaaatccgaccgaaaaatttagaaataaccaaaaataaaaaaactctcaaatgtccaaaaagtttaaattactttttaaagaaagacttaatttaattgtctagtggctaacaataagcttttagtctaacttatcctttacattttcaagcccatgaataaaaataaaaattttttaaaatttgaattgactcgacgaccgcgaaaagttctttttgggcataattacttatcagaatgcactttaattttaagaatctttctgtcggagcttttcagcatcaccggttttgtcgactattttttgggcccaagggtcagccagcatttgtgaataaagtttcattaattaaaaatttctcaattacaaacaccaatttttcctcgtgaacacccattttatggttatgaagcgtccgtccctccatagaataatttttagtcattatattttaatttgaatgagatgcagctaatggcctggaatattgattatgcttttattgcgtatggcaataaaattgattatttcattaataaaaattattttatttctccattttgcaaaattttcattttatgaaaggaaaaagtaataaaaatattaaaaatgaaatatgttaattttttaaaataaataaaaaatatttgaaaatgaaataatttaagttttgttttagggtgataaatattaatatttttcatgttttataacggaaacttcatcatttttctttttttggtatactgtttatattcatcagtgattttgtgtgaaggggacacttactgactattcattacaaaatgttacttaggaggtttaattttagagtctatggagcatcagcttcgacct

SEQ ID NO: 31963 - DNA, 1420 bp, Heterodera glycines
tagtcggacatcgctctcaagtccgcaacaaatgtagcgttcgagtgttgttgaatacgtttttgattttatgaatttaattttatttgctattttttgtacacaaatgcttttgaaatgatggtgaacacagagaaaacgagttgtgaaacaaaagaaccggcagatcagcaaatttttggttctttttttttgttgcttaaatcatgaaaaaaatgccagaaagtgatggcaacacagcgcactcagccgaaacacagtcggcgcccggcgatttgtctcaaccgtcaaagggttggcgacatcggtcgcaccattgctacactgttggccaccacttacgtcctcatccgcccaaacggctgcagcgtcatgcggaggaaccgtgcgtgagttgtgggcatcgcgcgactgccgcacgagggaatggcggcaactgcacagcaatcagcgaccatcagcaggatgatcacgaaaatcggttaccaatttctcatacatatttaaaagcaaatggctcccattttacctgaaaatttttggcggctctgtgtagccaagtttttttggtttttgactcccattttttgggtagttttggtttggtggaactgttaaaagagggaatggaatgcgatgcaagtataaaaataggaaaacgcttcattttttctcccccgtttctcctttaaataagtcgcaaataaaaaattccaccaacttttggatgtgtttctaaaatttaaccaatcctttgattcagtcaactttccctcccatttataagaattctcttgtcgctccatagttactcagttttttttgttttttagccctttaatgcatcatcgtcaaaagaacggcagcaatggtgggaggagtgcacgctgttctcaaccggcaggtgaacagcaacggcagcagagacaatacgacaaaaggcaactgcgtggccatttgcgtggcacccgaagcaatgggtaattattgtcctattttgccaagtagcgccggtgccggcggataaaattttagtttttttttcaagatttaagtataattactattaataattctcatttgttccaatagctttgcatcgggcccacccttcccgaaccggacgcttgacaaaaaacggagacggcaacattcatgcgattatgaggatgatgaagaagaagacatttgtgatgaccattacccattggatcgtgcaacagtgcagaatgagcgacaaaagcagcaacaatttgcaataattgaacaggtttgttgggggggattaccgtcatttgtggcctgtgcccaaaaaggaacaatttttataaggaattgaggaaaaaaaatttttggcaaggggaggtcaccggcgcggaaaaaggcgcaaaaaaaaaaatcaggaaaaaacaaaacaatt

SEQ ID NO: 31964 - DNA, 1556 bp, Heterodera glycines
  misc_feature (837)..(837): n is a, c, g, or t
aatcggtgccggtcgcgcacacttttggtggagacgctcccacttgaagccaaagtactcgtcgatgaacttggcgttgttatcggtccgtaactggttggtaaaaaacctattaaaagtatcctcatgcatttttgcaccccctttttttgtcaccatttccgggtcgtcacagttcacgcgtacaaggataatttgcagcggtttccgtccgccctcaaagcgcagccaattggcacccgcccggtttggagtgttcagcgtgccgagcacttgccggtgaagaaaggcagccaattcacgctcgctcagtgttttgctaaataacttttcttttaattttctggccgatgcactcgccatccaatggaacatttggacgaaaataaatcccttagaaattatttttctcaaaaatgttaaaaatgaggtatttgtgccatagttccctccgtcccatccttcaatttcgagccaattattccaattggttccaaatgttaatacagaaacgcaatgcctcgtttgacgaacccgttgagtttgtgcagctgcagcttggactcgaacacgacggtcttgggcctctgcttgcgcaactctttgcccaattcgcgcgccttttccgccgcgtcgtcgcccggacaaattttgaccgctttaaaaagttgtgatgcaaaagaccaaagatttgtgagcagatttaactcggttacctcctttcgacttaatggggctgaggagagacaggctcattttcaatttttctgattagacaaataagtgaggcagcgttagacctcgccactttccccttcctgggacacatcccccggntggtgtgagtttgggatgagttataaacaaaaagggatgttcgtgaattctcgctaaagatatcggtgagagtctctgaacatctttcacctccgttcccctccttcgttgtcgtcccttttgtcctttttgtgtccgcgtgcgccttttctgcagcatcacaaattttcaccgctttcgttgtgcgcgaaatgtccgaaattgaagagacactcgccgcaatcggaagtcctggcagaaagtaaaagttaagaaattaaatcgaagatcagctatttagcattttgaaaattttctgatcagcaaatcaaactcaaaaagtcgcgagaaatcaaatgctgctggcgcagttccgcgaaaagatgctctgaaaatgacactatcgagcaaatcccatgaatttgaaatcataattcattgacccaatcattgccttatccgtggcactttttgttaaatcaaccccacaatttgccgctaaccttcgtcctccgttttcgtctctttggcccgttttgtgtccgttttgctgtccatattttgtccaccatccttgttgccgctcaccaacaattccaactccgcacggcgttttcgaattcgattgatcgctcgggtttctttccgacgcttttgtggcatttctaattttattgtaataattgaaaattaaaaaacagccgaaaaaaagagaaatatgtacattgaacataatagag

SEQ ID NO: 31965 - DNA, 557 bp, Heterodera glycines
attcctcaacagtgtttcatttacagctgccagagttttagttggaactaaaaatttaatttcgttataaactccaacatttcattggtgaatgtctaagattcaattccatatggctctaggaaaatccgacactggaaaatccgacactggaaaatccgacactggaaaatccgacacaagcagaaaatccgacacgagaccaacttaaatttaaaaaatatttttgattgtttgagttaatatctggctaagtttatcaagttttcgatttggatttaaaaaaaattaattgattctgcattcgatgggatattgatggcaaataataaaagggttgtcgattgttgcgagtcgcataaatctctgtgagattcatgtcttgcaccacgtacactttcttatgcttcatgccctttcatctgattccatttgccggattgttacaatttttttgagatgatcaaaaagaacattgaaataatatgattattatatgcctaccttaaatctattttatagcaataaaaatatttattttaaataacttaagtatt

SEQ ID NO: 31966 - DNA, 884 bp, Heterodera glycines
ccttggactatagcaccaaacggacggacaatgtacgtgaatcaaagtagaaccgaaattcgtatggaaattttaagtgaaaaatgccaaaatttttcaattggagaagtttgggtagaataaaacatttagaaatatttattaattgttagttttaggagtgtgatgtcagagaggaattgaagaaaaataaggagatgaaaaagttctttgaaagtgtgccggacaagggaccgatcaatccgagggatgcttatgccgagggaagaacgatgccattttgtttgtacgcaaaggctaccgaagaaattgagatatcaatgtttgacatcattagtttgtacccctttgtgaattatggtaaaaatctgcttgcatttttaatattgccattcacttaagacaccccataccccgttggagtcccgaaaattgtaatgagcaggaattttaatgtgaattggacagcacccgacgacgtaccctatgatggacttttgaaagtaaaagtgatcccaccgaaaaatcttttgaccccctcctccccgtgcacatcgatgaaatgctcctcttccctaattgttggtcttgtgcgagaagggccaagaatgaatttgtgatgacaaaagatgtaaagaaatgtaaccatcgtcccacgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaaagtaaaaagtggcgacgtgtaaataagaattactattacttttgcatgtgaaaaatatagcaattgatcattttttgatc

SEQ ID NO: 31967 - DNA, 1782 bp, Heterodera glycines
aaaaaccccaaaaaaaaaaaattttttgggaaaaaaaaaatttttttaaaaagaagcagcctagtaaataatttttaaaaaaatggttttttttttttccctttccagtttcccccgcaaaagtttggggggtcttttgactccagtttttgaaaaaaaaaagtaagacttaaactttttggccctgtttaaaaaaggaattaaaaatttttaaaaattttattcttttcccctttttgatagaaaaaagcatcagagtgcctaaactaacatgtaaataaaatttggtgcgtttcagaaccctttcggaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccttttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccccaataaacttttcaaaccccattttaacgaccgtgaatgttatttttatcgaattctgaaccgttt

SEQ ID NO: 31968 - DNA, 1036 bp, Heterodera glycines
ttcaagcgcaagctagccgagttggaagcgacaaacgtcgcagcgcatcgaatggtggtgccaacccaagcaccgccggtgactgctgccgctgaaggcacatttcgggcattgccggtgatcaaattaataatgaattaatttgtgttaattaaaaaatattaattaattttaaagttacctgcgccagcggatcccgacctgcaatcactgactttcgaagcaagcatggcagttgataaagcactgctaaagtggaaagaaattgacccgcaggtggccaattggctgaacaatttcaaagtgagtttattattttatttattattgttaataaagaaaaagtccgcaaaaggaaattatctatttaaaatcactttggattagcatatccattaaattgaatttgtttttgcagttactaatttgattatagaatttttgatttttttgaattgatgaaatgattaattacctaatatctaattaagttgttgccaaaggctgttgcctacccacaaaagaatttttgccaaatttattttcggaaattaaatgattattttaaaaaatgtttacgaaaaaattattatttttttaataagtttgtattaaataggaaatgctgaaccgtcttgggaatgacgccgacaaatatcgtccaagaaaaccgccgcgtgcaaattaattgttggaaattaatattataaaaagataaattgtgcgtgataattgtatctgataatttgtttacattaatattataaaaaaatgttcataaataagactgaaaagcatcaagaatatgccattcaaaatctatggtttgtctagatttttatcatatgatccgcttcatttcagcattttatataagtttatcgattattttcgtttttattagttcggtttcttcgatttttttccattctccgtgccatgccaatgccaatctttgctttctttgcttcgcttggcttccccccccccccccccgggatccgtcggtgaccgtccgtcccgcttcttctttttt

SEQ ID NO: 31969 - DNA, 1240 bp, Heterodera glycines
ctaatatttaatggtaatcatcatttttgtctactgctgattagtaatgattatctgctgttgagcgaacttaaattagtataattataataatgattgtttatttttgttcattgttaattagggtttaaccacctgttacgtaaaaaatgctcattagtaattgacactgctcattattttaatgatgatatcacttttattttttaattatcctaacaccagttgcaaccattatgattttatcattctctttctcagtttctttaacatgcccattcaatgcgccacgagggcaacttcctaattacaatacaatattaggatgctcgagattctcgaccttgtttctcgagaagaaaaattttgaaaaaaaatctgcaaattttctccgctcctgtcctggcggcctttacaatttactttgaaggaaaacgccggcgggcaacagcactgccaaaaaccctggttttgccaattgaacgccaaccgagatttttttgggatttttaaaaccggaatatttcgttataactttgtttaaaattttcagactttgatcatatttggcctgcctccaatgataataaatgaaggggttattttttgagaaatttttcaagatttttcattgaaaatttttttagttagagccaaaaaatcccgacccagtatgaaatcacaaaaaattaaatgcaattaaaaaaattgtttttttaaaataaatgcttgaaacatttactatctgattaattggcttctcatttcgtatgataaaattgttaagtgtacttggatttcacaaattttcccattatgtacttgaaaattggcatccctgtactcaccaattcttatatggcccatatccgccatgccaattcaatccgccacgaggccaactacctaattattagggccgctcgagattctcggtcttgtcttggtttacagagaaattctcgtctttttggggtctcggtttcgacactcatttgtcaaggtcaattcttctcgagtttcagcaaatatttcctggttttcctacttacttagcgccaatcagtctttttttttttggattttcaaaatctggattttcattatgacgttgcttaaaattatcggttttgagtccgaaaatctcgcatcgatactgaaatcccggttccgggttctaatattaaaaattattaacaatgaaaattcagtgccattttccgaaaaatttgcaatgtaa

SEQ ID NO: 31970 - DNA, 1589 bp, Heterodera glycines
atctcttatattaaaacaattaaagaggttagattgtaaataataattcagtaaaaaaataaaagacgagatcacatgatagaaaatttaaaaattaatcacttaccccattatatattaatatataaaaaataaatttttacctatactaattctttaataaatattctttaaatataaataaaattttataccagaatattcgtatattattcactttaaatttatggcatatttgacgaaaactcgtacaaaatgctgcaacaaaatgcccaaataaaaatgttaagcagcacaacgtaaataaacccaccaacgacgacttagttattacgttggagaattcaagtacaaatcgtaggtataatgatagcagtaaaataaaaaggaatgatgtgatgctttttatttccatcttattttaaattattattagcaaaatttaaaatcaaaatatacaaaatatccaaaattgattctaaattatatattgaaaattaaaaaacaaaatttaatttataatattttttaaatcttttctagatccagaatctagcaaaatgcatttaatttaaaagaaaaatactgaaaagtgcaaataaaatgttcaaagtgaatgaaataattaagaaaaaatttattgatttagcaatcgaaaaaatttctaatttcttttaccaaaaataatccaataaagaattaaattaacaataaagcaaaaataggaaaaccaaacaacttcaagtataaattgacagtatttaaacagtataaaaatattatattgtaaataataaaatactggcaaaatatttcaataaacaatataaataattataagattttattattattaaattaacttattataaatttaacaatatcgatcgattaatagaataaatctttatctttgaagtgtacagaatatgaataattaagaaaccgagcattggtttgtactaaaaattaccaaaaatgaaaaaaatatataagaacataaaaatgcattagtaaatttagtaacaaacaaatgcaataaaatttcaatttaaaatattttgaaaataattacatataatttttaacgtgatgagacatttgcgccgcgccatttgcgccgcacagcaaaagtggacacttgcgccactcagcaaagtcgacacttgcgccgcgccatttacgccgctccatttgcgccgcgacatttgcgccgcctagcaaaatagacatttgcgccgcgcagtcaaaaataatatttttcatttcaatttcactaatatcaataagttttactaaaactataagccaacgacaaaaataactaattgaaaatttgaaaaaattactagtcacaaagattggcattcaattttttaaccattaaaatcttaacattgaataggttcatcaaagttatgaaaaaatgattaagaatatacaaactaacaaaaaactaaaaaaaaaaaaaagaattttctgtagaaaccccaattatttttttgctaaggaaaaagaattaaattcaattcccttgtaattacttgggagggagttattttcatcgattttaatttaatttcattgaa

SEQ ID NO: 31971 - DNA, 1455 bp, Heterodera glycines
tcaaactaatcagaagcgtatgcccaccccgaggtcccgtatccgaatcttctccagctctcgaattctctcctgctccattctctcgcggatctcttcccgcctcgccttcagtctctgctcctgctccgctctctccctctcccgttccaattccctctgccgttcctcctccatctccgcctctcgtcgtctctccaattcttgcctttcgtgttcctttcgttctgcttcttctctttccctccgttcgatttcggctcttcgtcgttcctccttaaaacattcagtagaacaaatattaaatcacgaaaaacacacttcttctcggaggatgcgccgacgccgttccaattcggcctgccctttgtccaaattatccttccgtttgtcttcaaaagttctgaattggccatggcccggtttttgcggcggaggagccgacgggtcgtcctccgtggccatcgtagacggagagactgttttgctccggttgcagaaggaatggagctcatttgggagtttggaaggtaatgcatagccagcctaacaaagaaagtgaaaaaataaattcggactaaaataatatttcacaattgtaaatcgaccaaaaacactgaccttgaccatttcgatcagaaacattgcggtgcaaaactcttcaatgcccaagcacccgtccttgttcacatcagacattgtccagatttgtgccaaaatattcgtcggcaactgactttctccaagcacaccacgagcctgaattaattataactttatttacatttttacaatttttgacaacctgttgccccgtcaaaagtcctactcgacttttgtcgagctgattaaacttctgagaaaaccgcaattttaacggctgtggcaggctccagtcgcccaattcttttattcccatgagaaacgggggtgaagttgcggtcactggtgtttgtgctaagtttttatagcttttttaccaaataaaagaattcaaagtgaagtgacctgctgaaaaacttccgtagggacgatgagaagacgaggccatcgccggcattgagccataagtggacattggacgtggatggcttacggaggacggcaaagccgtcgatggaccaccgccattagacagagaatatgacgacggagttgagggaattggcatgccaccgccaattcgaagcatcgactcgggcagcaccgacggaagtgaaatgccggacaagcaattgagcaccaatttcatagcgattgaaaactcgaatcggtccagtttcccatccttgttgacatcagccaactgccatatctgagaacaaatattagagaatgtgtttcatttccttcaaaatctattctttttttaaatatggaaaatcactttgccgacaaactacccaatttaattaaaaaataaattaatcacactcacctgagccagcatgatag

SEQ ID NO: 31972 - DNA, 1267 bp, Heterodera glycines
aattagagtgccactggaccggtaattttgggcaaacccgggaccgagaccttttcgatttgaaaaaccgggaatttttggctgggaaaaccgggaaaaaccgaaactagtcccggtcccggaccgggaccttggtactcagttgtccgcttccaggtcccggtcccgtggcactctagttataaatggttgtatttgaatggtactgaaattgtttcttacttttttcgactttttcaagaaaataacaaattcatcccccaacttttttagaattctccagccataaatagcaaaaaaatttctaattatttggtgcccgaaaattaatttaaaaaagaaattagcattttccaccttgatcacgtccttgtacgcctccatcagaaattcgtggtcgcatgcgatgcggtagtacagttcgttcagcgactgttgcgcgtcagtcgcctgctcgtacaactcgcgggggaacggcgacggcaacagggcgattggaggcgccacggacacatcgttggagtatttgtacttgtcatccccactgcgtccaacgaggcctgaaatttaaaaaaaaacgcatattaaattaaatttctaaaaatccataattttttattttaattttaaaaaataaaaattggaagcgaattaatattaaattgtgtgaaatatttggtttagtttaattgtaaattcattaattattggaatttacatttattgtccccttttatgaacctgatgttcaatttgatcaaattaaaccaaagaattatccgagttttttggaaaattaatataaaaaataatcaaatactcatgtcacggcatttttgagcattaattcttgtaaaaataaagtatttatcaaaaatagtaaaaattgtagcagaagaccaaaaaagttataagtgccatagtgtagaattttgacaatttaggcatttttaactcgtaatgaaattgagtaatctttgtctggccaaactctgttgatcaaaattcattttggctcttaatgtggtgacaagaattccgtttaaatttcagtttttcagttaattgcatgtcagcatcgcacttaaccaattaggcacgaaatttctattttttgccataaaattgggcatttattggccaaaaaccatatttgtcaaactgccaaaaattggtggcgctttaccattgaatgcgcgtagtcaaccgcgtactcggccaacaatttcagcttcgcatcattgcgcaccgcggccaacgcgtagtc

SEQ ID NO: 31973 - DNA, 1529 bp, Heterodera glycines
  misc_feature (1430)..(1430): n is a, c, g, or t
  misc_feature (1437)..(1437): n is a, c, g, or t
  misc_feature (1455)..(1455): n is a, c, g, or t
  misc_feature (1464)..(1465): n is a, c, g, or t
aatccaattttttaaacacaatgctattacaagaaatgcccaactattctaattaagatttgcttatatgatcttagtcgtgaggaccaaaataaaaccgaaattaaattaacaaaataaaattgaaaaatgaacattttattagacaatagttcccaacaattttgcataattttgaatgaatgttataccgtttttaaatgcattaattcgtccgacattgccaaacttgttaaatttactttggataattttttgataaacattcccattaaaaagattttgcgctgtttttccccgttgtcattcaatgcttcggacagtgccaattcgtcaattttcttgcgaatggcggcaaatgattctttaaattgcgcatttggggcattcatttgactaacattggtaatgtaatcatgcaaaagtattttatgatgaaaataaatggcatcggtgccaatttgtgttaaaagtgattgtgcaattggtcggccctcttcactcaacaatttttggtaattgtgcaccaaattcagctcaaaagcctcttcttaaatgttagaatttggttaatttaggtcaattattttaattagggtttttttcgaccatcggtgagagaaaagccatgagaaaattgcccgataaattttgttgggtatagctggaaaaatttgccgggattggcaacaccttcatcggcgtagaaattttccaaaaaaaaagaaacagaaatttcttaaaaaaagataatagagatttttcttagggcaaatgtttgaacatgggccgaaatactgtttcatttcttcaatttagtttgttataattaaaaattgtctttttacctgtaaataatttttgttcattttttggaatctcaactggtttttgtgataattgtttaaatatttcagtgtttttcaccaaaataagctcaactcgctttggctcaatttcaataactaaaataaatttcataatattttaataataataattttttattattctgatttttacttttcagtttatcaataaacggttggaattgtgtcaattttctgattgctgcttcatgcaaattgaacaaattctctttgatgatcaaatcaaaatcatttgctgatgcttttgttaatagcattttgccattttcaaaaatttcctttttaaatttaattttttcttttacgctttgccactgtttttcctcagtttgccattgttctgtgccttcattgttcttctcctcctgggccccgttcattaatatttccatttcggccatttgatcatccaacttttcctgttgttcggatttcaattggtcaaagttattcatgaacctaaaaattaaattatttattcaaaaattaaataaataaaataatttaccattggtaaatgaccaaaatatcaagaaaatntttggcncttttccgtttgaagtcntctctttcnnccgatagcaattttatgtagctgtaaagaagaagttcaaaaattttttcctcatttaaatctat

SEQ ID NO: 31974 - DNA, 967 bp, Heterodera glycines
cagaatttgaatggccagtcgatatttacactgagcacctgttgaagcgggtgatgcgaagccatagcaaactgtatttttaaattctggccgcaattctaccaaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtctatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatgaccagtctatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtctatatttacactgagcacccgttgaagcgggtgatgcgaagccatagcaaactgtatttttaaattctggccgcaattctaccaaaaacgtgtttagaccgcagta

SEQ ID NO: 31975 - DNA, 1170 bp, Heterodera glycines
aaatttagaaaatcacgcctaaattttattaaattaaattttcattttgttattatagatataaaaacatcaaatttacaaataacaatttaaatgtccaatttctggggcttaaataattcagttcaaaaaagtctgaactcggtactttcagcaaaaacatcgctttggtatgtcctgttataatgtgcaaaaattggttctattggactttaggcgtccaatcagtgactatcccttttcttaagccataactttttttttacttgatcaaagccaacattcttaatatgattttttcgtaataatatttgctcaatttgtatttaataatttccgatactttaagctttagtttgataccaagaatgtaagccgaaaatatgtttaacgagaatccaactttaaatatgttagagtcaatttttacatttatataaaaaaccgtactaaaataacccgggaaattggatatcatttgcagctaatttttatgtaaatacttttgtaacattctgtagaaaaaaattgaccaattcagaatcggttaccttttataccagagacatattggaaaatcaatttccgacattttcggagcttggaattcaggttctcgattagcgcaattttttgagccgtaaaaatttgccgatactaatgtccgatacccttcattttttgttcgtacggtaatacggagaattggtgtcccggcgaaaaataaattaaaaatttttcttttctaaaagtcgttaaaaacatatttatagaggttttcagggtcgctgatcacgaatctgccattaattttgacgaatttcgaatcccggaccaagactcgaacaaaaatccaaattcaaaattcaacttaaaaatcaattttgaattgaattggccaaaactaaggcatattcgtgatcagcgactccgaaaactccagaatgcatgctctcatgtttttctacatgaaatttgttttaaaaaatcaactacttgatgaaaatcatagacaaaatcagattttttagatttctgagctcagatccataatcaacgtatttttagcactagaaaactcgaagaaaatttttaaatttgttttcgccgggacaccaattctccggtattaagcgggtaaaatatatttaaaaaacaaaaaatgaataa

SEQ ID NO: 31976 - DNA, 1236 bp, Heterodera glycines
gttgggcgctcacttttgggcgcgcacggttgggcgccagcatgtttttccactataactttctacaacttttttctttgtcatccaaatccaacattgttggtatgattcgaaagcttaatgtatttagaaactttttctaagctattgcttcgcgattagacaagtatcaaaaaagttatacatgaaaattaagaaaaactcgaaattttaaagttttttcttaataaaaatttttctaggcttgaaaatcttttcgctttttgtagactaatagagcatgttaagagctttcgaatgataccaagattgttggatttggataacatataaaaaagctatattggaaaaacgtgctggcgcccaaccgtgcgcgcccaactgacgggttccgttttttttttttaatttaaatttttgaaaatttcgcttctgttttggtcactcaccgtcttccaggaacagaatgggcaaaatcaatggcaaattgtggcacaaaatcaacaaaatgatggcacaacaacgagagggcggggatggcattcggtgatgcctttggtggcaatgctttggacgaaatgtgcccatcggatgagaggataaactgtgaaatataaataaaaattttttaaaaattaaatattaaaaaattaaattggctgattatgaaattcacattcattttgacaaattccgaattgcttaacccgaattgaaacaaaaacgcgaaatttaaaaaattgaggagtttttaaattaaaaattgcttaaaattaatttaaaatgctttttcaaaaataatttaaaaaaatttgtttaaaaatataaaaaatatattatttaatcccattaaatttaataattgaaatgcttttggaaagtaattaaaaatcaaatattcacatgaattaactattttaaatgcatgtaaattaattgaagaacatttaaaattgaattatttttttatcccttatggaaattattgcaattttaaattaataattaattaatttatcaaagtttcgttttaccgcaattatttcagccaacaatgcttatttgttagacacatgtattattattaattgatgaagacaaaaacaatgttttgtacatttgcgtgagaaaatattgcggcaccgccgcagggcacaaaaaaaggaagcggaaaaagatatttttatttgcctaaaatttaaattatttagtgaaaaattaatattcaagcaaaat

SEQ ID NO: 31977 - DNA, 1674 bp, Heterodera glycines
  misc_feature (131)..(132): n is a, c, g, or t
  misc_feature (143)..(144): n is a, c, g, or t
  misc_feature (160)..(160): n is a, c, g, or t
  misc_feature (178)..(179): n is a, c, g, or t
  misc_feature (188)..(188): n is a, c, g, or t
  misc_feature (190)..(191): n is a, c, g, or t
  misc_feature (198)..(198): n is a, c, g, or t
  misc_feature (200)..(201): n is a, c, g, or t
  misc_feature (208)..(208): n is a, c, g, or t
  misc_feature (210)..(211): n is a, c, g, or t
  misc_feature (217)..(218): n is a, c, g, or t
  misc_feature (1595)..(1595): n is a, c, g, or t
  misc_feature (1600)..(1600): n is a, c, g, or t
  misc_feature (1615)..(1615): n is a, c, g, or t
  misc_feature (1641)..(1641): n is a, c, g, or t
ataaaagtcgacgtatctcagcgggtctaaatcgtacacccactattccaaaggctttcggatcgacttttgcggaccgacattatcgtttttgggcaataaaggtggattctggtgaaaattgaattttnncgacttttgtnntcgagttcgggatttngaaaatgggatgggtcannaattcgtgnannaccccgnannatacccncnntagaanngattttggggcgactatcttatgtaacagtgtttccttttgttgaaaatctttttcgaatgtggtttacaccttctgctttgcattctttcaaattgcgtcatgcatttccatttattcttcggtggtatagaaaaattcccattattataccttaaagaaacatgatgtataaagagaatttgatctagatttttttaccaaattccttcttcaaattgtaaattttattccgcttaattcccaattcattagcaatttcacgttcaattactgatcttttcttctcgtcatatttaaacccacaaattttttcttttctcattttatcaaattttctgatcaattccatttttgtttcttcactttcctccgttttcactcttttttgtcccaattccttcttcaatttataaattgtgtccggatttgtgtcaaactttttggcaatttcacattcaaattgagtatttgtccttttattataaacattttcttttctcaattcattattcctcaaattaaactcgttcacaatttgcatttcatttatttcttctgtattctaaagaaatcctttttaagagaaaaaatttttagaattcagcgaattttttcaaggaatgatattgctttgtctattatattaccaaattattgtaatcctcatcatttccagagttgctctgatcagtagacgagacattctgatcagcttcctcattaaactcattttcatatgattcttcttccaataattccatttcttttcttggcaatttcagttttctatttaaattattattttgttcctccaatgttttttcctttttaatcttttgcaattcttttggctttgtgtcttcaatttcaattttatttgccttttgttggttataaatttcatctttaacaattatttcttcctttattgcatttatttctccgaatttttgttttttgaagttttttgaggtcgatggcttttggtttttccataaatcatcaaataaatcttcatcaattccatcaattagcacgaataaaaatatgaataaaataatcacaaaattaatttgcggcattttttgatgcaaaaaataataataaattttgttttttctgcttatatttgttatattataagtggaatatatgcaaaatctctatttatttttgaaaaatctcaatcaattgcaatctattatatttaatggtaaatagttgattttaaaaatttttatttccctttccgtgtttgtaaatgttaaaaataatttatggaattccaaaaaaataaatatattgaaattaaatgaaatataatcggccaaggaaaagtttattgatcctcgatttatattaaataaaaaattanattanattgggcatcagaanatttgataatggcaccgtcagaattntggacatctaagtcctcttttacagaaataatc

SEQ ID NO: 31978 - DNA, 1290 bp, Heterodera glycines
ttcatggcaccaacataaaattgacagaatcatatatgcatgaacaaattttccgattaaattctagagctaaaggattgtctgtatttaaagcttttgttgatttgttgcattttaattataattttaatgattaatcttgttaaatctaataaaatacacattaaaattgcatgtatgtgtaaattttggtgaaaatttttttcgactttttgttcgaatccgggtccggggttcgaaattggtcgaaatgaatgtcatattcgtgatcagcggccccgaaaacccccggaaatgtattttcaatactttttttttaaattttcaaaaccaacaacttttagactagcgccaacaatttcatgaatttatttgaacaaatttcataaaaaatatctatgtataattttgaaaaatttacaaaatggaaaaaaatgaaaaagaatttcgtaaaatttaaacgaaatgaatttaataacgtaaaggttttgagtttttggcataaaattttgcttttttccaatttagtaattttcccatatttccagtgctttttcgattttcatcgaaaattttacggaatagaccctcaaatttcaaaattttggcgaattgactgcacaaaatttaaaaaattactccatttcaccttaaaaacgccaaaaaaatagtccgtaatacgtatcgtaatttatacggataagtatcagtattacgtacttgatatcgatacggattacgtacttacatactaaaaatacggaaaatccttactacgtaaaaatacgtatcggccgaaaaaaatacgtattacggactacggatccgtaaaagtacgtatacggatctggtccgtatccgatctctagtctgaaatttgaaaaatggaatttttgtgttaaaaattggtgaaaaactcactttggttggcccatcgggcttttgtcgcctttgccattttggttcgtctctgctcccgcttgttctcacgcgtatggcgtgcatttttggtctgtcgcttccgtaataaagttcttttagccattaaatctttaaaaagaataataatttaacttttttatcttataactttttaaaacaacgcggataataaacatagaaatcgatgcagattttttctctatcgatatgcaaaatttggtgcagattgtatggattgaaaaaaagtatatggagagaaggaatggtgtgttttccctataataaaaatatagatagtacgccaaaaggagacaaaaaattagagaaaaaagatactgtttttctctg

SEQ ID NO: 31979 - DNA, 1647 bp, Heterodera glycines
gcttaaaacgaagtgttcgtcccgttctttcaccagtcgctgctgctgctgtctgcttccgtgttctttccaacggtcccaaaaatcgttcgatcccaacaaaagtaaaaaaaagaaaaactctttgtttgtgtctctgtttctctgaattgcctttctccctcacacactctcttttcatatcttttcccccctctcctctctctgctgttctttcctttttctcatttatcttcgtctctcttgtattccatgtgctctctctcttatctcttccataatctcgtctctctctctctcggtttttctcgacattttttgcgccgttttttttttgtctgcccctctcacactctctcgtgttgcccaactatttccccgctcgcataatcgctttgataaatgtgaatgaaatgcgaattcgtaaatgtgtgtgagtgagtgacttggtttgcttgctcaaacacacactcttttcatgttccaccaccacagacacacacacccaacaccaacacaacatcatcgacggacggacgacaaatgggggaagtcgtcggcgaggcgggggggggggggaagagcgaagattaaaattaaaataaagaaaaaagggggaaaaggaaaatggaaggggaagaaaaagaataaaacttagggattgaagagagagagagttggaagagggggaaagacgaattgtaagcatgccgaaaccgaagtcagaatcgctgtaaacaaagaaagcaaaaacaattcgaccgttcacttgggaaaaaacaaccgtctttagcttacattaatgaatagtcctgaaagttcacatctccgaaaaataataaaagaaaattttagtgcgtgcttttgttcattctcccgctccttaaaaaggaatgtttaaatttgttgaacagaaaatgaaagcatttggtctgtgtttatgtgccagggaaataacaataaaaagaccaaagtgttgtggttgcttgcctaaatcgtatttcctcttcaccactcattccttttcaacgacagcgattggttcagggtcgggatcagtgttgtagggaaaatagctgtaacaaccgaagaaagcggcgacaaagcggacgaaggcgttcgacacggggcgaagttcacggccagtgccatgctaaaatggggcaggggacaatcatcaggcagggacggtcccaggtcttgcaggaggtaccagcaaaaaaaaaaatcataaagttttgagcaaaaatataattttgggtgtccaggggtcttggggggggggggaaggagagactgggaccatccctgaaatcagttggggatttctctaaacgttactcgtacaaaaaatttacataagtgtaccagcgatgagacatgacactgatgaccgccaaaatgccaacaaaaatgcccggataaaaaagaacagtgaaaatggtgccgcgagtaaatgccgcacgcctcgaaaccgactcacgctcatactcctgtgaaaacgaccattttaaaagaatgagaccattattggcaataaaaaatttgccgcggcacctatcgtcaccgccggctcctaaaaattcttgtctttaaaaattggcttaaccgcaaaatttatcattttgtggacaaaagcatgcatac

SEQ ID NO: 31980 - DNA, 1556 bp, Heterodera glycines
ttttttttcggttttttttggtatttttcaattttcggtttcggtttttaaccgaaaaaaaccgaccgagaaatttttgagtttttcggtttttttcggttttttaaccgaaaccgttcgaccgaaataattaaaaaaccgaaacaatcgaccgacttttttgacaaatcagtttgccattttttaacaaaattcattaaaaattcttaaaattttcctccggcggcgcctatcggcaccgccgaccccccaaaaagctatcttttcttaaaaaattagtccaaaatttggtatttttagacaaaatctgctaacaaatagcattaaaattacaaaaaaatttcccggcggcgcctttcggcaccgccggccctaaagttatggctagagctggcaattaaggcaccaaaaagcgcaaaatggcactgaaaaaaagcacaaaaatcccgaaaaaggcacgaaaaaaggcatttaaatttttttttttattaatgatttttagggagcaaaacacgtaaaactaattcaaaaaactaaattttgggcgctggcgtttaggcgcggccgtttgggcgccagcatgtttttcaactataacttttttctatgtcatccaaatccaacatttttggtaacattcgaaatcttaatatgtttataggccagcgcccaaacgcgtgggtccagaaaaaaaagaattttggcgaacaatttttgtgaaaatttttcaattcataaaggtatattctctgaatttttttagatcatttcttaggggtgtatttttcagatttttttgaatttttaatggaatttttcgggaaaaaacgccaaaaaagacaccaaatcgctaaaactaatctttgtggtttttttagaatcaaggagcaaacacatgttttttggctgccttttctatcattttccaaacctcttagtacaccattcaatagagtttcaatagctctacaattttactcagaggtgatctttcgctttttctattaatagatagtttattgcttttttgaaaaaaataaacaaattcaaaaaaaccgaaaccgaaaaatcgaaataaaccgaaaaattttcttcggttttttcgatttcggtttttttcggtttttaaccgaaaccgttcgattcagatgaaaattcaaaatgaatttttttttttcacaaataaagggttcgccaattttttgagatttaaaacaagttcttttggaggatatcaatggccaaaattcggccaccatttgccagtctcgagactgtttctgctttttctcgacccaaatttgagtgaaatgggcaatggcactttttgcttctcctttgctcccccccccttcccctgtcaggcgattcgtgctgcaacccgtacagcatgggcttcatccgcaaattgattctcaccaatatgccccatgcttatgtgctttcgctgcagttgggctcctcagttgccgaggacattggccgcggctatttcgccaatatgaacgacgaagtggcggccgtgtgccaacagttggccgaggacgcgcgacttg

SEQ ID NO: 31981 - DNA, 1010 bp, Heterodera glycines
  misc_feature (1002)..(1002): n is a, c, g, or t
aaaaatggtatctcttttttctcatttttttaccgcaaacttggtaccaacagttgccttcttttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatgtctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatgtctatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaacttggtacaaacagttgccttctcttgtctggccctatcaaacatcttttttctcatttttttaccgcaaacttggtaccaacagttgccttcttttgtctggccctatcaaacaatcttacgatatttgaaacgcaaacaaaaaaaattcttgaccaaaaaatggctatctcttttttctcatttttttaccgcaaacttgngtaccaac

SEQ ID NO: 31982 - DNA, 956 bp, Heterodera glycines
gggtattattttgtaaagtctttttttcaaaataaactttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtagtctttttttccccaataaacttttcaaaccccatttttcgcaccgtgaatgttatttttatcgaattctgaaccgttttgagtagattagactagaaaaaattgaaaattttgaaatcatgtttcccactcccttctccccagg

SEQ ID NO: 31983 - DNA, 1281 bp, Heterodera glycines
  misc_feature (161)..(161): n is a, c, g, or t
  misc_feature (167)..(167): n is a, c, g, or t
aaaaaaaaattatttttttgattcatttttattaataaaaaaatatttttttttgaaaaacgcaacatttttactgggttttttttaaatcattaattttttctaaacaatcccaaaaattcgaaaataaaaatttcggtttttttaatgtccccatttcnccgtcncaggtggacacaatgcggcagaagaagctgaaggtgtggattttcccggagggcacgcgcaaccgcaatggccacgggctgctcccgttcaagaagggcgccttcaacgtagcggtccgtgcccatttccccattgtgccggtggtcatctccgactacagcccgttctattcccatcggggcaaatatttccacaccggcggccgtgtcattgtccaagtgatggagccgatcagcactgaaaatgtaaaaaaaaacaatttttttggctgagcaaaattttaattgtgagattttttcattggaaaacccttcaattaactatttttgatttgaattatgaataaattcatgttcagtttgaccatgatgatgtgccaaagctgtgcgacgaagtgtctgaaaaaatggtcaaagtgtacgaggcgatcagtgcggaggtccgaacggcgtcaaaagaagcggcgcattgatcgaagcgggagagcgagaaagactgggtggaaaaaggagagaatacagacaacgaaagagtattgggaaagaatggcacggcacagacaaatcgcatttctgatcggggagaaggaagagaaggaggaggaggagggacaaagcgaaaatgagagagacaaaaaatgctcaacaaaatcacttaaatgctctccattgctttcttttttaattctctcataaattgtccagactttaatcgtcttcgttttcttttttaccattctcatattaatgccatacaaagaaagcacgagttttttgaaaatgtgctttttttgcattttccctccgcccctccattttaaaatggtttttttaaatttatttgtcgtaatggctttaccgaaaagcttcttgatattatggatatggctataaaaataaaagcaaaattcgatttaagcagttccaaaagccacagaaaattgctctgtttctgtgaaaacagtttccaagcaattttcataaaatctgagacaaaaaaaaccattaaaaagcggtttttacatggggcttgagtgtgccttccttcgagaaaatccatggcgctatgcccttgctcagaccaatttacactaataattattattatttctca

SEQ ID NO: 31984 - DNA, 1001 bp, Heterodera glycines
  misc_feature (38)..(38): n is a, c, g, or t
atttaccgttactgttgtcagtattcaaaaaaaaaacncgggaaaaccagaaagtttaccgttactaccagaaaatcgctcatttgctgaacactataaatcgttgttcatacatgtaaaatgtgaaaatctaagtttcataatctcaaaatgatgttttttgtttatgaatcaagcccccttcaaaaagggggctggctctattcgaggggggggggttctttctattcgaggaaatgcggtaatttgaagtaatttttaatcgaatcaaaaccatcaaatcgtgaaaaacaaccaaatccgaaaatttcaaaatttattgtacctggaaaagtttgttccatgaagcaacaactgaaatttgacctaaaatttgaaagcattatgtcaaatattcatacatttgttcttaaaattttcgccatattcctcttttatttcgggtttcattttttgccatgctctgtccacccgtgccgtcattgcatcggcatttatctgatttttttaaagaaacaaattagaaatgccaatttgtcattttgtaggtcgcgtaacctgtaaattaagaacgacaatttcaataaatcctattttttgaatattccttattttaattttggaatatagccaagtgtgcgatttatggcattaatgttcatcattaataaggagaaattaccaatttggtgcggaacatgcctgaagaaaagcgaattgatattagccaaacccgaaaaatggcaagaaggacctggctccaatatgctacagccgattccccaacattgcagctcaagcctgtgcgttacagaaaattgagtgaccactaaattcttacataatcttgctacctgatcgcatccatgtatgcttcaaccttaaaaaaaattttatatttaaacgatgccgagaataggcttttttgttggaaaaacaattttttaatagttttgtagaaaatctttaaaaataagaatagttaggaaatttccaaggag

SEQ ID NO: 31985 - DNA, 1011 bp, Heterodera glycines
  misc_feature (872)..(872): n is a, c, g, or t
  misc_feature (979)..(979): n is a, c, g, or t
aacattcgctagtctttgagagttttatgtaacaatttataactgtcaaattaacatgaaaattcactatttaaactcggcaaattgcgttcttcgccccattccttcgacattcattccgctcgtttctctttttcccttcaattcttcttaaatcgccttcctttgtcgcttttccaatattttttttaactaataaattttattacatataagtttttgtgaaaatttttgaaaatttattgggattgttaactgatgttgcccaaaataaatttatttggagcgaattttttaaagaaaattaatgattttaattaaatggggtcatccttgaaatttaacttttttgttgtctttcgcacaatgttggcagtgggctttgttcaaagaaaattccaggaatagtggaacgggccggaggtgccattaggcgccgttggggaaatttttgaaaattttactcgattacttagcaaaatttgctcaaaaaatgaccaagtttatatatgaaaacaataattaagtctgaaatttcaattttatccagtctaaatatcacggaaaaccgtgaattgaccccgtgaatagtgaccgtgacagaaaaaaccgtgaaattcaggtaaccatgacagtgattccgtgaatcatggcacaaaataagcaaatcagcatgaaaatgaccattttgtggcacttaagcgttcaatcgaagactatccaaattttcttagtacatgactttttgggtattactgatcaccgattcagcacccatcccgatcaaattcggacccctagtccgaattcaaacagtcaaaaactttgggacacaaattcaaaaaaatgggtttttaaccggttttctgcgngatgtgcttgaaaaaagctgaaccagcgacgcattggcgtgcagtggctttcacaaagtgaaaaaatgtcgctcctcctccattctttttttgattcctttttttgntttaagttgaatatgagtagtgcaacatttaa

SEQ ID NO: 31986 - DNA, 1279 bp, Heterodera glycines
  misc_feature (29)..(29): n is a, c, g, or t
atcaagccatcatacttttcagccatcgntggacacacaatatggcaaaaaaaaaattatttaaattttcttaattttccaaaactattttaggaaataaattaattacagttttttaatatcatttattttaaataatattcagacgtttctccaagtgatcgtcataagtttgtttaattcaattgcctgcgtaatttacgtctcaatgcaacttgtaagaatcagtaaaacctacatcatcgttggcacttatgcatggcttttttcgcatggtaagtcaaaaatttaagccatgaatttgacaactttgtaaataaattttgtaggatttttaattgaaattttgctatctttaaattaaatcattagtttcatactgtataaacaaagatatcaaattattttaatttctaatatgtgggttatgtttggaattgaaaaaatttgaggaatctagtaattttttggtgcttgaaaatgcgtaaattaattaaataatgaatttcatatttattaaatggtatattctctatatttaaaaaatacaaaaataatttttcaaaaggttgtcctcccctggtgtatttgctgctgaacaaacgaattcgaaatgattgtgccaactttggccgtgccattttccgttttttgcacaattgcaacaacaattcggtgtcaaatggaccaattgccatggcatggacggcaccaaattatgccgtgaacaatgtcaacaggaataataataataatatgccacaacgatgaagaccagccgaaagtttttgtgggaccaattcctcagggataaattccctaaaatccagaacattgccgtttttgatactatccattgctgatttattcaagcgggtttttgggaggaggtatgcaatatattttattgtaaaattttttaattttaaatagtatttttaaattcagctttgtgctatgccgaaacaagtgccgaaatgttgttggcaattaaccgatgcatggaattgttgagaccacagttggcacatgccattttcagtggtaaagttttatcttatacagcatttcattgataataattatatttaaatacaattatttatttaataaatcatttaatttgttcaaattccgcttaatctttcgggttatatgaaaaaaatttttcaaatattttcaaggcaataaattgcgatgtttatttgctctgccaatttgttatggctttgcagttgccatgttcactaagccaattctgttcagtgatgtttatttg

SEQ ID NO: 31987 - DNA, 958 bp, Heterodera glycines
tttggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaataatcgattttttcaagtgtccgtttggggtactcaaacaattatggggagcaaaaatccaacgcagaattaaagtacaggctatagtgaagctattccggaaaggattcggtctccccataaatctgtgcgcatcggtttcagggggactgccccgaa

SEQ ID NO: 31988 - DNA, 1458 bp, Heterodera glycines
aaaaagcggagtaggggcagggaatagagcacatgttaaggcaggaggacagagcaatggtcagaggggaagggatacctctaaagtgggggattagagaaaaacggataaaatggagggaggaaaaaatttaaaattggagggacacgcaatggagggtaggggaattaaagccaaaccaattaatggtaggatttaatagggaaaacaaaccaaagaaggacatgtttttcattcattacggttttaattttgaaaaattaaaagcgtatgttaaacatttagaaataatggccacctgaagggtcaacttgttgacaatgctgagacctgaattctgaaaacggttctcgtccattccgtgaaacaccggcagaagaagaccaacccgaacttgaagtccaccagaggaagcaaatgaaacaaatacgggccccaaagagcacatcgttgcgcaacagctgcagtttactcgctgcgaatttggacatgagcaacaaacagctcatgggaccgacccgccgtttgactgctgctgaaattgaacagaaattagcaaaggcaaagagaaacacagaaaaacaaaacaaaactcggtttaaatatttacacatggaaatgcaacaactgacaaatgacaagagaatgaatgagtgatgcgatccttccatttccatttgccacaaccaaaaaggcaaaaggccaacatgacatatttgaatttgttaactaataccttatcagtagggctgggattttgagcaattcccgtgttttttgagtctatgtttcgactctcggggtcaaatatcgtatacagcgtggctagtgaataaaattaccaagtttaatcattttgtaataaatgttaaaactgttgttgaatttactaccgtagtcatttacatttaataaagacaaaaaaagagtaaatcaattgcataagaaatcaaagaacagccaacaaaatcagcaaataaacgtgtaacggtaaaggaggcattattcagtcgattgttcagccagccgtacaacggcccaacaggcaaaagccgggatggcaattcgctcggttacagtctcgcttggaacgagccaaaagccgactggaaaatcaaaatattaaattcaactattaatttcactctgatcagtcttttttgattttttgagtctttcactgatcacaaagcactgattggtccgtttcgaattcaaatccttcgtttgctttgctttttcactgatcaccaactttctccgcccaatgttttctgtcccatcggtcgctgtgaacgaagcgaaggcaattgtcagcagcagaagcagaaatgttgtgagaattgacaacttcatccttcgatttgttaattataatagctcattagcataattaaatgtgcattgatttggtgtgattgcaatacaaatggtaaaaagcaattcgtccttatttat

SEQ ID NO: 31989 - DNA, 1805 bp, Heterodera glycines
  misc_feature (1681)..(1681): n is a, c, g, or t
  misc_feature (1749)..(1749): n is a, c, g, or t
  misc_feature (1787)..(1787): n is a, c, g, or t
ggatgcaattcccgcccaaatgttgtacagtatgccaccagtcgatgaaatgtcattctgttggagttctgtatgaatacgcggacaaatttgttccaaatttcaacaaatacaagcaaatatttttgcttgttttctttttctgtactcgttgtaataaaattgaaaattttcgtaaaaattgccataattttggcaaaatacaaacgaattgacagccgattctcagcatcggacgaaacggttggatttgtgcaaaacaatatggcgtaatccaatgccaattgtttgtcgcagaaaatatctatccgagggaattggggtaagtaaaattaattacctaattaaccttgtcgatttaatggttcccaaaatttatataaaataagttaaattaaacaaataaaaaaatgttttaatactctaaagatagttaataatggagaaaattaccctaaaaaatcatattttattatacaaatgacaattgccaaatttttgaatattttataaattagtaatttctataaattttatgaatatttaagtttagagatatttaagattattttacaatgataatttaatacctaatgagaatatcaaaggattttcaaactccaagagaagtaataattgcatgccaactaatttaccaagagcaattttcgtcttaattaattgttcacactttccattcaaacggcatttatttcccacaattcgcaaaacactcactaattttgtctcacttttgaccatttgatctccataaaattccataaaattccttaattattttttttgcttggcactttctttttgaatttattttaaaaatataattcgtataaaacaaaaaaaaatgtatttaccaaaattgcacaatattctgactcatctgctgctgattctttgaaaattggtgacaatggccattttcacaagtcaatggtttcattaacgttccaattatgtaaaaatgggcaaattcgcaatcttttttaatttctattaggaaatttttcattttttgttcttcaaaagttgtcattttatcagggttttttatttgtttagtaatttcactgcattcaatcttatcattgtccattttagtgaagagttgctcatatattttattgtgtcgttcgattggatacttttgattctctataaaaaattgctttaaaactaatttttattattaataaaagtttaaaaatcatttttattgttaaaattagagcccggaaatttcaaatttggattgcggactgggatcctgcaaaatcctgcgcaagatccggtcctgttccgggctctagttaaaatatcatgtttaactgtatgtggtgattaaatcgcgccaacatttccaaatttggcaatgtgtctcttcatcaattgtttctaattgttttgtcattgcacgaaatttgcctattttttgccgatagatttttgtttgcgattcatttaattcttttaatttaacggcatcaaataaatccgttataaatgatataaaaatagccgtttcaattgtcattttataatgctcatccaaaatgctttctgaccattcataatttcctccgtgtttctcttcttccaatgataattttaataataacatataattttcatcaaattgataagtgtcagtttttatcactanagtttttgtttaaaaattatatttcattaatgagaaaaactaagtcaaagaataaaatatatttctanaagattccatatttatttaaaaccctaaaactattttncatttacttacttgattg

SEQ ID NO: 31990 - DNA, 901 bp, Heterodera glycines
cctaatccagaaaaaatcactatctctttttttggatatccacgtgtcaaagggtgtgcatttaagcgactcgctgtgcttgcccactgcatttcaaatagctggtaatttttatttctccggcctaatccagaaaaaatcactatctctttttttttggaatattttacgtgtcaaagggtgtgcatttaagcgactcgctgtgcttgcccactgcatttcaaatagctggtaatttttatttctccagcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaataggtggtaatttttatttctccggcctaatccagaaaaaatcactatatc

SEQ ID NO: 31991 - DNA, 642 bp, Heterodera glycines
caccaccaaacacttccatccctcttctcattcaacccacagcaatgaaattggccaactcttttcacttcttggcaatggcacgtgagaagcgacgggacaaaacaaagggactgacggaggggggggggggggggtaatgcgattaattttccacgcagagaatatgtgacacaacaaatgcgttggagaaagtgagaagggaaagacgagaacaaataggcagaaagcaggcaaagttgggagggggaaattggagaaggcacttggaaatgccatcgccgacgccgttccgccgctttctcgcagaacagacgaacgacgcggagaaaaacattgtactcatttctggaacatatataataaaacaatattaagcgagtgattgttgaacagttctaaggaaatttattttttaaatttagatggcacggcaatgccaatttgtaaatttgatgaatttataaaaagataggacctggctataaaaatgaaaatgtttaaacagagaaataacaatttatattttgtagaagtataaaaaaaattaaataaataatattttatgaattcaatgaacgatttagaaatcgcgattgaaaaatctgggcggaggttgccgctgattttgggaagacctcg

SEQ ID NO: 31992 - DNA, 1201 bp, Heterodera glycines
  misc_feature (16)..(16): n is a, c, g, or t
  misc_feature (40)..(40): n is a, c, g, or t
  misc_feature (107)..(107): n is a, c, g, or t
  misc_feature (114)..(114): n is a, c, g, or t
  misc_feature (122)..(122): n is a, c, g, or t
  misc_feature (149)..(149): n is a, c, g, or t
  misc_feature (170)..(170): n is a, c, g, or t
aatttcatcaaatgcnttttaatttcatcaaatgcctttnaatttcatcaatgcccttttaaatttcatcaaatgccttttaaatttcatcaaatgcctgttaaatntcatcanatgccttntaaatttcatcaaatgccttttaaatntcatcaaatgccttttaaatntcatcaaatgccttttaaatttcatcaaatgccttttaaatttcatcaaatgcctttttaatttcatcaaatgccttttaaatttcatcaaatgccttttaaatttcatcaaatgccttttaaatttcatcgaatgccctttaaatttcatcaaatgccttttaaatcatcaaatgccttttaaatttcatcaaatgccttttaaatttcatcaaatgccttttaaatttcatcaaatgccttttaaatttcatcaaatgctttttaaatttcatcaaatgccttttaaatttcatcaaatgccttttaaatttcatcaaatgccttttaaatttcatcaaatgccttttaaatttcatcaaatgccttttaaatttcatcaaatgccttttaaatttcatcaaatgccttttaaatttcatcaaatgctttttaaatttcatcaaatgccttttaaatttcatcaaatgccttttaaatttcatcaaatgccttttaaatttcatcaaatgccttttaaatttcatcaaatgccttttaaatttcatcaaatgctttttaaatttcatcaaatgccttttaaatttcatcaaatgccttttgttgtagttctttcatttctgatttaattcgactaattagagcatttaatattaaaattaaacagaataaaagtaataaattcatttttcaaagtattctcgaaatgtatttttttaataatatcgaaaacgattaaattttacttatccaaatctataataaattcttaattcttttttaattgtgaataaatggaaaatgaaattgaattttttttaacaaataaaacaaatttacttggttttctgctttaagaatctttaaattattctttttttttaatttatttcgaaattgcatatggaaagccaaatttggagaccgaattttatttaaaaaacaattggattttctcatgaaaacattgcttgcaaatttccagaaaatttcatttagtgacaaattttacttgaattactttgttgtaa

SEQ ID NO: 31993 - DNA, 1005 bp, Heterodera glycines
tacttatttgctttattttggaaacgatagatggtgcgacgttttatggcggaatcgggacaacggtcgattctttttgtgttctcagttcgtaattcgggtgccggattagccagtttttcaaaaattaactataacaaattttatcttcattttcagccaacattttaaaaaattgatttaaaaaaatgagcacaggtagcaaaaaacagaacacaatgaaagaaataaatatataaataaatacatattaggactgtaacctgaggtaggggaatttaaaaaatggcaattttcgcacttcaccactgttgtgcaatagaataaaggtctcgtttacagatgtccgggcccctgtaaacgggaccttattctacttgtgcattttttaaaaagggtgacgaacaattcttatttcccatcgagttttttctggttacagtccaattttttacaatctgttcttttctctgatcaccaccgttcattgacaataagatgacttaagggggaaaaagataacaagtatatacagaataaaagaaaattcagtttattaaaaccctggcggggggggcactaaattgactcactgaaaaaggaaaattttttttaattgggtgcttgaaatcatttttttggatgggggggtaattaattactagggattctttttttatgtaagaaaaatcgcgaaatatgtaaaaatgctaaaatatgagattttttaaatttttcaaaagaaattttttataaattctcaaaaattcccaaaatatgtaaaaaaatatatgttcgaaaaaattgcgaaatatgtactaaaaagtccaaaatatgtataaaaatatgtacatatttaatatgtagaaaaatcccaaaatatgtaaataaaagtcccaacttttgttcgcaaacacaaaaagaaagtgtttttcctgctatttagagcatggagaaaccaggaaaaaatatgtatttacataaaaatggcagccctattaatta

SEQ ID NO: 31994 - DNA, 1311 bp, Heterodera glycines
cggaaaagattcgagcctataaatgaaagaactaataccaatcgtgggagattattggtcccgaaaaaatctccaccattaccctaaattcctttacttctctgttagatagcatgagttaaagacaaaattcattaccatagaaattaataggtaatggtcaagttgtcccttaattacggggagggaggttggacatcactaatcacgaatctgacctcctttttggttaattctaattaagaacaaaaatccataaatctttttataaagttttcaatgggagggtgttgcaattcgactatttcaacaaattagctgctcattgtcagaaatggttatgtccttcttctgttacattttcatatattgcgtacagaaaatggaaagtaccccaaattatagaccggacaaattgcactcatcgaaaaatgctaaatacaatatatggattgtcttctaaagatacttataaattaagttatttagtggaagacaacctccttttgctttttcaacggcagattgcgtgtgcatctgatgaacctgacgaacggcgggaaaaaatgacagccgcatacagtcgcatttcgttaattgtaaaataaattgtttagaaagcattttttttcttaagcaaaattgggtgtaacaacagtctcgaaaaaaaaatttgttttatcttccaaaatcgattcaaatggatggaatgaatttctctggcgtaagcgatttggcgatgatgctttttttcatttgtgggatcaagttcgtctcatttacccatgtgaatagttttcttcttttctcatgtcttcaacacatttgtattgccattccatccatttgaatcgattttggaagataaatgtgaattttgttgaaaaatgaaattttgactttttcttcgaattcaggtccggggttcgaaattggtcgaaatgaatgtcatattcgtgatcagcgaccccgaaaacctcaggaaagacgttttgatgaatttcaaaaaaaaattatttttttttaaaaaaaggggagggacaaaccctactattaccaaaattttaaatacctggatttttccgcaaaacttcaattcgttttggctaaactttttgtagccaaaaaggatcctttttaagcgctaattgaaaaattcactgatcattagggcagcaacttttagtgacgaaaaatcccgaaatagttaactaaaatagtgagtaaaaatcccaaaatagtgacaaaaagtccaaaatagtgacgaataatgacataattttcagccaaaaaacaagccaaaattatttt

SEQ ID NO: 31995 - DNA, 1399 bp, Heterodera glycines
cagagataagtgaatttttgtcggctttcttggaatttcacccagtgattggataaatacatatatttgttgctttttacacgattagtgcacggagttgtagacaaacttaaaaatgaaccatttttaatacaattatttagagaccggagattggtgaccacaacgcagatctcagacagcggtgcctcaaatcactcgaagagaacgcaaccttcgaacaacttttggccgagtgtaagcagatcattggccttcgccacagcactgcagctttggctcgtggaaaggagttcaatgctgtgcagctgcgcccgcaaattttgaaggacaaaccgagggtcagcaaatcaccaataagaacacgaacattttcgaccaacacgcggcacaacagcacttcatcaccatcacaaccaccatcggcttgtacgagatgcggcggtaatcactggaactcggactgccgtttccaaagggaagtgatttgcaataaatgcggcagaaaagggcatattgcgaaaatttgccataatcagaacaacactccccaacattcaggctttaaatattcccgcacaggctcaaataagcaaaatgccaacatcatcgactgcctgcacatcatgccatccgactggaagacggaaaatgaaccgtacattgagcggcatgttcggctcaatggaaaagtgcacaaaatggtagtcgactccggctcaaaattgagaatcgtgagaaagctcatttgggtcaaattgggccaaccgtttctcacagaaacaaagctcaagggtcgttcattcacagggaacattttcacatttatggggaagttcaaggtccaagcagcattggacgatggaatgcccctcgatttggaatgttttgtcatcgattcgacggacacacttgacttgatgggacttccatggataagagcatttgaacgcgcctacaaccaagtggtggcgacaactttgtcaatcgaaaatgtgccgacagtcgttggtgcaaccgatcaaacagcacgtcgacgcaattggagatggatttacagaacacatttccaaacatttttgaggaaacattgggactttgcaccaaaatcagggcccatctcaaaattaaagaaaattcatctcccgttttttgtgcagcacgaccaattcccatcggcgttaagcaagaagtggacaaggaattagaccgtctcatcgatatgggcgtcctgaaaaagaccgattgtgcttcgatttcagcacaggactaaatgccgcattggaaccacaccaccatccactgccacgacctgaacaactttttgcgcagctctccggcgctgaagtgttttcgcaaatcgatttcaaagacgcatacttgcagatcgctgttgatg

SEQ ID NO: 31996 - DNA, 1094 bp, Heterodera glycines
gaaattttgtatgtgaatccttcacagttcgttcttaacaaaagtgttttcattttctgccaaattattcccagtgccgagttatgacgtgcttgctcttgagtctttaaaattttcggtctcgaacttcattagtggtgtgaagggtagtgctgcgttcacaatttttagggtcacagtgaaatttaatttattttaaatatgtaaaaccattgggaacgatcttttagctgctgaggaagacatattttgattgaataattccattcgcattggggagggaggcgactaaaaaaataaaattttttattttattttcattaattttgaattcctttttttgtacttttatatctgtggcttttaaaggctgggattccatgagctaaagcaaaaagcatccatcacagattaccatttcgtgaaattacgatgttgttttccttagaacttgtggggttctcaaaagagagtcagcggaagaattggcactaccaaatgcatcaatggcattttcttaaacaattttttttctcttttcgatgacacaaaaggcagttatggaaaaaatctaggaaaatatagacaaaaattgtttagctgccattcgactctttctatttcttctaaacagatacgaagtgatataaccgactcatttgcttgtggcaaatttaaaagttcattttgaagtgcttcttttatcaatttctcgtttccgaaaagtctttttaatgcatctacgactagagcataattttctgctgtcggttgatagcctatcagtagtataaggctccaaaacggcgctggtaccggaacgactcctccaaaatcccaagcctattgaaggggtgttttcctttgaagatgccgcccgcgcacaatcccgagcctattgaaggtgtattttcttttgaagatgccgccttaggattattaccgcaaaatctcgagcctattgggggatttttaagttgccgcccgtgatattttccacaaaatcccgagccatttaaatgttttgaagttgccgcccgcgcatgattccgccataaaataaagtcgatattttgtgagcacaaatccaaacc

SEQ ID NO: 31997 - DNA, 1147 bp, Heterodera glycines
atcatattttctttataggaaacccacgagtatacattaaaaaaaaattgaaaataaatctaatttctgtagagggattgaaccaggagaaagaagaagggaaagtcaaggagactagccattaggccatttgcacacttgggcagtgttacttttaaagaatatattaattattattttttatttttccctttgactccaatttttttcactaatttttcactcagaccccattcttaccagtgcttgtttttcccggttcccggttgccctaccgggaccgggacctgagcttttcaaaacccgggaaccgggacctcggatgaccgggaattcccggtccggtcccggtcccggtcccgtggcactctagtaaaaatattttaaaatgtgtttttgaatgggcggcgcaaatgtctattttttcttggcggcgcaagtgtcgaggcgcaaattgaagcactttttgacaaaaattttacataatttgtttgattttcttttagttattacagaattatctttaatcacaaatcaataaactaattgaaatcagtcataaaaagcaagcattctcgaatacaatgcattaatatacgtcaccaaatattgacagttttattcagaagaataataaaattcttcaattgtaaaataaatattattattaatagggatggaatttttttaataaatgccaatttttctgtgaagccaaactatgctctaaaaacatattttccactttgtgtgggagcttctagactcaagtttataatatagatagttttacttatttcgatatttttcaaaatattaccattgtatctattttggtacctttttctgcacttttcttacctattttaggatttcgtaaatcctaatcacaaaaagaatacgaagaaaattgtttgtaagtttttctgaatcactcactgataagattatatcgcaaaaattttaccaatatcatatccgggttcaagccactcgccctttattggaacttcaaccaaaattgtccacttgttgactttaaaaaaacccagtttttagattattatttttttctgctaaaaatgctaatgaacttcatgctatacatttttgtaataattctatgtaagtattttaatatgaaaat

SEQ ID NO: 31998 - DNA, 1165 bp, Heterodera glycines
  misc_feature (51)..(52): n is a, c, g, or t
  misc_feature (1097)..(1097): n is a, c, g, or t
tccgagtttctgacgtcattttggcacagtggttgcaaatgttcgtgtacnncagggaaagatctcaggaattaattgccgactttttgaaaccaccaaagtcacaaaaattaatgaaatggataagcactccgagtttctgacgtcattttggcacagtggttgcaaatgttcgtgtaacacagggaaagatctcaggaattaattgccgactttttgaaaccaccaaaagtcacaaaaattaatgaaatggataagcactccgagtttctgacgtcattttggcactgtggttgcaaatgttcgtgtaacccagggaaagatctcaggaattaattgccgactttttgaaaccaccaaagtcacaaaaattaatgaaatggataagcactccgagtttctgacgtcattttggcactgtggttgcaaatgttcgtgtaacccagggaaaaatctcaggaattaattgccgactttttgaaaccaccaaagtcacaaaaattaatgaaatggataagcactccgagtttctgacgtcattttggcactgtggttgcaaatgttcgtgtaacccagggaaagatctcaggaattaattgccgactttttgaaaccaccaaagtcacaaaaattaatgaaatggataagcactccgagtttctgacgtcattttggcactgtggttgcaaatgttcgtgtaacccagggaaagatctcaggaattaattgccgactttttgaaaccaccaaagtcacaaaaattaatgaaatggataagcactccgagtttctgacgtcattttggcactgtggttgcaaatgttcgtgtaacccagggaaagatctcaggaattaattgccgactttttgaaaccaccaaagtcacaaaaattaatgaaatggataagcactccgagtttctgacgtcattttggcactgtggttgcaaatgttcgtgtaacccagggaaagatctcaggaattaattgccgactttttgaaaccaccaaagtcacaaaaattaatgaaatggataagcactccgagtttatgacgtcattttggcacagtggttgcaaatgttcgtgtaacccagngaaaaatctcacgaattaattgccgactttttgaaaccaccaaagtcacaaaaataatgagatggata

SEQ ID NO: 31999 - DNA, 1393 bp, Heterodera glycines
attttcaagtcattctgtcaatacttttgcattgtacccatccatattcatgtccatttttggcattttcccacaaaacctctatttgaacggcccctcccaatatttagacatttttgaaagttttactttatttacatttagcgaaccggaaaaaattttgagaaattattaaccccccgccccctcaatttggaaaatttaagtccatattttatggacatatttcgcgattttaaatctaaatttttgagatgccctaattattgtacaaaaatgacaatttatttgttaaggatgaagcggacaagggacgactggaggtcagaatatcgctcaatttaatttgaatattttcgtctttttttagaaaaggcttgaagccttccatgattggtaaaaaaaaatgaaaaattttctttttttttttcgttttcagcgccgaaccttttctaaaatattttcgtaaacaaaagcgggtggtcaaattggacttgaaggtgggttaattgtactgtaaatagggttcttatggtacggatcaaatcaactgagcatcagacaatagttgctcgaatatgaatttgatattattcaagacataaaactgttatttattagcctgcaaaatttcaaaaaatttcgttgatttacaaaaaatttattgacaaaaattctcggaaaaccgtttaacttttttgttatgcaatggaatttttttaaattttgctgagtaatacagtactcttaggggctattgaacgatatcgaaatcatttaattcgggcaacggtgaaaggagttaggtcccaaaaactgacccgggatcagttggccgaggcccagcagtcgacccgtccgggttcttaccgtaatcaaaaaacccattcttaataatatcgtaaacatctagattatttagtaaattggactcagagagtatcgggatgtccaaaaaattgagaattcggcgaaaattgaaatttatggcattattccgctcaaaaaagtttccaacccaatacacctatagataccgtacaacgaagatctttcgcgcacagtacgccaactgttcattgacattggcttcggccgcaacaatgactcaattcgtgtggtgcttttcctacaaagtaagaaaaaaaatctgtgccgaatcggacggcacagaattttttttttttagaaagatttttctcgagaattttgcacgacttggattcgggatcaacgaaatttcgttattaaacgggcaaaaaaaaaagccttatagagctgcacgtaatcagttttcaattaaagaaatcctttttatttttcggttacggaaatacgccgtaattttcgcatccccccaaaccaaggggcgtaggcgggggggggggggctg

SEQ ID NO: 32000 - DNA, 1180 bp, Heterodera glycines
aggtccaccgtatcatctctacagtactgaccactttctcctcactttttcgattccaaccaaatagcatcggacgcttccattcctcaaccatcctccgacgattacgctttttacttcgtcgtcgtgcatacgcttcgatcactttagcttcgctttttcgatcgggaagcatcgaaagtgcttcatcataattatctgaattcatcgccacgcaaaacatccttttcaaaaccatttaaatcgttttcattccccgaatcattgtcagaatctgatttcttaaaatgaaaattattttaattataccgtatttcctcaattttaatcaccccccccccccccccaaaaaaaaaaattcaaatttttctccatatttgataaaggtacaaatttgcctctctatgtatgtaaattaaggtatttacaatattaaattttaacctgtacttctggaattaaaaattgtttttccattttttggctcataaatttaagttgaaaattcataattcactataaagcgtgttatttttagtgtttaaaattaaaaattgaaaaaaatatgtgggatgtactttatatgaaatatctatcttcaaaacgatagttattccttaaattttgaaaaattcgtttttctaaaaatatcactctttcttggaaggtatttttgtaaaaaaaatatactaaaaaaattcgcaattttttttcgatttcttaatctgaaaaatattttaattatatttttgacgacttttattggcattcttttgtgatctcaattgaactgttgggaaattattgttaaaaaaatgtaataataaaatcattaaattatgcactaaaattaacttaaacaggtgcaaaaattaattacatctccgtactgtacctggttctgaacaggattactgtaacttgactcggcaatcatttgtctggtgggttttcggtcaaaaaatggtcggaacaaagattggttctccattccccgcataagatctcggtcaaaataactcatttctttttcattcccggaaacattctcagcatctgatttcttaatatggaaaatattaatattcaaaatcaatgcaagaaaaaggaataatttcaaaaatagcgaaataggcacctaaaaaggccacaaaaaaaacccacccatcgaataggcact

SEQ ID NO: 32001 - DNA, 1752 bp, Heterodera glycines
cttaggacacctgcgttacgctttgacagatgtaccgccttcagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcg

SEQ ID NO: 32002 - DNA, 935 bp, Heterodera glycines
gtagacgtggagccgttcgttatccaggcggagatgggcacttccggccgcgcgttttgcttgcttcgctgtttgtaccgtgctcatcacgtgacgcatgcgttgtgcgtgacacgggcactctattggctgagcacatcgatcagaggtggtaattatgctaattattctgacaaacaaattagggttattaggctaattatatgtcatctccaaatcacaatatacatgcacttttaccaaattttatgcattaggccataacgtaattcaagcgacggggggggaaagaaaaaacccaaacgggagaggcaaccgttggtgagcagaagcacaacgaaaacgacgatcagcgaaagtagcatcaaagaaacgagcaccagtgcgaacagataaatgcgtttgtagctgaacgcagtgaaaggggaagagaatcagtgagtgattaattgcttcgccagtactttggcccatcagaaaaaatgatttggtgcggctcttcttgcgctggcacacttccgacgtgtctttgctgctgtaggggctgttgatgagtttgtcgaggggccggcgtgaaaatgggaaagacggctgaaggaatggggacaggggcgaccgaatgttggcgtggacggccgtatctgtgggacaaatgcggagaaaagcggacttacaagaatcaatcggtgtgcctttagctatcaccattaatgaagctaaacaaaagcccccttttgttttgcttcatcgtccgcccccctcggaactgaattggtccatttgtactcactggtctcgattgctccatcccgactgggccataaaatgagcacccgtccccggctcataattgcgccgtgctggtgaatctgattgtgccctttcgcttgcctaatatagatatccattataacaatgtctcatagtataaagaa

SEQ ID NO: 32003 - DNA, 937 bp, Heterodera glycines
gtaaaggtacgtcgtaaaaatcgtcaaaaaatcacgaacccggaatccaactctttaaaacaataaaataattttgtggaagaatgcaaatgatcatcaaccatcaagagaagaagcgcaatttcaacaaaaaacaaatttatctccgtttttccctttgtcgttttaatttgatgaaatggtaagaagcaaaaacaatattccgtccgatcgatcaatcggtcggtgatcagtcgaacagtccgaagcccatgtcgtcgtccgattcttccttcacttcttccttcttcttttcctccttcttctccgcagcagcgggtgcagcagaagcctgaaaaattttttttttttttttagtgaaatgtttggggtatgaaacgggccagtgaaacaggtttcccgcgtggttttcgccaaatttcgaacttcggacaagaatttgaacaaaaggtcgaagcttcatttgatttttgtatttgaaagtgtaacattttctaatggtacaatgttttttatgtaaaaaggttatagaagcaaaaagttaagaattctaaaattttgggctttttgtcagaattcgtgtccggaactgaccgaaatgggtactttcatatttgggatcgaataccaaattttgaaaagtcaaaaaagaggcgcacaaattaacataaaacatgcttctcaagctgatcaatatgccaatattttaccaacaatgttcccttttacatcgcccaaaaaatgctgcgcaagctttgtgatttactcgcaaatttttttttgctgttttttcttccatttttggcgtggattttcaagacaaaaaagtagcccaaaatgatggtcctttcatcattttcaatcgacatcagcatcccagaaaaagatggtttgaaatatttccaagacttttcggcgagttctcatcaaaacatgt

SEQ ID NO: 32004 - DNA, 209 bp, Heterodera glycines
ccccccccccctaggcccctccacacccgaaatttttaaggaaaaaattatattttttggtgaaaaatttcgattttccttactggttccacctccaagaactacctcacccgaaatttttaagtaaataaaaggatattttttgtagaaaattttaactttagtaaagagaattttaacaaatattaaacgatattgattggcgaaac

SEQ ID NO: 32005 - DNA, 1128 bp, Heterodera glycines
ctcgagagtcgaagggaacaagcttctttcaagacgaagagcaaaattcacagagaacttcaaaccagaaggcaaggctttcatcgcattcgggtcgaccaagcccgagggcttctcgaacaccattcgaaggggctttaggcctcctcggagctcgggggaagcaatttccccagccaaatcagccagcacaagttcgtagcagcaggcaccagtggtgcattcagcgtcatcgaacgtgacgctttccagccgataaacattctgcccataatttcttctgagggtaaccctcgagaaagggcctttcgttttaggaagctctttcgagaactttccgttcgaaatgtctttcaaaattcgaaagaactttcaagaaagcacatttaattcggctcgggaacgccttccagagaagtcagttgctcaggagagcaattgacttatcacccaccgtcagatggaaaactcacccaaggggtaagttgagaatttcgaaaaaagcggtttggggatgaaaagaacgatggtagagtccctccaagcggagttactccaccttcccaaaccagcggaatccgttcagtcgctgagacaattctcagagtccattgaacggatttgccatcaattattggactatggagaaaatgaacagaacaagttcatggcctccacaattaagtccaaactgccctaccaccttctgacccaagtggttgagaaagaaatgagggcaggaggagcctttaactgcacagagctccgaagagctatctcttcaatcgttgaagtcaaagaagaagtacagagatgtactcaggttttccggggagaggaaaaaccccggaattttccccctcattcaaatggggggagagccaaccaagggagaggaacaccgttccgtttctcccaaccgttccgacaagaacggcagtggaggccaatggaacgaaacgaaccggtgaggagaatgtctcctcaaccgaatcgttcattctcggccatcaacaaaccacaaacccctatctcagatagggggtcaaatcgcttttgctccctttgtgaagcggaaggggcgtgcaccgaggaggtgcacgaaatacaccacactgggggcgcgaa

SEQ ID NO: 32006 - DNA, 2132 bp, Heterodera glycines
  misc_feature (2003)..(2003): n is a, c, g, or t
  misc_feature (2053)..(2053): n is a, c, g, or t
tttcatccaagaaaatataatatcctttctctttctttagacgtaaataatttgaatattctttagccattttaaaaaatttctctgaatttgtcgctaatcctttgacaaattccgaaaatagagcatctgcagtctaaattttgaatttattttattttcattgattattaagtctcacccatgtccatttattatcgaattccgaatgcttaattattaaatgtttgtcattatttattaaattgatttccaatgggtttttttttgccctttcttccgcttttttgaacattttctctaaattttcatcaaatttttgttttattattccgtctaaactttcatttgttttataattattcgctttttcaattgccaattgcaaaatcatttcattaattggcaatttttgtttataatttaatctcttctcattcaacaattttagttcaaaataattattgaataatttgtttaatttatattcacaataattactccaatataatttaaaataaaattgcgaaattttggccagacaattcaccgcataaatcagtggtccattaatttcaattcgttctttaaacacaaattttggcttcactgtggggattccgagatattctctgtacaaatattcgtgcaaaatgtccaaatatttgcgatatttttggcattctgtccgttcatattcttcaaattcctccgcaattttgtcacattgccaattcattctcataaaatgcatgatgccaaggtgtgcttcatatttttgtcttgaatactcactgaattgaatttctttctgtcctttcaaaaatgcaattagcatattgtcctcaacctaattaatgaaataaattagtaaaattataattaactcaccgatgaatttgcaattgaaaatgtaattaaaaattgttgaaaaatactaataaaaaaaggaatcataaaaacggaattaatcaacattatgtctttctttctgaaatataaaattaaaactgattggttttagaagagtcatccaaatttctatttattttttaatttcttttttatattaaatagcgaaatttttacttgaatttatttagaaaaatacgtaaataattaatatgcagaaaacccaaaaaaattttaaaaaatagaaatacaacttttattctgaaacacgaaattgttttctactttttgaacacgtttaaacagggaaagaaatatgaacttattggaatttgcatctctatttaaagcttatttataataaaaattacatattatatgaatttaaaaaaaagacggaaattcattaatacaattttatttcgcatttttgaaatatttccattttctgcaaaaatctttgtaatgtaaccatttaatttttaatgcttaaaaataaaatttcttatatctaaaaagtgtttaaaaaagggatataaaaaataaaatacttttttgaattaagggttttggtaaaatttgaaaatttaaagaaaattaagtttactctatttcatataggataaaaagcaaagtaattattaaaaataaaaaataaaatatctcatcgccttataaatggtgaaaattttaaaaattgggattgatcattagtaggattatccaaatctattttttacttaatataatttgtttattatattaaataatgatgcaatatttaaaaattgggattgatcattagtaggattatccaaatctattttttacttaatttaatttgtttattatattaaataatgatgcaatatttaaaaattgggattgatcattagtaggattatccaaatctattttttacttaatataatttgtttattatattaaattatgtggaaatatttacaaaattgggattgatcattagtaggattatccaaatctattttttacttaatataatttgtttattatattaaataatgatgcaatatttaaaaattgggattgatcattagtaggattatccnaatctattttttacttaatataaaattgttattatattaaataatgatgncatatttaaaaattgggattgatcataagtaggattatccatatctatttttacttaatataatttgtttattatatta

SEQ ID NO: 32007 - DNA, 1046 bp, Heterodera glycines
  misc_feature (44)..(44): n is a, c, g, or t
  misc_feature (62)..(63): n is a, c, g, or t
gcagaaaattccctgattttcatgaatgacgctgacattgaccnattcaatgttctgattgnntcgtccgttggtcttgggcttttgatcaaattgttgaccaaaattcgcatttccgtctctgtttttgattttgcaaccaacagcccaatgcccaattttcccgcattttctgcatgtcgaattctgattcgggcacacatttgcaaaatgtcccggttttccgcaccgaaagcaacctctcgtgcttttcgtcggcgttcttggtcctctttgctgagtgccaacttttgcgacctccggtattgcatttgagccaattgcttgggcatccaaattggactgctccaacaaaacggctgattcgacggcatccttgaattttaggtccttgtcaccttttttgatcaattcaacccgaattgcatcattggagatgccattgataaacaatgcgcaaagacacatgtcaatgctgtcgcggctccattcagccttcgcgatcaaacttctcaattggactgagtagtcccttatcgattggcctgtttgctgcttggctgaaaataattcatgcctgcacgcggcgatcgattttgcttcgccaaatctttccaccatcaattgctcaatttcagcaaggtccatggttcggacatcatcgggctgtgccattcgtcgaagctcttcgtacacctgacccatttcgttgaacagcagaagacgctttgttgcgacatcagtcacgcctttcagctggatgaagaattcgaaccgttcccaccaagttgcccagcacatctctggcaaaaatggtccgggtccttttccgaccttttttaccgctgccattctttcacttttcttaatttgtcccactcggatcaaattcaagatgctgctgatcaactgtaatccgacttggatttacattgacgtcaattgttatccgtaccggattaacaatgaaaattggtgctggtcaactgttattcaactcaaattaacagtgagagttaattgttatccgtcccggattaacaatt

SEQ ID NO: 32008 - DNA, 801 bp, Heterodera glycines
cagtcggcttcggcccatgcccaggtttcgcaatgtagagagcgcataccttctcaggtacagccaaacttcaccatgcgtttttgtaataccgtaaaggccatgagttcctttaattaaaaaattatttaatttttttcaaattttttttcttttaatccgccacaattaaagaaagaaagaattgatttctaatttatttttcatattttgacattattttataattactaatcccacacagatttgttttaatattaattatgcattccaatggctgacccgaaacgaattgggcgatgccaaaaaagtggcgtcccgacgtctgctcattgaaatttagtagaaaaatagaacgaattagctcatagtcggtcacaatcacataaggatcctaacaaaaatttgttttacaattattggtttaagagttaattagagagtaattaatcagttattctctaataatccttttaattgctttatttaaatggtttaaaatggaaattgtagattaaagcggttaattagtgatgaattgaagcaaaggcaccctaattaatgatgtatgataattacttcgcccagccacagcgtgtacactgggccatattccttggcaaaatgggtgtacgcaccggcaccgccatggtccgggaaattggctaattggtgcaaattgcccattaatgggagtgggcttggcccgggcggcaattttcggcgtttccacacaaaattccagaacagaatggcgaacacattgagcagaagcaggccaattagcattttttagtatat

SEQ ID NO: 32009 - DNA, 1842 bp, Heterodera glycines
ttttttttttagttaacatatttccgagatttttccgtcactaaaaaagtaggcgactctacttttgatgatgatgcagggctggatggagtcggagatgggaacgaattgttcatttattagccccttttactgttgaattgagtttcattttttttttggaaaatgtgccaaaaaaattatttaaaaaattctatttatcccccctggcacataaatggagactggtatattatttttcaacctcctcagaaagggggtatataattggaggccggcagattaatggagactggcatataaaaagagtatatacggtaacccaaaatcggtcatttcgcctactgacatttcgcctactttcatttcgcctaccaagccaaaaaccttcatttcgcctactaattagtaggcgaaatgaatgtttttggcttagtaggcgaaatgtcagtaggcgagatgtcggtaggcgaaatgtcagtacattttgcatatcgatagagaaagaaattaggaacaaaatgtaagggtttttaagagcaaaaaaagggttaactaaaaagttataacggtttctcttctaaaattcttattttttaaattttagatgggaaaaagaaaattattacctaaaattcacggcaaaaacggagtgaaagagcgtcaaaagaagcgggaggagaggaaagcgcaaacggccaaggcgacagaagctcgtctggtaaagaaaagtgagtttttccatttctttttcataaaatccataatttttcagtttttagccgctgcccagcccaacaccgatgcagaaatggcacaaccatctgaagaagagccatcgacatcagaggcaccggcgcgggataacaacggacgaccaccatcaactccaacaccgatgacaccgcaggaaatggacgtgccgtcggtggagatgatggaaatcggtgttccgttcccttcaacgcctgccgacggcgaccaacaagccgagcctgtgccgtcaacatccacggcacgctgtgacttgctgtcgacaccatcgacttcaaaaggcgccggtaacttcggtctcgatgatggtgagtgaaatgccatcaaaaatttgatttttaaaattatttaattttaattattttcaagtccatttgacgagctacgacggcgttacgtttggatcgaggaggagctgcaatgacagcgccagtcaaacgccttcctccgaaaacagctcaaggcacagcgcgaccgttcgacgagcctcgagcgttcggcttcagcatgccgccagcgtaaagccctttccgacgtgaccaacaaccaacagatggacatcaggctgagcgcggcaaaggatctgctcatcacattggacgcaggcatctcgttcaaagcccgtgaagcattgaagcggtcgtttaccggccaaggacttgacgtttgggcaccgacaagagcagtgaagcgtctgaagacggagctgtgcgagacggccaattttcattggacgggcgacggggagacgcgtgcgcttgtttgtgtcgacgtcgtgccatgaccgagggccgtcttcaggaattggcgacagtggtgagagagaaaaaacaacaatttttaaaatgttaaatgaatgccgactgaaactccaccagcaattttgtctctcaaattgttttggtgattgcgggtgacaaaggaggcgatggacggctgcaacgacaaagttgggattggtgatcggcaacgttgatcacccaaattccccaaaaaatctgtccattttgggcatttattttgggcatgatgaccgaaaaaagttggagaacaaatttagctcgattt

SEQ ID NO: 32010 - DNA, 927 bp, Heterodera glycines
ttcgtcttgcccaggttcgcctgcaattccgttttgctcatcagttctctgcagccaatcaacctgacataataatttgttcattttcgaattaaaatgaaaaaaaaaaaaaattaagagtaagattggtaaaagtagatgtttctgcccgtttaactgaaaattatggtttttctttatcctggaccgtcaatgctccagaaatttttcaaagatttccccatttcacacctcagctccagcttgccgctgaccgccaacaggttctgcgtctgagtgtacagcaccaactgttgctgtcgtcgctcactgttgctaccgtcattgttgcccgcgttgttaccgtaattggctgccccgctcgccaccgacgtcttttgttgcggcgctgccaccacagtcgccgccggtgttgttgccgtcgcggtggtcgtcattgtgccgccggactcgctgccaccgcttccaacagtcgccgccgcccctgtcgctgttgttgtccatggcgactgggagggggcggaggaagagatcgtcgtcgccgtttgctgctgcgagtacatccagtggtcgccggcaccgccgccgcccgcgtggttgtgctgcggcgacccgctcgcggtggtggacgagctgccaccgtcggaggtcgcggcgacaacggacgccttgcgcccctcgtcctgctgctggtgttgtgccaccaccagctcgcggtccaagtgctcgcgccgtggcgacccttggggcagttgttccctgacaaatgaggcggtaaatgaaacatttttaaaagttttgtgatgaattgcataatttaaagttcctttaaaaaaaatgccgaaaatttttacaaataaaaatgaaaaaaaaatttaattaaaaaaaatactgacgaatatttcttcaacgccagcctgatcaggt

SEQ ID NO: 32011 - DNA, 968 bp, Heterodera glycines
acttacagacggatgatcatactcaccagatcggacactgaaatttgcacgaattttcaatttgttaaagaattttgcgaatttttacctgccaatgacgcaatgaaataattggacggctgccgaatggcacggtcgagcacaaaggacagaaggaccaccaaattgccggcgacggtgacggccgaaatcacagccatcagaagcaccttttgagagggcaagaaatcaattattaaagatcaaattgactatcatctcattagtaagcgatgatcggtcttttgattggacagccaaaaagccgggaatttatcaacccgagaaatgagactttcgaatggtcttccctaatcaccaccaatggcactgactaaaagaatgtcggtccaggcgagcaccaattgatgttggacagtggcggcggtggtctcgtcgttggcggcggaaggattcattgggcatggaagagacaaggcggaagaaggacgaggaggaggaggaagaagaagaggaggagaaaggggggacgaagaacatggcacattttgatcaaaatcaaaggaacaaatgggcacagtcaaagagagggaggaaatgccaattggggaggaggacagcttcttccacccccactgacgcaaaaggcaagcggattaccaatccgtcagagtttggtcgatgggttgggggaggggcagcgaccaaccgacggacaaacggacgaccccttctccaatttcggcaaaaagtggctgaattgggggggggggcaaggaagggcaaggggaggggagggaatgaagagcttagggttgtgtgatggcctaaattttgcaacgcgcccccgccaaagggcttaaggatgagtgattgaatggaagagaaggaggaggaggaggaggaggggcaaatgatgaatcgaaacccgggggggggggctcaaaaagaaggaaatgatgacttaa

SEQ ID NO: 32012 - DNA, 898 bp, Heterodera glycines
ttttgttatttgactttttttattggggatttttatgaattttttcactttaaagctccggcaatgcccttgacagaaaaaaacaaattctgagaaaacgaattgatatttaatctattttttctgttccgttgtccgatttcgcgagattagaacaaatgggccgaatgggaagagattggactaatggagaaacatttctatttgcgttttgtaatcgaccattactcagcaaatgacggtgaattcaacgtcaatgactatttctttttttggtttttgtctctttcacttttcatttattttaaaagtctgacgatcaattgaataaacggcaaaaatgaaaacaaaaataaattacaaattaaaattgtgataaatgaaaatgaatggttcatcatcaaaaaagaaagagttgtgttgattggttttgataatacacaatttaattgatcatttattgtagataaaaggacagcagggagaagagaatgcttaagtgtgtcggaaatgtgtccatgtcagtttttgtgccgtcgctgtgccgttccagccgtcccattttttctctacaacgcctcctcaattttttgttccacggtcctctcagcctcttccgtgtcgtcgcccctggaattttttcggtaaatgaataaatttagtagtgttagtagtgttcacgaacctcgagttcgtcaatgatgcgctgcgctctacatttttccgccaccgctttcctttgctgaagctttgcaaagttgatgagccgtcgggtttccgccatttgcttggtccttctctccaattggcgaattttctgccttgtttcatgttcgtccaactccgctcggcgccgaagccgttttgcatcatatctgaaaattgacactttgttttt

SEQ ID NO: 32013 - DNA, 1428 bp, Heterodera glycines
  misc_feature (100)..(100): n is a, c, g, or t
  misc_feature (1390)..(1390): n is a, c, g, or t
ttaagccttttcaaattgcaaccgctcagacccaatcttttcatatggttcatgttttggaactgtccaaatgtttcactgaaattaatgccatccattngagaaaagtcgatactctgtttgaatattttgtccaattcattaatttattttttctttggctttacctccaagtttttcaattgtccgatttcagttaacaatgataagcttccataattatggtctccaatcaccaaatttttaaggttgttgagctgacttaagcttcctttctcgatggaagatgaaagcgaatttcccgcaatgttcagtgtctccaactaaatgccattcactataagcttgtcttttgttagttcacctcaccatttcaactccgtcaaagtcggcctttctcagtgtcgatattttgttgtttgccaacgaaatcttcttcagtttgggccctttcctcagcagtttcgttggcactttttccaagttgcattcttcgatcactaactcaacaagtgagtcgaatttggcggtcgaatttgtttcgaattccaaattcggaatccctttacactttttcacttccaaatgcgtcaaatgggcaatttcgtggctcagatgaaaatgctcttctgagtttgtcatttcctcttcagagaagtccacgtggtccagaatcatctgtaaattattattcacaccttcgttcttttttttgtatttacccttccaacgcttttattggcttttgctacaaattcgagcgtttttctcaaatctgtgattttcgtgccataaatgcaagtgatggaaataatctcttcattgtaagccaactccttttgtgccaatgtttcgtcgattgattgttccgggccacagagacagtttatttttgtcagttggggggaactgagaaggtccaatgatgagcttgtctggaaggcttccaagtcagggcatcccggcactcttctcgaattgattgaatcatttgccctgagggtgccgagaccattggagcaaattagccaaatcacacaacagaaaagtgttgaaagaagtgttgttgccgatggcatcgacggaagaatgaatggctttctgttagttttggaaatggtttggctttgttagtcgttcacaaatcagtgttatgttgggatgaaatgtttcgtcgggcggactctccgccgccgtttccctttctccccatcaataaaccgttttccttctcattcacttttatccgtccattggtggtcgatcgttggttcgatcacttccagtttttgcaagcagaaccctctaagcttttagtgaagcgtatcacttttaattaaggtgtgaaagtggcgtttcccggggccttcgctagtggaaaaatttaccnaatactttgaatgagcttaacattgaattctcagctct

SEQ ID NO: 32014 - DNA, 1260 bp, Heterodera glycines
agccgaagcaagaaacgagcccagtttttagaagcacgaagcttgaagttttaaaacataaccccacagcgaccaaatttgaagattcaaatagaagcttcttattttaagttttacactttacatattttggattttttcttgttgtatttttctatttttttattaaaatagaaaggatttggcgatgccaccataaatataatctaagatttagattttaaatgttaaatttaattcatatttttgcttctaaatatttaatagtaataaaccgaaggcaaattttcgttaaatgattaaattaaaatattttctaattgtaccaattttattttaattagataaattatttttaaattattttaaaaaatatgtaatataatacatcattaaatgaccttccaaaactactcattggtcaatgaagtgagaatgaattatttaataaaacaatgaaaaattagtcggaaaatattttcaaatttggaagggcaatttctaaaacaaattatgctttttattttaaggcgttcaatcgtttcggcgttggcactttctcaatggaattgtttttgacgcattttttccgttggctcgtttccctgcccggaatgttgttcaatgcagcccttttgaacacaatcattcgcgaaaagtgataattaaataaaaaatttataataaaaaattcttataaaatgataaatttaataattttaaagtgattaaatatgttgtaaagtgactcccttaatttttttaaatttttcttcttaagcttatattggttttctcattttcgagcgtttcaagctaaatttgtgtgttttcggggtttttagattattaatagggctgctaattttaggtaagaaaaatcgcagaataggtacttaaaaaggttaaaaaatatatcaaaataggcatcaaataggtataaaaattccaaaataggtaaataaaaatttttattaacgattttttagtggaaaaaagcaaacaaagagggaaaattttggttctacatatctctttgtaaacgaaaatttaaatatattaatattttcttagataatattgacattttaaattaaaaattttgtcaatagaaaaaaataaataaatgttgggataaatttttgagaaatttttccaattcttagggtgcatttttgaaaatttttttggtcgattcttatgggtatattttttgattttattgcatttttgttaagaattttttgaaaatccttaaaa

SEQ ID NO: 32015 - DNA, 1726 bp, Heterodera glycines
  misc_feature (158)..(158): n is a, c, g, or t
gtgcttaaaaatgcgcggcgcaccgcgcaaaaaaaaaaaccgcgcccgcgcaccgcgcatcgcgcattcaaattgccgcggccgcgaccgcgggatcgcgcaaaaaaaaacgccgcgaatcgcggatcgcgcatcgcggatcgcggccgcgctccagnccctgattcaggtccaggattcttttttttttgggtttttcgaaaatcgcgaattcgggtttggattaaaagtaggataaaactgttaggcaaatgttttttcaccttttgagcttcaacttttgtcccttcttctgctgacaaagaacacttcttaatttccatgatgatctcttcctgtaatgcgcatctatttctcaaaaattcattctccgcttcgagctccttcatttgttaagcacgcaaattgcacaaactaacccaataatcattctttttcatttaattattattcagaacaaatattgattagctaaaaattttaaaaaatgtcgcaacgtctaaccggggatgtgccatattttcgaactgtgccctcctctccgtcaaatgaagacgacggattggcggacgaggatgagccggttgatcaccaaagtcccactgctcaacagcaaaaagcggcacaaaacggtagctaattaagagccaggcttcgttttttggggaataaaatcttttttttttttttttagaaatacgggccaagaaaagacgattctctgagttcgaattaggtcggtctgggtccaggtttatgcttttttttcatggaccaagacgccaagccaatgcatcttaggccgtcggggtttttctttgggtctgaaaacccaggcccagttaaatccaaaaaacctgagtttcctggaccatcatttatttttctatttatttgttatttaaaatgataaatttttgataattttaagtggttcaacattgaattatttttaggtaatttttatatttttctaaacaaaatatttttggtttctgggcattaaaaaacacaagttctagcggtgggttttttcccagaaagtccaggcttaattcaaacccagaccaagacttttcaagtcccgagctctaatcattatcacttattttaccctacaatttttcaattttatttgacccattttttccttttttctagtggaggatgatgaggagacaattttgcgacgtcgacttttggagaaaaagttggaaaaggagaaaacaaaggcagccgcgactgttggccagcagatgacgaaggagcgcgacggggccgaacagaagggggcaaaggatggttccagaaaggagcacccgcaaaaggttttcggcatttttgtgggcatttatacgctaatttgtggttttggtttcgttttaattccgagtcttggtcctaaaaaatgattttaacccaaaaattacacaaattttagagcatttgtgggtgccaaatttaaaaaatcaacagcatttatttaggagaggccaaagcgtgagaaaattgtgtgggacagagaaaaagtgacggcccctaaatcgtcgcgtcatggccaattggtgtcagcgattgcggacaccaaacatgggcaacgttcacaaagccaggtttctgtccaatgatgcgctcatttttggcaatttttttttgtctaaaaaggggaattcttggtagcttatgccacaaaaaataaataattttttttttttgtgactctaga

SEQ ID NO: 32016 - DNA, 897 bp, Heterodera glycines
ttgctgtctttctgcttcaggtcctgcaaaatgtgttcatatgtggtggagtcgaactcgtaaatgttcggcttgtcctcttttgggccgggcaatttcacgtaattgccggagccaaagctttgcacgttgaacccacgatttctaatggggggagggggggtgggggtacagaaacaatgcacataaaattgaaatttaataaaatttataaattaaatatagaaatttgtcgcaaattttttgaagagcaggactttgattttgattccgaaattagggtattttaccatttttgggttcacagaattcatttttatttttttaatcaacaaggttaggacgatagtttactattgaggaaggaggacttgtggaggagctggacccaggcttggattttcctaggctcagaccaggtttaggtatgaattttattaaagtttacttgaatagccggagtttcaacgctgacaccgaatcggagcgggggaaccccccgggggacgttcatttggatttgtaattaactgtaatgcctccctctgtttttgtccgagtgatcgctcttctgtcgtcccttggggcaatttgtaaattcgaataattcttcagaaaagcgttggatcgattgctcatttggtttggttcaattcttatcacaaatgtttgttgaaaattttaccattggaaaaagaagggcgatttgtttgtgaatttttaattctggtgctgatacatagcaaatttccagggagttgaagaaggccatcgaaaaccggaattcacaacacaaatggacaatggcactatttttggtggcaaactcacagaccactaagacaaaaaatcaattagtttttgaactgggggctcaaaactgactcggtgtgtata

SEQ ID NO: 32017 - DNA, 972 bp, Heterodera glycines
ggggtactcaaacaattatgggggagcaaaaatccaacgcagaattaaagtacaggctatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagtaaaagcatcagagtgcctaaactaacatgtaaataaaatttggtgcgtttcagaagcctttctgaaaaaatattaagaattaattttgcagataggaataaaaacgaaagactcagattttcgaaaatttttttga

SEQ ID NO: 32018 - DNA, 1269 bp, Heterodera glycines
  misc_feature (16)..(16): n is a, c, g, or t
ttttccaaaacataantgaaaataaaaaagcctatgattttttaaatgctttgcaatcatagaaaaatgtttgattattattatttacttaataaagtacatagaaattgaaaaactcaccatagaagagataatctgttatagaagaaaattgagaaattattagtgaaattaagatttctcttaacagggtaggcgaaaagggcggcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgagctccaattgcatgggcgtctgtaaattcgaaaccagcacaaaaaataagcctcatggcaaaattccagcgcaattggtcggctataagccatggaattaccacaaatttcgacgacattcaagactgatttttgttaaaatatgaacacatatttaaccggaaataatgaaaggtgtgtgtttgatcagaacttatcttctctatttgttacactatcgattgcttatagaaaaatgcataagatttatacaattaataaaattacaaaaaaaaattgtttatttaattgaccttttccaaaacataatgaaaataaacaagcctatgattttttaaatgctttcaatcaatgaaaataaaaaagcctatgattttttaaatgctttgcaatcatagaaaaatgtttgattattattgtttacttaataaagtacatagaaattgaaaaactcaccatagaagagttaatctgttatagaagaaaattgagaaattattagtgaaattaagatttctcttaacagggaaggcgaaaagggctgcaatttgttaaaaatattaatacagtttagttccccgttttagcatagtcgtttagatgtgatcccagtacaattaagaaagtaggtatgaatgcttgggaaaattttgttgtttaaaacagagcaaatagagcggtgtgcgaggaaatgcttatcgtttaaggtgggtattgaagaaaaatcgacaaaaaatttaatgcgctccaattgcatgggcgcctgtaaattcgaaaccagcacaaaaaataagcctcatggcaaaattccagcgcaattgatcggggctatagccatggaattaccacaaattcgacga

SEQ ID NO: 32019 - DNA, 1230 bp, Heterodera glycines
gaggacagggattgataactgtaatgacggataatttaaaataaaatagcgacattcttccaatgttagcgcaaaaaaaaatatgagtaagaattcagagtcatgcgtctcgagatgccaccttcgcttaccatgtgcattgtgatcagagtgccgtccacaatcgcttcgattgcttctttctgcccccgcaaaggatcgttgaagatttgcttcgtcatgttgaaggcgttcacttgcgcttgagaagatcgctaaataaaatatttaataatttatttttaatccttacagttaaatagggtgcaccccaaaatttcgccgccgaaatttcgccggacggaatttcgccgggacataatttcgccaaaatttttttttaaaaaatttggaaattttcaagaaaaaattcttagaatttttttatatggaaattccaatgaaaaatttttgaaaaaattttttagtgattttttggaaaatttttcgaaaaaacttactaatttatcataaatttcaaaaaaaatccttaaaattttttctaatttttttttgaaattttcttataagaaattctatgattttttcttaaaaaatttctaagtctaattttttgattttatttttttgcggcgaaattttgtcccgtcccctttgttgttgctactcaatgaattgtgcgagtgacgagcagtgccatgagtacgcttgtccaccaccacaaccatcggcacaatgtgtgccgaggtgccatcgctgttcgaagggcgccgcttggcctcggaattccaatgccttcgccctgcggcccaaccgccacgaagggtccgttgagtacgggtgtaatgttcgggttgggcgtgggcaaattgggcggctccgccttgatcacctccttggccactgcgctggggtcctcctccaagtcgttcttgaactccatccgatccccaaaggtggtcagcaggtccaggataactccgttggaccagccgaacccggactgacaaaggaaaagtccaattgcgacgaccaaatccctcccctccccctcaaattacctgaacttcgtattcaccgccaacgcctttgttcggcttgaatttgttcaccgcgtatttctcccacatgttgcccctgggcacttccgagcggtacacccggtaattgctgagcacccatttgggcaaaagcaaaacgcctttttctgcattctgtcggttaaagggg

SEQ ID NO: 32020 - DNA, 1434 bp, Heterodera glycines
  misc_feature (1028)..(1028): n is a, c, g, or t
cacggaggtgctcactttgttgttgtcagtctgaaagtcgcttaaggctttggctcaattggcgctgccggtggctacggcggtgttcacgtgtacggaggcggggagagaatggtgagacgcaccgatttggtatttgaacgcactgggcagtcgctaattgtacggcatggtaattttgtcattcagatccccggcggcattcccaattcgttggggcgggcgctcgcgggccttcgatggccaacagaggtaaagggcaccgcaacaaatgctgtatacttgcctccgagactcttacacacatttagggtgggactcgtccggtgctggcaatgccaacaaatttgtgcccgaactctccgctgcagggcccagtggcagcggcaatggctcccatcggaagttcacccaattcagcggtccgccgccccctctgaacataattcccccgcggcatccgccgatgttcggccatctccacccgccccctcttttcacttcgctaaaccctccacacgcggcgagcgcccaattcaacccaatgggcacgttcaatttgcaaaatgggacaacggcgagcaacattcagcagacgggcggactgagcgaagacgcaatttggcaaggtgagacgaaaaaagggacacaacgccaagccatgggcgagaaattaatgatttaaaaataaaaaattttaaaggttttaattctgagagttgcctaaagctttcaattagtagtagaagtagcatgcttgaactattgcttttaatcacacagaattcgaatattttttgtgaacttagctgatttgaaattttgcccaaactcggcattatttaaaaacgaaggtaatttcccgttttgggatcgcacaccaaaactttaaaaaatcaacaaagaagcacgcaaatcacacaatatattctcaaactcatccatttgctttttgcatttatttccccaaataatactgtgtatgcgttttgtgaatttgtgcgcaattttgtgattttttttttganaatttaaaagtgttaccccgaaacaggaaaatacaaaaacgagttattatagaaattagaaattgaagcatccgttggattattgcacttttttgcagacccaaacggcgaactgcgcaaatggcaaagggacaccggcacttccatttggggcgacccggcagagcaaagtttgctttcatccgcaacacacaaaacgattggtcattttgcagcgggcccaattcagcgatggcaacaattcactgccgatgaagtggtggccaagtccaatctgttggccaaagaaggcgcagaagtggtggagagcggatggtacgggcacactttcgttattttgcccttaagcgcggttttccctagaaaagttacgttttttaaatgaaaattgggatgggtttttgaa

SEQ ID NO: 32021 - DNA, 1074 bp, Heterodera glycines
  misc_feature (1017)..(1017): n is a, c, g, or t
  misc_feature (1024)..(1025): n is a, c, g, or t
  misc_feature (1031)..(1031): n is a, c, g, or t
  misc_feature (1040)..(1040): n is a, c, g, or t
ccaaagaagcgagggacattggcataaggttgaaggagcctcctaaccaatgttggggttgcgctttttctgccttcgaatccgcatttcgtacattttattccccttaaaattgaaaattattcaaatttgaaaaatagtcaattattactttgcgcaacatgtccgggttatatccgcgtttgaacaattcgcggaacaccagcaccatatcgaaccgaccgccaaagtgagagaaggcataggtgtcgtaggcgagcggtaagtcgtttatcagccagctgacaagcgcatccaaagggttttccgccaccacttgcttgtcgactgttgtttcggtgaagcggcgctggcagaacgcgaccgtacgattaggaccgcacacttcacaccctcccgatgcctctcgccagctctcattttcaatgcagtcggggcaggcgacacgcgcagcgataaagttgggcaaatgttcacgcttttcgggcttttcagatggcatgtgctgcatagtctccaagtcaaatgccacaattcggtaggggtcgcgttccttgggctcgatgggttggatgtagcatccccgctcggtgttgtggtagttgttgcacatcttacagaagcgttcaccacaaacatgcccctttctgccatttcttttgttatctgctacatcccaaacagcaccgcaatctttgcactttttcgaccgcttgcagaagcctgactgcagatgatgctggtagcagccgttgttggtgaattttttgttgcactctttacattttttgaagaagccggcggatgatggacatggaaaagcaggtccaacacgtgagcacagcacacagcgcgccttacatgatttactgtgtgtcgacattcttcggtacgggcgctcacactccaagcagtatggttgcccaaaaagaccgccctgcttctgcacaccatcaaaatggtccctcattgaagtacaacagcagcggagtgtcgtaaatcttctcaaagtacttntacatcnntttatnctctcccancgatcctaggaagaacacagcaaagcggtgttgt

SEQ ID NO: 32022 - DNA, 1063 bp, Heterodera glycines
  misc_feature (51)..(52): n is a, c, g, or t
ggagaagtttgtagtgactgcgcatgaaataatagcgactcaaatgacggnntttgcacccgtgggaaccgttctttggcttgtgaaaatggctctaaacattcccaataatacggataatttattttaaaaaaacatacaatgaaatgtgatgaatccggatcattcaaagcacaaaattcgccatccgcacagtctgctgattgttgtgagtcgttcgattgggcgagcgcatgggcaaggcaaaagaggaggagcagacggaggccgtgccgaaggtccattttgggaggaatgaatgaacagtttgggaaaggcaaaaagtgacagtcattgggcaacggagcaaatttataccgcagcaaaagctgtgggaggcgtcggtgatcgggcgaataaattatccgctaattgtgccactaatattcacactctgtgcattaatttactcaattcgccgccgcccccttagttttttctacaaaaagcagacgatgctcttcatggcataaattaacacagcattaaataaatgtgcgaacagcacttaaattgaattcaataaatataaatgatgagagtaaacgttaaaatttaagtgaaaaaatgaattagcggactaattaacggattaatgtttaataatttgaattttgcaatcttcagttgttgtagtccctattaattgtgtctacgttcgctggtgcggcatatgaccgaaattaataaaatttcttaatagatttgagaaattttaagaatcttaattattgaaatttttgagtcttcttaagcatcttaaaaatattattttatttgttatagaattatagaaaacattttattttatagtaataattttttcaggtcccggttggacctggtacccggtttaaaaacttgaagcccggcttttctgatgtccggcaatacctgaacccgttttttgcccaaataccccggcccgttaaccctacttcaaaacacaaaaatttccttacgcctaatttcctcctaataatttttagctaaggttttaattcttatcaggcttatttttcct

SEQ ID NO: 32023 - DNA, 1103 bp, Heterodera glycines
tgggacgcataaaagttcttggggacgcataaaaaaaaggccaggggacgcataaaaggccatgggacgcataaaagttctgtgggacgcataaaaaaaaggccatgggacgcataaaaggccatgggacgcataaaaatcaaatgggacgcataaaagttctttgggacgcataaaaaaaaggccatgggacgcataaaaggccatgggacgcataaaaatcaaatgggacgcataaaagttctttgggacgcataaaaaaaggccatgggacgcataaaagttctttgggacgcataaaaaaaggccatgggacgcataaaagttctttgggacgcataaaaaaaggccatgggacgcataaaagttctttgggacgcataaaaaaaggccatgggacgcataaaagttctttgggacgcataaaaaaaggccatgggacgcataaaagttctttgggacgcataaaaaaaaggccatgggacgcataaaaggccatgggacgcataaaaatcaaatgggacgcataaaagttctttgggacgcataaaaaaaggccatgggacgcataaaagttctttgggacgcataaaaaaaggccatgggacgcataaaagttctttgggacgcataaaaaaaaggccatgggacgcataaaagttctttgggacgcataaaaaaaaggccatgggacgcataaaagttctttgggacgcataaaaaaaaggccatgggacgcataaaaggccatgggacgcataaaagttctttgggacgcataaaaaaaaggccatgggacgcataaaaggccatgggacgcataaaaaagagttctttgggacgcataaaaaaaggccatgggacgcataaaagttctttgggacgcataaaaaaaggccatgggacgcataaaagttctttgggacgcataaaaaaatcccatgggacgcataaaagttctttgggacgcataaaaaaaaggacatgggacgcataaaaatcaaatgggacgcataaaagacctttgggacgcataaaaaaaaggccatgggacgcataaaaatctttgggacgcataaaaaaaggacatgggacgcataaaa

SEQ ID NO: 32024 - DNA, 1989 bp, Heterodera glycines
  misc_feature (19)..(19): n is a, c, g, or t
  misc_feature (52)..(52): n is a, c, g, or t
aaaattatttttgggtttntcgagttcggtcaggggttcggaatctgactanatagatgtcaatttcttgatcagcagtcccaaaaacctaaagaaatttttttttaaatgcaggcaggcggatttaaacccatgacacaaaaatccatttttaaccaaacgtacaattcccctttgttgagaatgggcaaaattcaatttttgaggccatgtagcttttgaaggatgccaaatgctccgctaaaattaaacatcacaaaagttgacaaaagaatttaaaaatcgaattgtttaaattcaaaaatttcaggttaaaatttattttaccattaatttatatcgatacatatatacctacaatacaatagtcagaattttgaattttttgaggaaaacatattttttaagcgtacggcaccttggtcaaatttgatggcaggtcaaatgaaaaggtgtcgcaatatttgatgactaactcaaaaaatattcaaatgaagattgtcgtacaatattttggcccaaattgctctcttttatcccgtgaataactgacaaacatttgaattgagtcggatttgtgatcaacgtattttttgatcccagaaaatcgattaaaaaaatttcaaaaatcaaatactcaataaaaaatcatagatataataaaagattttcaaaatccgagttcatatttgttatcagcatattttttaagtctagaaaaagcgctttacgctttaaaaaaattatttttttttcgtgaccacaattccgaaagattgccgaatacctcgaagtgtataaggtttgcaataatgcaggcgaaaaatttgaagaatgagatttttctggttttctatgcataaaactttgattttgccaattttgggcacatatattggcagtatttcagttttaccacatatttcagcatttttagcacactttggaattttgtaaaaatttctttgctgttatgctaaatttattatcattataaattgataagtgaatatatatcactttaaaatatatatttggtgaaattcgttgtctaaagatctattttaagttaataggcgagatattcagtaggcgaaacgtccgatttttgggtgtaggcgaagtgtcagtaggcgaggtttccaataggcgaaaagtccgcttctaatgaaggaatatagtgaacacggcgaaaaatatttcaaaaaaataattgctaagatactaaataagcgtcgtcaataaaattcaaaatatgtctttccttgacaagcatagagctatcaagtgttaactattgagcaaagttatgtcaagtttttgtaacaaatgtctgccaggcggttttaagaaacaaaaccactttttctaactaattttgggagtttagcaattaaaaatcaaacaaacctaaagatttaagcttaataaaatgtctcatttgtgattctaaattacacatttttttatattttttattttttcaaaaaagctgtcaattttctgcagaattttaaaataattaacctcattttgaatttttgttttgaatgcaatcaatcatcacaattaatttcaatttttttgagcaaataaagcgccaaaatgaacaaaaaacgttctctataaacaaaagcaatagaatttgtgaatatttgagcaattactaattatttaaaccaacagctatgaaaacatttaaaatttattaatttgcagaaaatagaaaaaaaaattcacaattacgtaattaaaataataactaattagttttttcactatattttaaggcgatataaaaggaatggcaaaataacagaaaggcatcagtcttacattcatttattaaatataattacagaatcaacattaaagcaaccttaattggcatttaacttataaaataataaattaattaagtatagaaaaaaaattaaaaaatgcactcgcttctgctgcttttcaatgtcacggtttacgtgattattt

SEQ ID NO: 32025 - DNA, 1305 bp, Heterodera glycines
ttcaccattttacgcatttttaattcgtcgatcgcttctttaataaattttgtgtcggaatcgaagtctcgaattcgttttcgggggacacggtaaggagggaaaaagaccctcctcactccatcacattcgcctacgtcttttccctcaaccctcccggatcccaaattcccctcccatcagccactgggaaaaaattcgggagtgacccgaagtagcgccaaattcgagcagttcagtctcccaccagtaggagcagcggaagagacggggagaactcccgtcgtcgtcaagtccaagcagggcagtgaaggaaggaagagccgagcggtgccaaatcgtccgacgaaaggacagggccgttcgtcagcgtaactcccaccagccggagaagcgcgcatcgatcgaagcggactcccaccagccggagtgtccgccgcagggaacgggagtcgaaacccgtggtcgtcgagtcaaaggggtccgacaagcccttcctccaaccttgtcggtggtgccgttaagcaagcagcgatttgctgcacaattctctcaagcaccaatccaaatttgtcacccctcccccctcccattctcgtccccctttggcgctgatcggatcggtcagcagcatcagacccatcaaaaagaacggcaaaaaagggtgcgcttccctttacaacaagcgaacggagtgagcagagagcgaaagggacgagagcggtgaagaggagcgggaaccaatcccgcctcagcttggcccaccccaacccccaagcgcgcggcggaaataaaaagattggcgacacatatcatatttttctaattgtatgcattactttgttttccgctataagtgcaactatgttgccttgcggtttgttcaaataaataaaataaaataaattcttaaattttcccccggcggcgcctatagggcaccgccgggacccccaaattcctatcttttttcttaaaaattagcccaatatcgcaaattttgcttattttttgtacaaaatattttttttaatgacccaaaatccctaaaattggttattttttagacaaaatctgtgcaatttatgtcaaaataaatagaatcgaggcgatcaacgaataaaggaatgtggagccaaagaaatcattcataaaaattaatttttttgtgagattttttgaatctaattcaaagcaaacccccgcccccgccgcgcgggggcggaattatcgtgcccccgccaccgcccccgcgactctgacccccgccaacccccgcccccgcgaaaagccactcctgcccac

SEQ ID NO: 32026 - DNA, 950 bp, Heterodera glycines
agtgattagaagaggtacaacagtgattagaagtggtacaaaagtgattagaagaggtacaaaagtgattagaagaggtacaatggtgattagaagaggtacaaaagtgattataagaggtacaacagtgattagatgattaaataattaaggaaatcgtttattaaaaagtaagattaaatattgaatgtaattaataaattttaaaaataaaataaattattccttttattaattaaaaagaaagtttgaaatgtacaaggattgaatatttatttaaattgaaattaattttacaaattctaatttaaaaaatacaggagttctttaataaaagtaaataaattattattttaatttaaaacatttttcacaaaaaaacaatttaatttaaattaaaaaattttatttttattaagaaaaaaacactcttttaaatgaattaaaacattaaaaataacccaaaaatacatagaaaataatatacaccgcgcggattcgaacttcgccccccccaaaaaaatgatgcctcagaatccccaatcacacagggattctgaggtcttgactatgtcaaaagtaaaatctgatcacgtattcgtgatcagcggcccaaataacccataaagacatatttttggaagaattttgttgaaaaaatttttccactcaaaaatcctggtcacccccctttggactggaatcccaaaatcacttttatttttataacatttttcaaaaaagtgataaaaatgtgaaataaaatttataaaatagagctaaaaattgcggatttttgtagcattgtgtttttttttctttttttcttttttaacaggggagaaaaatttttttttgaaatcgcaaattttacagaatttctagaataacttttttcatatttatgttacaaaagccaaataaaacccataaaattctcctgatttttc

SEQ ID NO: 32027 - DNA, 1527 bp, Heterodera glycines
  misc_feature (1484)..(1484): n is a, c, g, or t
  misc_feature (1488)..(1488): n is a, c, g, or t
  misc_feature (1492)..(1493): n is a, c, g, or t
  misc_feature (1513)..(1513): n is a, c, g, or t
cccccgtggttgtacctcttcccccgttgttgtacctcttcacccgtggttgtaccttttccaacgttgttgtacctcttccccgtggttgtacctcttccccccgttgttgtacctcttccccgtggttgtacctcttcccccgttgttgtacctcttcccccgtggttgtacctctgccccgttgttgtacctcttccccgtggttgtacctcttcccccatggttgtacctcttcctccgtagttgtacctctttctccgtggttgtacctatttcccgttaaaatctcttaacaatccatagcttgcctaggtagcgaagctcaagaagcgcgaagcgctttatcccaagcccagatccgacggttcacgcacccgctagtttatacatttttacatcaccaaaataaaatgatataataaaaaaggccagtgaaaatcaatttaatcaatgtttaatattaaaaatgtgcatagtcatgtgtattcaatttattattgaattgtaaaatgaagaaagaaataatatatggccgtaaaaaccacaaatttttattttaaacgaaaaaaattctcctgcgctacaaattaccatcaaaattgcaaatattcctttcagcaaaatgtcaattttgttaattttgatcgccctaatggagctgatcaaatggaatgctgccaagtttgaagtgatcacagatgacacaacagaggcggaagacatggaaaaggcaatgaaaattggccaaacttacttttggcgtaaactgatgacagaatggaaatgtcaaaataaaaattttaaaaaaaaaaataatcacaataaaaaattgatcaaaatttgcgaaaattggaaagtgaaggcaattgcggcgaatgcctatgtgaaaagttgggtgtgccaaaaaaaacaattggaacaagctgaagttggtacaagttcatcaggagcacaaaatgtggaaatacagggttaatgaattgaatttttttgaattttgaaattaaattttactttttttagtgtattcatgcctttgtatgaagccaaattttcaaatggtgaggcaaggcgaactgcaaatgagctcagcaatggaagtaatcaaaggagtgtaccgggacttattcggctggggcaatggcaaatggatgcaaattaaggtgaaatttagaattaaaaaaattaactgttaaaaataattagatggaactggaaagaaacaacttgtggagcatgactacttatttgtttgataaattgaaaaaaaaagaagatctcttgggaatggttagaaccatcgaacaatatgctgatattggtgttttggatttcaaggaatttatgccgtcgaatcaattttcaactgagggtttaaaagtgaatgagattcatgacattgtctctagtaagttttcattctcatggctccaaatattttttgaaaaatggtttatttaccttttataatataagcattncttnggtnngtgtccccgagattcatttngttattattaatct

SEQ ID NO: 32028 - DNA, 1295 bp, Heterodera glycines
agtgacgaatcgagtttgattggcgattttgtttttgcctgcgctgatttgcgaggagaaggcgaaaaacgttggccaccgcatggaaaatgcctgaaagagaaaatgaaagattttaaaatatttttatttaatttgaatttaccacacaaaaggccctcctccgcggccatccgtcgtgccattgcaattgcgtcgtccgagtgaacttgcacaattccgccgccgtttttgtacaggttcgtgtccaacacggcgggcactgtgcccgtgccgatgccttgaattcgatgccgtgctccttcggggcggcatccactgagtacggcactctccgccggctcaacggcgtaaaactacaatatttgtggggcatattttataacgatatttcagataagaagtttatcagtttgttgtcaaactgaatcagccgaaaaagacaattcgttcaccgaaatgctataaaatttctcggtatttctgtttgttaagtgcaaggctttagactgattatacctacgacatgtgtaccggcacagcgattttggaaaaatctggattgaccggttttagggaggtagggatccgatccggaaacctgtagtaagttatatagcgacccaacctcgcgcctatatcactcacgtttccctcacttctactcgcatatggacctcttctaataactgtatacctcttttaatctctaatgtatttattaatttgaagagtttttgaaaattatttgaatttatttttttttaaattaaagaataacattattttttctgaatttgtaaaaaaattaatttcattttaaataaaataaatattattaattttcaagttgttttttattaataatttaaaattaaaatgcattcgatttttaatatttaataaaaaaaatttccttatttattaaattttaaatcatgttgacctctttcacgttgttgtacctcttctaatcagatttgtacctcttttaatcacagttgtacctcttctgatcactgttgtacctctattaatcaccgttatacctcttctaatcacagttgtacctcttctgatcactgttgcacctcttctaatcacagttgtaccttttctgatcactgttgtacctctattaatcaccgttatacctctcctaatcacagttgtacctcttctgatcactgttgcacctcttctaatcacagttgtacctcttctgatcactgttgcacctcttctaattactgttgcacctcttctaatcacagttgtacctcttctgatcactg

SEQ ID NO: 32029 - DNA, 970 bp, Heterodera glycines
aaaaaaaatttttggacaaaaaatggttttctctttttttctcatttttttacccgcaaaagttggttccaacagttgcccatcttgtctggccctattcaaacaatctttacgatatttgaaacgcaaacaaaaaaaaatttcttgaccaaaaaaatggctatctcttttttctcattttttttaccgcaaaattcggtaccaacagttgcctttcttttgtctggccctatcaaacaatcttacgatattcgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaatggttatctcttttttctcattttttttaccgcaaaatttgtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttcttgtctggccctatcaaacaatcttacgatatttgaaacgcaaacaaaaaaaattcttgaccaaaaaatggctatctcttttttctcatttttttaccgcaaaattggtaccaacagttgccttcttttgtctggccctatcaaacaatcttacgatatttgaaacgcaaacaaaaaaaattcttgaccaaaaatggttatctcttttttctcatttttttaccgcaaacttggtaccaacagttgccttctcttgtctggccctatcaaacaatcttacgatattgaaacgcaaacaaaaaaaattcttgaccaaaaatggtttctcttttttctcattttttcaccgcaaacttggtaccaacagttgcct

SEQ ID NO: 32030 - DNA, 1680 bp, Heterodera glycines
aaaaaacaagggaaaaggagaaaaagataaattgggaataataaaataattttaaaagagaaaagaaaaaatttatagaaaaatagtcaaaaatggaaataattgaagttaaaaattttaaataggacaaacataatgccaagagtcaaaataatttttaaattaaaaaaaaacggaatgcaaagggttgaaataatttttaaatttgaaaaaaacagaatgccaagggttaaaataatttttaaatttgaaaaaacagaatgccaagagtgaaaataatttttaaatttgaaaaaaacagaatgttaagagtgaaaataatttttaaatttgaaaaaaacagaatgccaagggttaaaataatttttaaatttgaaaaaaaaagaatgccaagagtcaaaataattttttaaatttgaaaaaaatgccgactgaaaataattttaaatttgaaaaaacagaacgccaataatttaaataaattttaaatttgaaaaaacagaaagccataatttaattttgaaaaaaacagaatgccaagaatttaaatattttttaaatgagaaaatggggaaaataaatgcaagaaattggcaagaaataaatagggaaatttggcacaaaaatgtgcaaaaatttggcaagaaataaatagggaaatttggcacaaaaatgtgcaaaaatttggcaagaaataaatagggaaatttggcacaaaaatgtgtaaaaattggcaaaagaaagggttaaaaattgtggcaaaataatgcgaaaaattggcaagaaataaatagggaaatttggcacaaaaatgtgtaaaaattggcaaaataaagggttaaaaatttgagcaaaacaatgccaaaaattggccagaaataaattgggaaataaggggcaaaacaatgccaaaaaattgcggcaaaatggcacaaaaaacggtaccataataatgccaatctggcacataaataataaatggcgaaaattaatgggtaaatgggtaaacaaatgccaaagaaggaaaaaattaaggcataaataaatgataatggattattgattggcttttccttccgtaaagtgaattaaatgaaatgaaaatgaccaaatagacaaaaaatcaattaataaattgtttattgtctgaaggtgtcaaattacataatgggcatgcgggaaggagggcggcactacaaagtacgcgaccaatttaaaaaattgaattatttatttggcaccgttccaataaccccgcccaccttcataattgatttgtttatttgacccctcctcccgccttctcgccgcccgctctcgccccctgcccccgctggtgacgtcaattttgccctttatgagagcaaattaatgtttattgtccattgccaatgtggccgagtggttagtgcgtcagtctggccgccccccctggggttcggttccgcttggtgcggggaatttttggagaattttaaatgattttaaattcaacgtcttaagatgttttgacttttaagatgtttaaaatttaatttaaattaataaaataatttgcataaagtcgcgcagtcaaaaaagtcgcgcacccctgcaataggtttgggtttccaagaaaatgtagcgcaataggtttgggtttgcaaaaaaagtcgcgcaataggttttggcttcagtact

SEQ ID NO: 32031 - DNA, 1246 bp, Heterodera glycines
atgaattcaatgaattttcaaaagttttcggtccttattctattcgaaaaaaatttattaagaaaatttcaaggaaacaaaaacaaaacaaagatttttcaatgggttttctttttttctgaaatttagtaatttctttagagttaaaattcatgaaaaatgtaattttttgattttttttcccgtcaactttttgtcccgcgacgttttagggtgcacgagttttatcctatatgcttttgcagcacaaatttcttgaaaaatatatcttttggaaaaaattttagacaaaaatgtggcgatttgcacggcgaactggacgccagcctggagaccagtgccatttttcgacgccgattggacgaaaatgtggcacgcatggacacactgtgcacggaattgtaccagagcaggcaacgaaaaatttttttcaaaaagtttatactttaaaatttagggcccaaacgcagcaagcgttggacgacaaaaacatcatggcagctgaggtggaacggcttaaaggtttgaccatttcttgggtcatgaaaatgggaattttaattttttttttaatttggaaaatcatataccatttatctgcccccgtaacactttcgataattttttagttttcgccttttggggcaatttttgaaggtcttcctttcctccgaaatgatttgggcgcttataactcattgtcagctacagggatattaaatgggagctaatcctgaaactaaaaggctgtcagtgcccaaatttttctaattaaggcattaacagctatttaaaattgcaaaaatattaagttgccaacattgagatcgaccccaaccaaaaatttagtttttaaacccaaaaaaattaaaaaaaaaattctttcttgacagatgccatctttgcccaggacgagttcatcggcatgttggagggcgatctgttggtgtacgaggcccatgtgggcattctgcgcgattcgttgggcgccaccaagcgggaggaccgccagcacatcaagtcgaaggcgttcagcgccaagctgaacgcgctggagatggagaagcgggagattgcgaagcggaacaacggtggggttcaagtttactatttttttaattcgaaaaagattacgaatttttttttaattgcctgtcatatccccaaaattgcaaacaaaatcccaattcaaatccctatcatttcttaaattttaaataaaacgaactcaagggctaaactcccg

SEQ ID NO: 32032 - DNA, 1114 bp, Heterodera glycines
tacgcccttgttctgatttgataaaagttcaatccgtaatttttagttggcttctgaacgtctttcaaatgtgaaaacagtgaaaattttttcggccgaagcgaaggaacttcaatcgtacaaaaacaaaatcatggagatttgggaaatttccaagaaggaaggcacgaccaagggccttatgtttggcgggtgattgtctccgttttccgtccattcgttgccattgtccgtttcagtttccaactcaccggttacctcgcgctcacttcaatgctttactatggcagtgtgctgattgccgacggctgtttgacctacggcgatctctcttcctttatgctttattcggctttatgttttggcggcattactaatttccagctgttttatacggagttaatgcgcggtttgggcgcttcggcgcgtattttcgaacttcgcgaccaaaaaccatcgatttccagtgaaggcgagggttttttccattttggtttctcaaattatttttattttatttaggtggccttgtgattaatgctctgaataaggaagtccgattcgaatccgtcgctttttcttatttgaaccgagaatccatcttcagcgacattacatttcgcattcctaaggcatcggttaccgcaattgtaggagcgtctggaagtggaaaatcgaccattgcgcatttactattgaggtatttctttaaattcttgaccaggactgaagccatcggctggttgctcatcatttttcaactgtcccaacaatttctggccaaaacaaaaaatagaaacacttatttttgcgtggtttgctgatgcagtttggtcgtggttttttgttctcccagtttttaaaaatttaaatgttttgttatttatttaggttgtacagtccgactgcaggtcgaataatggtcgacgacatcgaccttaaacaattggacctttcatgtgaagaatggttttttggtttcatcccaacattgtttataattgtcagcttggcggagaatgatcggaactgtcagccaggagcccattctcttctctaccctcattcgtgacaacattctctacggaggtgagaacagccatttgataaccga

SEQ ID NO: 32033 - DNA, 1599 bp, Heterodera glycines
ctcccggccgaaggccgggagcgccctgaaagtagtctaccggtcttacaactttttgaggcgcatctagggaaaactataggttttttgctccggtggccaactgagtcccggcggctaatttctcacttttgcttgcgtttgaaggcccgtaactttttttaaaggaaagggagcggaaaattcttgctggtaggattttaagttgaagtgttttctaattttcaaaaaaaattccaggcctctagctatacttggaagggctgcagaaattggcaacttttcagtaccaactttgcccagttcagtccccgttgaataactcattaggctttgacctgagcgcagggtggccagcagacttattgtagagctcggtgagctcgatttttccagattttaaaatttcgaaaattttcaaaatttttcgagctaggcctaaaaaacggttttcgggtttttgaattttaggattttttaacgaattttcccagaaaaacgaagaccacttccaaaacatagtttttcgagctctatcgactggtatttttttcggaaaaatttcgattttttcccgaaaatagaaaaattttttggcctcagcgggacatttgagtcccgggcccataactggtcaggggttggttttagccaaaaagtgccttagaccaaaattgtagagctttttaagctctatcgaatggtgtactataagtctggaaaatttcaaaatttttcgagctaggccccctagaaattttcagaatttttttttgggttgaaaatgggggtgtaaaatttttttctggggtattttggggtgctgagcacgaatatgatgtttgtttttcgtttcagatttttttgaatttttttaaaattctttattttttgggaaatttttggccctcaggattttgggttaatattggaaaattcataactcggtgatggtttcatcgatttaactataataaagctttaaaaatagagaaaaataaggagaattttatgggatttatttgagttttttatcacaaaaaagaaaaaagttattccagaatttctggaaattttcgatttttcagaaaaaaattcagaactcggttctgaaaagtcatactgtaaaagtaaaatactacaaaaatccgcaatttcttgctctataagataaatttgcgcgaagcgcccgtcctgaggctgcgatgaattgctaaattaacgcactttctagcgacgcggcgaagccgcgtccctgagcgcgaagcgctttctcacagcaccaaaaaaaaactgttcacaccattgccaactgtgcaccctagtttatatatatatagagaaaaagggggactcgtcttaaaaaacaaaatctcccggccgaaggccgggagcgccctgaaagtggtggaagggtcttacaactttttgaggcgcatctgggaaaaatacgggtttttctctccggtggccaactgagtcccggcggccgatttcttacttttgcttgcgtttgaaaagccgtaactttttttctaaaactcgaatcaaaaaatgctgaagagcgagggcaccccgccaaagtgtcctctacatgct

SEQ ID NO: 32034 - DNA, 1008 bp, Heterodera glycines
tatgagcgctaaaattatcagagtgccgaaaatcgcatgtgatctaagcctagcaaaaatggtgtagtaaaaatcgtattacgctcaaaaagcttctcaaacattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaagaaatggtgtaagtaaaaatcgtaattacgctcaaaaa

SEQ ID NO: 32035 - DNA, 1432 bp, Heterodera glycines
ccgaaggtactcactcggcctcttcgcggccttgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcgagtttctgaaaaaaaagttaagcctaaactttttggcctgtttaaaaaggaattaaaaatttttaaaaattttattcatctccctttttgatagaaaaagcatcagagtgcctaaactaacgtgtaaataaaatttggtgcgtttcagaaccctttctgaaaaaagacc

SEQ ID NO: 32036 - DNA, 1332 bp, Heterodera glycines
tggcatcgaggtgatttttctttacaaaatttttgatacggtaaccatacccccccccccccccacctcgctggtaaatttttatgaaattattttttttatatgcattttaaaaattatcattttttgtattaataaaataaaataatggaaattaaacaagataaatgtcagaatctactgcaatgcttggaaaatgtggcatttgagctgacggagcatgtgtgccaactgccggatgtgccgtcatcgtcttcggtggaaaaggtgggaaatgaattttttttaatttttaaaaatcatattcggcggtgccaataaaaaaaggcaaaggaaaatttaatgtgtattttaggagaattaataaaccaattttttattttgtccaaaaaatggtcaacttttgcaaaaagtgtgcaattttgtgggtgatcgtgatttgtgaaggtttttgtttaacaagtcaaaatgctaaaataactgatttttagatttttttttattttgtattatttttatttactttttaaatttcggcatctttttttaataattttagaagaatttttttgcgaaaattttcgcgcaatatttattttgattttttctcaactcagtccctcttttggcacaggaagcgcctcaggtgcaatgcgtgcgcaaactgcaagcagtgattggcaagctgacacaacaattgcagcagttggacagtgccgaggagcgccgggcagtgcgggacaaatttgttgtaagtcaattataaatatttaaataacaagggaacatttcaaaaagagagagagggggggggagagagagcgagaaacagagagagagcagtcgattttaaattttttttttgctactacaccaaaaatgatcaaaaaaaagtaatcaaagtttcgaaaaaccgataaaagtgatcaaattttcagaaatttctaaaaaatattagaaaggagctgagaaccacaaacttttttaaaaaatgatcagcaaaagattgagcaaaagaaattgccagcaaaaaatatggtaattttaagcattttttttcaagattgcagaatttaagagtgattaatttttttatttttgtaataaaatattaatttcaatttatttggcacaaattacctgtataattaatttacttaattttttaagttttttcatacattgtcaaaatttgtttttaattactttttcaacaatttagtctcgctttgcaaaggagagcaggcaatgtttggcggcgcaaagcgggcacaaagagacggcggcgccggcactgaaacgatcgaaccgccgcgtggagacggtacagcg

SEQ ID NO: 32037 - DNA, 983 bp, Heterodera glycines
gttgattttaacgagaaaatttttggatattttcctccccctttaaaacatttataatttagttagtaaaactaaacgaaaatttatcaataaaaaatatgaataaacgaaaaaaagattaatattagcaaaaaatttataactaaatgaataaaaaaatttaaaaaataataaatataaattaataaaatttaaagaaacgaagattccacattatttaaattcacgaattcataaaacttaactaagatagtgagaagacttacgacaagtcatttgtgctttacaaaccaaagcgtacgaaatgaatataataaaaattcattgaaaaaattatctgaaaaaaaaacttaatcaaagtaaaatattcgacatataatttaattttaaaattaaaaaacattaacaatttaaaaatttattcaaattcaaaatgcattttttattaataaatgctaatagattttttaattaacaaacctaaaataaaaaacaaaaagtactattagatttttggaagttgatttgaaaaatcgtacaaattcgaaaatatttattatgtttatcatttttgttgttgtcgttttgtgctaaattctcaaaacttccaaaattttagtaatttattcatatgtttcacatttaaagataatttaacaataagtgtgttctttttgctcttcatcaattaccttttctgtgttcaacagaaccagagaggttaccaccagagaggttaatcccgaattattgacaagccgaatttcacctatgatcaggagtgattcgacttattaaattaaagcaattattatatgttttctattaaatatgatcgtttttacatttgcattttgacttttgcttttaaaaaattttttttctttttcttcccccttcgtgagggtaattcattaattctacaagtatttttttgtataatataattaattctattattttaaaatcaaacctatctgaat

SEQ ID NO: 32038 - DNA, 1252 bp, Heterodera glycines
aaaacaaaaataaatggaatgtttcaaagtgtccgattggggttactcaaacaatttgggggagcaaaaatccaacgcagaaataaagtacaggctatagggaaagctattctcgaaggattcggtctccccataaatctgggcgcatcggttcagggtaactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaataccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattattttttttaaattattttttgcatttgatcacccaacgttctagactgatcagaagctcaccaaattttgcagggaaactgctgagaaccctacaaatgcttataaattttcttagaattttttgcctggaggaacacagttcttcacacttaccacacaagcttaaaatttttggcctgtttaaaaaggaattaaaaatttttttaaatttattcatctccctttttgatagaaaaagcatcagagtgctaaaattaagttgtaa

SEQ ID NO: 32039 - DNA, 1134 bp, Heterodera glycines
gagaaattacgggttttataaataaaaggaaaaatttgggaggaatttttaatgcaatttgagcaaatttttgatccattccaattttgaaatttattttatttaaaattcgttctaatcaaattcagaaaaaaaagttcactacaaaacaacacgtaaaagatcaatcccttatatagtattacagtatgccctgctgttgttaccgtttcggtgtaatctaattcctcttgttcctttgaacaattactgtgatcaacagaagaattactttgatcagcagaagaattactctgatcagcagaacaattgcaaagaccagcttgttgttgctcatcattttcattttctaatgcttctccgttccattggtcggattcaatttttggcaattttatttttattttaaattattttcatttccatccaatagttcctttttgattttttgcgatacttttggctttatgttttccgtttcatgttcatcgcaattttcagatttaataataattttgttggcattttgttgttgataaatttcatttttaacagcaatttcttcgtttattgaaaaatttttggtgattttttgtttttttaagtttctcgaagtcgaagatttcaagtccttcgataaatcttcatcaattccttcggtaatgataataaataaaatagttaataaaattattattaaaaaaatcttcataaaattatttttttgcatttttttgattcaataaaacaaattattatataataatgaatattttttgtatgttttcgcatttataacacaaaaattgattttcaacgtgaataattgcgcatgaatacaatatatttatgataaaaaaatatatttaaatcggaattaacataaccaattatctcgaattacacctaattaattatgtgttatttttttatgcgaacttcttaaataaattaaaatcaaaattttgtaagaaaaatttcaataataattattaggtaacatttgttaattacaagagtgtaatgagatggtggttataatgaaaaaacaaagtttagaaaataattccgtttcatttaataaataatcatttttctccagaaaatttaattcaacagaatgcaaattttttt

SEQ ID NO: 32040 - DNA, 924 bp, Heterodera glycines
gcgcccgtttctaaatttgttgggctattaaggccgcttcgcggcctcagacgggcgcttcgcgcccgttttttagcttgttaggccgcttcgcggcctcagtcgggcgcttagcgcccgttatttaaattttgaggtacaaaagtgattaaaagaggtacaacagtgattagaagaggtgcaacagtgattagaagaggtacaacagagattaagaaaggtaaaacagtgattagaagaggtacaacaatgattagaagaggtacaatagtgattggaagaggtacaacagtgattagtaaattcattaaattaaaatgaaaatattttttaacaaatttaatttaaaaaatacatgaaattctatcaattaaaaaaataattcatttaaacttataaaatttattcattaaaaaaaaattaatttaaatataattttttatttattaactcaaaaaatattttaaatgaataaaaattgaaaaacacgaaaaaaatggtagaaaaataatgtacaccgcccggcttcgaacttcgccccccccctcaaaatgatgcctcagaatccccaatcacacggggattctgagggcttaacgatgtcataattgaaatctgatcacgtattcgtgatcagcggcccaaataacccctaaagagatgtttttggaagatttttgtcgaaaaaattttttcactcaaaaaccatgtgctcccccctttggtcccgaatctcaaaatcacttttaattttataaaaattcttaaaaaagtgataaaaatgtaaaataaaatttatattatagagaaaaaaattgcggatttttctaggattttacttttcccgaatagctttttagaaggcagctacaaatttttttctgaaaattcgaatttttccagaaattctggaataactttttt

SEQ ID NO: 32041 - DNA, 1576 bp, Heterodera glycines
aaaaaaatgaataagatgaatcattatgcagagagatttttgtttattttaataaaaaaataaaaataaaaaataaaatgagaaaaacattttcagaattttctaaaaataagatggatctagctcaatgtccaggctatttttcggcaacctgaatttttgtccaggaaatccgggtcaaatagggaaaaaaagctggtccaggttaggtatggaaaatctgaatttccttgacaatattttaattttttttgtttcgattacatagatttaaaaatacatatattatcattgccaattagatgccgtattttctcgattagagcccccggggctctattgttcaacccccccccccccctcagaaaggggctttattcgagaggggattctaattgagaggggggttctaatcgagtaaatacggtacattaggtttaaagcatcaattagaaaaaaaggattttggagccaaaaaaaataaaaaataaatgtttagcaatatttttttggaccttgaaatcgaatgttttttttggaaattgcctattaggcaccgccaaaggaactgaaatatttgtacatagaaatctaaaagacaagaaaaaaacaatgaatttgttttcatatatgtattgtttggtgaaatttccatcaaatacattggggacagtccgctgttgagccctacaaattttttaaaatgggatttaacaactgtgcttttcactccttccttatcttttactaggacacacaattgttaacagtttgggagggggggggtaattaatttttaatttgtatgggggggattaatggggtccaatttaaaattcgaaagggcgaagagacgacagaataaataatttgtttaaagtatgaaattaatgaataatgttcagcaatttacatgaggagcaaaatcattattcggagaaactgtttctttaattcttttttttcttccatttttatttttattttccaatttttgttggaaataaaattggggatttttgttttctgtttgtttcaccttaagataaacaggaaatatacataaattacatttttttttttgttcacttcaaatgcttaacatttatggccaagtgcctttttgggggaattgtccgttccttttcatgtgattaattttttctatttttggtgccccccccccttttccccctttttcgccttttcctctcactgatttttgtttaaaataatctttttttttaatctaccaataaacaaattctgtgaatatttttcaattgaatgtgtttggcttttatctgtccatgaaatgcaaaaatatttttacaaatattcaccagaagagaaaatttgaattggaataaaattggggggggggggcatacagttttaaggaaaaggtttttagggtttttatgaaattaaatttaaacaattattgcatgttaataggtggatatgcaattttgaaacggatcccccccccccccccgaattttacgccgcttcaaattttggttggacgacggcggcgggcggtctttgtctcgctccaaaggcgaaaataaaa

SEQ ID NO: 32042 - DNA, 937 bp, Heterodera glycines
gacaatcccgtgtttttatacaataactttgttcatgttcgaacaaaccctatctttttggtatcattcgaaagcacaaaatctgaataatgtaataatacgagaaaacaagagaattctaacatttcaagaaagttacaaaccaaaataatcaacaatgtgcttaattaatcaaatccgataattagcgcttttgggtctttttatgtggataggtaaatggggagaattttgggtctcgggtgatggcaatagacaattacagagaaaaattaatatatcgatgttttatgaccaaataatattaatgtcaaagttgaaatcaaaatgtgttgtcaagttttattctcattatcagacaaaacataatatttaaaaagaacaaatgacaaaattggaagttggatggatgtgccggccgcttattctttcgtactgttgctgattttgagggagaattattgctggccattgttgttcagtgccccttggaaaagatggatgaattaacagggagcagctcgtttccccacatgaatttttttaaatttaataaattagaaatttcatattaaggaaacattggaaaagtctaaattttaaattcaatttttttgtttgccaaaaacaacatgcaaattcctatttttcgtgttgtgtggtcaaggaaagaactgacaatgactttaatggaacaaaaggaatgacaaaccaccgttctgctggtcgaggggcggctgaagcccaacatcatcaaacccaagcaaagccggattaaaattcggattcggaggcacttctaaaccaatgaatgccattttgacacaaatttaaatgccttttcgggcttaaaaagggtgtcgccaaattttaagtaaaaccggagaaaaaaagaaaatttccgataaaattagtagttttatttgtaaaacttaag

SEQ ID NO: 32043 - DNA, 1242 bp, Heterodera glycines
acaattttcaacgcgataatttttcatccaccgcccctccgaatttaaatcctcttttttaaaatctcttttattcgaaaatcgcagaaaacatggacaatctaattaaaatcttcatcttaaatcttcgttaatttaaacgcaaacatcaattcatcataattcctctttctcggcaataaatcgtaaaaaaaaaattctaataataaatcaagtataaaaaatcgaaggacacaaaaaatacaattgaataaattctttaaaatacaacaaaaaaaattagaaaaaaaaacgataggaaaaaccttaaaatgtttaatacaaaaattttcaaaaatttaaatgagagaaatcacgcaataataatataggatatataatatagaaataatagataaaaaatcacgtaattaaattaaaaaatgatcttattatacccgaccaccacaccacacatacaaaacactaaacacccaccatgtataagtataatggaaaatttaaatgaaaataatctttaatatttaatacttttataaatttaatagtgcatgtaattatgcctaactctaaaaaaaaattttcaatttatttttgtaaaaaatacatttaattaataatacataattataatgaaactagaacttaaataataaaaattctttccttttattagattaaataatttatttttcaattgaaagtttaaataaaaataataaaatctattagcttgacttaagtatatttcgttaattaaataactaacatataaaaataatttattaatgttttttcataatatctattataacgaaataaaaactaaaataatgattttttaaatatattataaaattaaaggtaatataattaaaataataacgataaaaatactaatcgtaaatatttaaatgagaaaactctatgagaataaaaatcattttttaattaaacagtagctttttaaatttatcttttcaaaaaaaaaattatatatttatttgcatcagtcaattcattcttttcttaatataaacggactttacaatattcttaagtttatataaacattaaattgtaaatgacatattaagtttaagactttaagactgtttatacataaaattaaataatattaaagcattgaattattggtaaaaatcgtagaatattatgggcataataataaatattaaaatgaaaagaacacagatgtgacacctccgcgaatggaaacaa

SEQ ID NO: 32044 - DNA, 1751 bp, Heterodera glycines
  misc_feature (866)..(866): n is a, c, g, or t
tccttcttttccattcggacaaatgggccgccgctttttcttcccgcccccgacgccgccgaagggacgcagaaaaacggccattcgcaaccggaacaatcgccgccccctcttcgcaattcggcgtaaaaaggcgggaaaagggcgggcgccgaaattcggagaaggaaacggtcgctcaaagagaagggaaatggggcgggcataacttcacgggccaactcacggataacgaaacgccatccgctccaatcggaccaaaatcggcatctcgtttaaataacggcactccgtccatcccgtccaaagagtcactccaatcaaatgggcactcccgccccccccccctccccccctccctctcttctctcattagtctcactttttctccaacattttgtcgctgtccgtcgccttcggccctttcttcattccaattattttcaacagccgttggtgcgaatcgtccgaaaaacccaccgaagcgcccctctgctgctcctttctcaccggtgccgttggaaaccttaggccaatcgaagcgataaaaagtctcttggctttttccttggcttttccccattttcccactgtttttcgatgaatcccttcgcattatttgtggccacattaagtgatcggcgccttttctgcagtgcctgcgcattttgctggcgaagttcgcgattgatcagcgcgtaaaggacggggttagcggcggaattgaaacagacgagcaaatgggcgacgaaaaacaccgaactgagcgtcaaagtggaccaactgacctgacaaatttaggaggataggcagaggatcatttttattttattttattagataaaatcatttaaattccattgccnaacatggctcagttggtaatgccttccctttctgcgtatcgggttcaaaccccaaccaaaacagtgactatgatgatacttttctgcagttatgacaatttgattgattaaaattaatcgcacagatttctgagtcaccacaattaaatgaaaaaatattttttaatttatgcgaaaatgccgtgcctaatatttttcaatttttaaatattgaagttcaattacaatgataatgccaaattgggacataatgttcagcgtccagtagggagtccaacctaaaaattagagggagggggtaattaagggtaaattaattaaataattattggctgacttacaaaggaaataaaatagaataaccgccacaattcgtttagttacctaaacaaaaagagtgaatattttttagcattttaatttataattttggcgaatggcaaactttgtgaaaccgcgcggaagacagcgcccaattttgcccgtcggaatgctttcgcacggaaatggcatcggcacggagtttgaggatgacgcgaaggtaaaagaaagtgatcagaagggcgggcaccaaaaagccaacgccgaaagtgtaaagcataaacagaggcgaattggtatctgttggggggacttttgaaacattcaaattttgaagattagcaatctctccaaattatgtcccaattcccccgaaaatccccggagtatcaaaggcattctttgcaaaaattccattcaaaatgattaatatgcaatcccaaaatgtaatgcaattaccgaaaacacatttgtgcacaatcggctgttgttcaacaacaaatggctccgaatagcgctcactttcagactgaaaagaatctgtggggggggggggcggggggg

SEQ ID NO: 32045 - DNA, 1166 bp, Heterodera glycines
aacacacgcaaattttacctcgctcattccaaaaacggacgtaagcaaacttttgggaatgacaaaggagaagagaaccttttccgcttattgagtgaatgaatatgctaaatgccggcggcgatgctttttgggatgaaggggaaaaaggtgggagggagaggaggaagggaggaggggggattccgtttccatttccttccgttagcactttctaatttaggccttccttccattttaccctcccttcctaatttaggctttccccttaccacccattgttctgcttcccttattgtccccccccccttcccttcgttttctgcttcatcctttaggctcttcctatttctcatgttcttccacttcaccttttctctctctctctatccgtgcatcctcttcttcctttccctctcttcccatgctttccccttccttcccctcctctcttcccatgtgccctctcttttcctcacttcttttcttcctcctttttgccccctcccctccccttcaaatgtttgtgtaaatgtgtggcggagcattattttatacaaataaataataaatacgtagtcgtcccggcgtctcctcgtctataatatggaagtgaaagaagtggttgactgacaggctgatagataaaaccaaccctccccacatcctttgcctcctcgccaattttgtcggaggccagaaaatagtgaggagggcgagtttggggttaagtgaaagaggaggaagaggaagaagaagggaggagaggaagtgatgaggaagaagagaaaggaaaagggaagggcatgaatcggtcggatgaattgagaagggacttcacttcgtctaatccattggattaacgaattgattaattaattactaattaatttgctaaccaaaacaactaattgtaaaagttgcaatatttctttatgctacttaaaaattttaattaattaatgtcttcattcttccatgcacattttcgatctgtcagatcactcactctcttactaccacattgatcactccgaccacttcacaaatcctttcaatcgaatcaatcgccctccccaaatccaattcatccgccgaatccatctgttatattcactgcgccaactcactcattcatctctctcctatccgtcaatccatttcca

SEQ ID NO: 32046 - DNA, 1782 bp, Heterodera glycines
tgcaggtctttatgtatttaaaattcaaactcataagctccattttgctatttatgataaaattaattttcaaatttaaaatattaatcaaagtaaaaaaaagtcagagataaataaatagttacaggaacctcatgagaatcattatcttaacacattattactcaataaaataatagagaaaattttagtttgcaatcgcagaagaattaatttgaatttgcattgatattgctttgtccgtccgtggtaggccgaactgacaaaagtatcaagatagtaatatttaaacttaattatttattttaatttatttgctaaataataaatcatatctataaaatttagtttggggtaaaatagtcaaacataaattgccagaaataacaaatattttcaagtgctgattaattcaaaaaaatataaattgaattcaaaggtaaataaaattattagttaataaaaatttaatcatttttattctatatttcatgtggtttaattttattacttgcaaataaattaacaattgattcttcttttattttcatgtacaaaaaacgggttacaaaaaacggctttaattccagatgaacaagatccttcaattgttattaatatgtaataatgataaacttttttcatttttgaattaagcttaattttaatttcaatgcaattcatttttttaaaaatcaatgatttcataatagaaatgccaaatgcaagtaattttcaaaacaattaagaattaatttcttattaatttacatatatgaaatcgttaactcatttaatttgtaaattaaattagttaataaatttttattcatttttacttaaagttgtcttattgaatttataatatgattttattttggtcgttttaaacaatttatgtgtttaaaaatattttaagcagttttctatttttattgctatataattgcctgcgttgtttacaattaatgaaaaattccaacattgttcttaaaaaatttcagcatttttaattattctttatggcattatattattttgcttaatgtctttaaatattgaagaacttaaatatttcaaaactggtattttttaataaaagatccttagtatactttccataaaaattattgttagttattcattttaatataaaatttaaaatgggtatttaattattttaatagttttagtaatatgcatttctgaaataaatactttataaatttaaatattaaataatatattattagtttaaaaagttgtttactttcatttttattttgattataatttttctcattcttaaattaaataaataataatttacaaaaaagggatataaaatgtatttttttacttagtattctcgccggatttcaaatttaattcttttgaagtaatttttattaattaatttttcatgatcattatcgagtttttttcattcatcaatgcgtttttatcttcatattgatgaagaaaaagtttttattacttttattttcaataatttctcaatattttattataaaattaaatttcttattattttctcaaattctttgtactaaaacacagaatatttatattatttttaattaatatattaaatttcttttaattctttaaaaaacagatttattatttgaagtaaataatgtaatccatttaataaataggtccaaaattttcacttttaaaaattttatagcttttaaatttttaaaatttaaattaataattcgttcaataaatcaaaaaacaacaaattaaatttta

SEQ ID NO: 32047 - DNA, 825 bp, Heterodera glycines
gccgtcgttttcgcgctgtcgttttcgcgcgggggtcgttttcgcgcccgcgcttttttagcactaaaattgcgaatatacttaaaaaatacttagaaaatttattaatagtctattaagtttaaaaatacctaaaaaaccaaataattttttactccgcgggtggatccgaacctgacctcaccccagccggcttcagaatctcagatacgcagggattctgaggtcatagcgatgtcctaatggaaatctgattagagattggttatcaacggcataaattttctaaaaaaaactattttttgaaaaattctgagtgaaaattatctactcaaaaacaacgtgcctccccccgtggtcgaaattcgaaaaatcgttttattttatttcgtacataggctaggcataagctttagacctaggcttaggcctaagctaggcttgtttgggcctacataagattaggcattatttagtaaaaaaaaaaaacacgaatacacatatttattttacatatatgcaaccgcgcgaaaacgacagcgcgaaaacgacggcgcgaaaacggcggcgcgaaaacgaccccgaccgacattttcaaacttattttttctttataaatttttaaaatatgttaaaaaaatgaaaatatgtacaaatatgtaagaaaatcccgaaatatgtaaatatgtataaaaaccccgaaatatgtaaataaaagtcccggtttttgttcgcaaacacaaaaaagaaagtgtttttcctgtatttagagcaaggagaagccaggaaaaaaatatgtatttacataaaattggcagccctagt

SEQ ID NO: 32048 - DNA, 1641 bp, Heterodera glycines
cccaaattttttttacagcttacttaggcccaaataagcttatttccagaaaatctcgcatgaattctcattttaaatttttttatagatttttaaatgtttggatttttttttggcttaacaaaacttcatcgaacctggttctttctatttctctttcaaatcgccccaaatttttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggattttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcaaattttttgaaatttttttaagtgcaaaagtggtgggtgtctgcaaaaaattttcaccgggtttaaaaaatctaggaaaataagtaagtttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcatttgtagtgttccgatacgtatctctgcaaaatttagtcagcccctgatcaattacaaattatttatggacgatcaaattttttgaaattttttttagtgcaaaagtgggtgggtgtctgcaaaaattttcaccggggttaataaatcctaggaaaatagtaagcatttg

SEQ ID NO: 32049 - DNA, 1298 bp, Heterodera glycines
agaccaattctagcctaaaagtagaagtcctactgattcagtttattcaaaaatttgtggtcaggaattttattttcttaaacatttgaacaaattaatttgattacctttttttaattaagaattccttcatgcttttaattttgacatttcccatggaagaaattttgtgttttttcaaaaattccgagtccctaaaaatggaacctgcatcatcatatgtagatataccaacaaatgaaattcatagcgaaattccaattttaccaatgtaaaggtgtaccataaaactatttctgatcaggtccctgataaaatatgactaataaaacccgtccaaaaattaatgattgttcagttcattcattagttaattaggtctatttaaactaattaaattaattgttgatcaatttgtccgataataaatcaaggacaaattttcgtacgatatatcccaaaaatccagtctgtgtaatagatcaaaatctcaactgattaccacacacacccaaagcccaacattccccattttaattgccatgccactaaatttgtgccccgttgttttattgcctccgccgccgaccaaatcaattatatgcaaaattgggtcctgcatcagcagtacttgcgcaggtagcccaataaatccccagttttattagctttgggctggcaaatttggcatatttttggacaaaagtttttgaattaaatttattaatattttaattaaaaagaattaaaatattttttatatttgaaattatatttccaaaatattcagtttttaaattaatatatatttaattaatttaaagcgatgaatctggctaatatattattgttttttttatttctgaaatttaaaaacattcatataatgtaattaggcagccttaataattagctgattctttttttttcaagtttctaataacattatatatttgtcttactaattaaaaatttattatttatttctcatattaacagttttttatttttaaaatatgattttatcaaatacaattcactaaaacttaaattaataaattgctaattatttgattttgctttatttgaaatgctaattatattttttgttttcttaactaattaatttttaatttttttaattccttcctcttttctccaaattgaataagatcaaaaattccctaaaatttttatccattttccgctcaaatttattaacggaattttgcacttcgcccactgaactttcacacctaccccacatcatcaacaacagcagaaatgaaaactcgtct

SEQ ID NO: 32050 - DNA, 2284 bp, Heterodera glycines
  misc_feature (47)..(47): n is a, c, g, or t
  misc_feature (53)..(53): n is a, c, g, or t
  misc_feature (72)..(72): n is a, c, g, or t
aaaagctcgggaatatgtttcattacttttgatgacataaaatgaanattttntcgacaataggagatgccnaaggcttacggttactcgctctaattttggtttttccatctccaaaaacattgcatttcccgaaaattgccttttttttatcccatctctaaaaaatgccatcaattttcaggcgcagaatttgtgagcgcatgaaaacagtgtcagtggcgctggtgctgtgcctgaacatcggcccccgacccgccccgacgtgcagaagccgcagccgtgcgcgcgcaaggaggcgtgggtggacccggcggagccgagcgtggcccacgcgcagcagcggccggcccaacgcattgcgcaaagcctgcagaaaatctacgaaaaattgcatccccgagcaaggttcaaatctttatttgttttttaggaaggtggacaacataaatatgctttatattagagaccggacgggatcgggatcccgcgggatttcttcgggatcccgcgggattaaattcgggatcccgacctcgggatccgtcccgaacgattttcaaattcatcgggattgatcgggatttcatcgggatcccgaagcgggatccctcccgaccattttaccaatcccgcgggatcccgcgggattgaagtcacgataatttttggaaaaaatctcattttttaaattaagaccttaaattttaaattaaaaatttgcttattttttctttaaattcccttaaaatcccaaaaaattttcatgagtctcaaaatacttgtgaaaattttcaaactttgacacaaaggttggccattttgtgacttttattcctttaaaaaaagaattatcaaaaattattttttttaattccttaaataatattttaaatcttattaggtagtttcatgcacaacaatttctaagaattttgtctaataaattagattagaaattgttgtctaagtatttttccttcggtgcataacggcaccgccgggactctaaaaattcttaattttaatgaaaaatttgctcaaaatcgctaaaaaaattggggttttatggacaaaatctgttaacaaatctcatcaaaaattacaaaatttttcccgtcggtgcctatcggcaccgccggggcccccccttgttcccctaaaatttttgaaaaattctcaacaaacaattctttaaaatatgattttttgattccgatgcacttttggatttgctaattatcctcacattgttaaaactgatcataggaggcgaaaatacaaaaattgatattaattaaattgtaaaaactatttaaagttatgttaaatgttctaatttttggtcctaaaatctgatttttaggcatgatactcgctcgaattttgaaaattttctaaaaacgctataattcccatccctatttttcttcaatcgaattgatcaattaggaatattagataagcatttgaacaaaatttggcacaaaacgtaaaaaaaaattggattttagcaaatcccgataatcccgcgggatcccgaaaaaaaatcttcgggattgatcgggatcgggattcagtcgggatcccgactcgggatccctccgaccccagtcgtccggtctctactagcaacacacaaaaaaagcattttgattttgtttaaaaaaaatcaatttgcacttaatttaggccattgtctgcgccagaagaagagaagtaggacaaagcagcgaaaaagggacgtcttttattttttctttgatggcaccgcccgtcaaaaaaatgaaaatgttttcttccgacaaccgccgcctcattagtgaaaaacgacagcaattgttggggccacttattgaatcagttagaaatcggtgaagttcttgatttatggggaaaattaactggaaaatgagtcggtaatacctatactaactaattaactcaacagacaccgaaagaaaaccggtgctaggtcgaaccaaaaaaaaactcagtaattgataaaataattaaatttaattaatcgtttcaccaaattcatataattatagtctcctcaattatttgtaagtatattttttaaattttatattgataaaaatttaaaaaatgaataaaatttttaatggaccaaaatggcgatttaaaaaaaattatttatttatttatatttaaatattaatcatataattaaatttattgataccaatttaaataattaaaaataattattttatcaatcgctgagttttctggatcgactcagcacgaagaaaaacat

SEQ ID NO: 32051 - DNA, 989 bp, Heterodera glycines
ttttgatactaaagcatcagagtgctaaaattaagttgtaaataaatttggtgcgctttagagcactttctgaaaaaaatatttatgaaacaaaaaaatcgattttttcaagtgtccgtttgggtactcaaacaattattgggagcaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgca

SEQ ID NO: 32052 - DNA, 1448 bp, Heterodera glycines
tcgatcgaattttcggtgtcggagagggcgacgatttaatggatgatttattcgaaaatctttttgaaaataattcacaaaatttgaaacgattgaaatctgacgaacaaccggaaaagcagcaacaaaaactgagtgtaaaagctgaacaaaacaaaaaatgggatgaatcatcgcaaaaaatgacgaaaaaattaaaaattgaaattaaggaggaagaagaagaagaagaagaagaatggcacacggataaagtgccaatgggcgaacaaattcacaaaatcaaaagcgaaccaaattttgatcaaaatgaaattgccaatcggacgcaaaaattaaaatttgtaaagaaagagccaaaaatggaaaatgatgaccattttattagcaatgatggcactgttcaagctgaaaatgaaagtgatcagcaacagaacgagtgttcttcaccctctcaaaatgatcaaaacgcctcttctgatcaatcaatggacgaaaagcaagacgaatcggaagatgaaagaaagttgaagcaaattgaaaagtttgacaaaatgagaaaggcatattgggccaaaaatggccataaaagagaagagcgaatgaaagtggaacgaaaaattgccagagaaatgggcatttatcgaacacaaatttataaatggaagaaggaattgggccaaaatgcatatgacaaacgggaaagtgaggagacaaaaaagcggacaatttatttgttcgaagagataaagcagcaaatgaaggacaacaaattgtacatttgcaaatatcggaggaaaattgaacagaaaattgccataaaattgggcacttaccattgccaaatactgaagtggaagaaggagtttgtgatcagcagagggagaaaagtgattgaagaatcggaccaagatgatcagtcttcttctgcggatgaggttttaatggtactgggaccaggggtgggcgaaacttcggcttcggcttcgaaaacttcgggttttttgagcttcgaactttgtgcttcggcttcggctattttactcgaagtttcgggaaaaatacacccctaaagattgagttttcaatgtgaaaatgcacccttagtgatgggcttttgataaacttaaattaatatatatttattaattttttgttttgatttttttgttcacacgcatggtcgagtggtagtgctctttgctcttttcattatgtttctttggatcagttcccatccaagtactttcttttcttctaatttttcaaaattattcttttttcgacggaaatttaatataaatttaacaattaaaatctaaaaatcttttcatttttgaactaaatctgtcactaaaatttcaaatttttcccgtcggcgcctatcggcaccgccggagttccaaaattccctttattttttaaattgactcaaaaactgtgagtat

SEQ ID NO: 32053 - DNA, 599 bp, Heterodera glycines
actgtaaagaattcgaattgttttattcatcacacgaattccaacacaaaaaataaactaatgaaaggagaatttctcaaattttatatcttcttaaatcagggttcggatttgaaatgctataactttttttttgaggttttttggtcataacttttttgtaaactgacgaaattttttgaaattttacaggctaatagagaatctgaagagctatcgaatgataacaaaaatttttaatttggttgatcaggaaaaaagttgttaccaacggcgccgaaaaggccggcgccgaagtgggcggttccctttaatacagggatgcgatctgttctgatttatcagaaatgttctgatttggagggtccaaatctgataaaataaaaatgttctgatttgcagaaatgttctgattttggggtagcgaccaaaatttgttctgatttcttaaacaaactcataattttaaaattttatggcctaattaatgtcactattttacaaaaaaatataaaatttatggcaaaatttggtcattttttggacaaaaatctgttaacaaatcaaactaaaatcacaaatttttcccggcggcacct

SEQ ID NO: 32054 - DNA, 1696 bp, Heterodera glycines
catgaatgcactgattgataatgcttttccatccaaccattgttactgttttcttgttttgtttgctgatcattcgtctcccgtccgtccaaaatggactgtattctccccaataaattagcaccaggtggacgatgacgatgttcaaaacatcatttattccccaaaaatatggactgatggaccacccccccccctccaaattgaccaccccaaaaagtccattaatggccgccccaccatcattttggctcccgaccactgcctttgaaaggtgcggcgctaattgacgctaatttatgccattttctgctcatcggcagatgatgatggatgatggaatgtaaaaggtgtgctgctgacgtgtcgcatcgcacaatgaaaatttgaataatgcctttaatgagttgttgttgtccatcacagcagaggcgcaggtggtcatcgttgttttgtgagagactcattaattcataataattaaaatttcaaaaaattaatcgacttttcaagcaactatgtaaatagaagacaattaaattaggtagcacaatttatttgatttgctgcttttattaatttatcatgaaacttaattttgctttttttgtcacccaattttcggttttactttacttggaaaacattagaaggatgtaagttctaattaacatgaaaataattttacgtaaattcataaatttttatgatcttttggaaaaacccaaagggtccccaaaattttggattttgtctaggcgcctatgcatacaagcaataattataaatgaatttttcttttttaaattaaaattaattccttttttttctctcaatattgcaactcttaaacatttccaaaacctctcatttattatctttttatgatcatcatcattcttcttctctctgtcatccattgttgtcggcggtgcacacacacatcaccatgttttgtcggttatatcttttggtcttggccaacagattttaattggagataagccgccctcgagggaggggaggcgggctaaatggccccgacggcacagcaacaacggcacggtaaatgtgggtcatctccccccaaataatgagtgagagggacagaaggattagcggcgggaattggaaatggacaaggcggaacatcttcaaaaaaagccatattttgggagtggaacggagggggcacaaaccttaatgggtctcataatcccgaactaaaaccaaaaatttcgttaaatcaaaatccaacttagtttagctaatttggtacatcgtgaaatttgatattcctgctggttttggaaccaggaattttgtcaaagaaaatccatttgccctaaggcaagctggccgcaattaacaatatgccgatcgagctttacagtatcggctaattatgtatatctatttgttatgcccagaaaacgtggctaaaaaatcgggtttttgttcgaaaattctaattacctcaaggaagctttcatacttagataggtgacgaaaaatttagtaaatttcattaccatataatttttaaaaattcatttaaaattttttttgactttttaatctcttttgcgttaaaaaacacgaattatatttgttataaaaataaatatctttataaattaatggattgttaaaatttccatgaaaattttgtctcataatcctttcattaaaaatt

SEQ ID NO: 32055 - DNA, 1349 bp, Heterodera glycines
tcttccagagccaacaaccgcaccagcagggcaagaaaacggtggacagcggcttctgctccggctcttcagggctggcactgtgcagcggagggggcgtgttggcaaggagtccgcccggcgccaatttcatgtttggcagtttttgatccccgactcccacagcacacaacatttgcacttcgttctttggttacaatgtgccttcccttctctcttctcacaaactctgctttctcttgacgacttattcctccgccgatcccttcgcggcaatcaacgggccagcttctccacttttacagcaacttgtgttcgcgtggacgcaattgtggctttccaacgcggcgggggaatacgtctctctttctctcgccccttttgtttccatccctcgctctgttctctcgtgggcgtcactctctctctctctctcgccctttgttgcctgtctttcaatcaaatggtaaatccttttagctgatcaaaaagagctttttttcttccgtttcatgctttccttcccctctctctctttttctcatacatgctactgtacatctgtcctacctccctttagatcacaaatcagatcagctacccttttcgtgtgaatgtgtacataaataagcataccctcccttccgttagcccccctcccaccctccgtaactcatatcttataattggttgattgcaataatttcaacaatgtgtacatatttacatttcaaatcacaaatttattccatctgattaaatcttttgtacataataatatttattggcggaggcgatggaaagattaaaataacttgagattcgcaattggttcgctttctttccttctcctccccaagcttcgcacagaatgctcagtgcccgtttggatattcttttctttcgaatcccacaccttatttatacgtttttgttgttttcagtctatgggacaaacccattaaatgatgatcgaatgaataactatattatttatacgttgactttttgattgtcaagttataaagacaaattcggagctcaatcggctttttgttagtagcaaaatgttaattaatggatgtgctcctaataggcttttatgtggggaagagagaagacattctaaattagagaaagcaaaaaggcatacacatcatgtaggagctaacgaataagcgtatgcaaagggtggagtggttttttgcacattcagtagcggagagatggacggggtcagctgctgaaaaggccgtttcactcccctgctgctgttttttgcgaggggagagaatgggtgcgtgggggagagggggcggtgggaggaactcaatagacaattttttata

SEQ ID NO: 32056 - DNA, 1599 bp, Heterodera glycines
aattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcccggaggaacacagttcttcacacttaccacaccagcattatttttttttaattattttttgcatttgatcacccaacgttctagactgatcagaagctcaccaaattttgcagggaaactgctgagaacccttcaaatgcttataaattttcttagaattttttgcctggaggaacacagttcttcacacttaccacacaagcttaaaatttttggcctgtttaaaaaggaattaaaaatttttttaaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttt

SEQ ID NO: 32057 - DNA, 1080 bp, Heterodera glycines
gagtcattggtattctgagcaggggcgacccgtggatttcgtggtccgcgatgatgttgttgacacgtttgatttcggagacatgacaatgagagaaatatgcgatgacaaatggacgaaatgggggcacacatttccatggctaaatttgtaagtgagtgaacaaaagttcgtcgattttaagggttcggtggcgactccaacaaataatttcagtttaattattgcaaaaactaaaattttatgtccaacaacgaaccggcactgaatattgcagcgaaatttgcatcagactttccccgttcttcaccacatgttcaattagtggcattctgccgccgtttccgccactcgtcgtgcaattgtcgttccgatacgccatttccgttccaccgattgggccatgcattttggtgtttcgcgaacgcaattcaacgctttccgagtggacggacgcgtcatcgaccattgcaatgctcattttaggcaaaacagcggaatgggaataattgttgggcgaaaacagctgaaaaagtaacggaagcggtggtcgatcggtttcgttgctgtccatttgggataattggaattaggaaaatgatagacgattaaaggagggagggagcagaagaagaaaatgaacgattgggacaaacggaggagatggaggaaaaagagaagggaggggggggggacatctttaaccattttttgacatcttcattcattcattcattgaatgaatatgtgttatttacctattccgtcttcattttctctctgctgaatgaacgataaaagtccggtttcgttcttccctttccttcgttttttctttttctttgcattgggaaacagtggagaaaaagagggaaagggacaacaaattgttacttttttaaatgagggaaaaatgcgaaataaacgaaagattcggagaagagaacagacgaacgaaacagaacaacaaattggttgaaagtgaaatgagagggttctgaatacgaatgtgcagcgtataataaaataaaagcaattcctttccattccttttttcaagtaaccaaacgctttttttgc

SEQ ID NO: 32058 - DNA, 910 bp, Heterodera glycines
attcgtgatcagcgaccccgaaaaccccaggaagacgtttttgacgaattaaaaaaaaaattatttttttttgaaaaaagggggggggggcaaagcacactattacccaaatgtctggggcgcaattctggggtaaaatgcattcttaagtcattcggatcaacgaagtatattcgatggtttacccagcagtaatcattgtaaaaaacaaagtgaaacttataattttaactggtgtaaaataattatagccgggatttctagtgaaaaaccttttttttttgctcaattgttttgctcaaaaaacgcatttctgcgttgaaattttcttgtattcgctaatttaaatctttcgaaaccattagccaagatataagcaaaaagatcgacccttcatgaaatcggtcccagtcccggattatactgctttactttgtgtatttgcaattttaggctgacagtttgaaaaataaaaattgggctcaaaactattaaaaatgattggactcataaagtgcattagagcccagtttttttggactttatgagcatttaatttttttcttagaatttcattcgaattatttttaggatgggactcgacccgaaagtgctcacttcggtgatcaactccagctcaggccgttgttggagcagtgacacgtacaatccgtgccccggcatccttccgaatacccccgccagctccaattacgagggcggattcggctgcaaattgatggccaaggacctcggactggcgcagaattcgtccactcagttcaaagtgccaactccgatgggttcgctggcaccaaatttaccttttgctctccgctcaaccaaaattcgcgaacaaagacttcaccgtggtctaaaaaatgttagagggaatggcgacggaatccaa

SEQ ID NO: 32059 - DNA, 1524 bp, Heterodera glycines
  misc_feature (96)..(96): n is a, c, g, or t
gaaatatataatattggaaagatatgttttctctctgtctttaatgtaagaacctgttaacgaatgatgatgcaaaaatcaaaatggcagcattcncaattttagcataatttattcccccctttttcagtgcgttggcggaaaaaaatcattggctggagggaccaaaaaggaaaagaagcacaaaagatcgaatagcttcagcagttagaagatccaatgatgccgcttcagtacgacgaatggaatggccaacaaacagtccccccccccctcacaaaccgttgatatcccccaaaattatcatttgtttatcacttccttaaacaaagtttttgcgccttccatacgatctgttctattgtgtgcacatgtatgtacatatgtctggtccaatgtaactccgtttcataaatctgtatgtaaacttgaacaataaatgtttttttatcgcgatagatattgtaaattttgatggtttataatacccaagacttttctcgagcgagactagagagtcttagcactgccccgcacatcgtctcttcgcggcactgcctttttaacaaatgctctcgatttttcaagcaatttttttcacaaaattttgccaaaaaaaaaattattgtaaaaaaattttcggctggccttacgacagattttgggtaaaaacaattttggagaagggatgactttaaaagacaatctaccatccaatttttaaaaattttctcagtgacgaaatgatagggagccatttttactgggggacattttgactaattttggcttgggggacatttcgacgcagggacattttgacgggcagcgcgttcatctagccaagagaccgaaaattttcaaatcacggagattggaactcaaatttttttttgggatgagatcccgcgggattaatcccgcccgcattttcaaaaaatttcaaagcagatttgtattcatttattgtgcactcataaatacattacattaacatatagggagggtacagatacaatttatgagtggttgcgtcaaaaggcattcgatacattgttgtttgattcatcaatcgtttatatatatatacaagcatacacagcagggatgggccgaggtttcgcttttcgcatttcgcctttcgcattttttggcgtttcgcatttcgcttttcgcatttcgctttttggcgcgaaatgcgacttttacacccctaagaattggattaaattcccacaaaatttttcaaaattttacctataaattggctaattttcagtgaaaacctgtttataaatgaccaaaatttccaattttttccccggcagcgcctatgggcaccgccgggcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaa

SEQ ID NO: 32060 - DNA, 2170 bp, Heterodera glycines
ttgactaaattttaatgtaaatttttaaaatgttgatatgcatatttatttatatagataatgaaaacaaaaaaatattttttaggttttatataaagtttttttgcagtgaaaagtgtatatctgatggaaaataggtccggttagcaccgcgaaaaatttcttcttatttcttttcttcaggatgaatggatgggaagaagcgataatggactatgaaaaaaggaaaacaaagcgaaaaaattggtttctggaatttgaaaggcgatggatcaggatgcacattcgtatgatgagtaataagataaagaaaaaaatgttaaaaaataatgaaagcaaaaacaaataaagtgaataaaaaaagcaaaaaaaaatccagaatatgaaaaaaagtacaatttggtagatgaatgaattatttttcaaattctaaaaaataaagtatttttttatcgaatatacatatcatttcatggttgcttaaggcagttattttttaaagaatctatcatttttaggttagaatgaaactacacggaaaaaccgataatttaaacaaaaatttgcataagaaaaacctcccggctgaactactgtttcaaatttttacttttgttccaataatcttattatttggagaaactagaagaaatgcaggttaaagtatttggtttttaaatgaattaatgcttaaggtaataatgtaacaaaggtcattgaaattatttgtcggcaaattgaaatatttcgaacatatcgcaaacagcaattaaaattcatggttaattttcattattacaaaatcattttccattttagatgaaaattattaacaaagttcaaaaaatgtgtcaggtgaagactactggattgattgaatatgaacaaaaaattggttatttctatttaaatgaagaaatatttaattcgagtgaactctttttatttctttgttttgtaaagtgttttaaaaattatccttatggtattatcttattgacagcggtatgtatgtattgataatttaatttaaaaattatttttttagtactgtaatgtctagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaaattttctggtcgattcttagggatgtattttttgaaaaaatttttgggtcggttcttaggggtgtatttttcttttttattgcatttttgttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgttttaggccacggggagctcaggaaaaaaatatgtaaaaacctaaaaatcgaagccctactagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatcctagccctaataatcataaaccagtgcctcaaataagttttgcaaaaatggacctcctccataaggataatggtgaaaaacgggctaaaaaatccttcccaagatgtggatgatgcgggaattgaccaaaactccctagccaaaaaagacaaaaagtgaaattttttttaatttttttttccaaaaatcaa

SEQ ID NO: 32061 - DNA, 1450 bp, Heterodera glycines
tgccacaggacactttaggagtacaaaaacaaaatccgccccctccgggtgcgcactttggacggaggggcaatcaaaacagtttttgtggacgaatcgcagcccgtttcgcagctgatggtggtgatctgctccaaaatgggcattgccaaccatgaggagtactcattggtaaggggagcatcgccggaggggacggacagcggagcggagaacggaatggccaagggcgaaagggaaaggacgccgtactcaaacggcggaacggacgaagcgcggccgaaacagcgcagcgggttggagcacacgttcatgaacacaatcggacggaagaaggagcggcaaattcagcagctgaggtgcaaagccatgccgaacattgggccatttcgccgccttaattaagggccaaattgcacacggacgccgaaattaattgggtggactattccaagaccctcagggaacagaacatcggggaggaggaggagctgactctgcgcagaaaattcttcttctcggacacaaatgtggacaccagggacccggtccaactgaatttggtcagtttttgttgccgtcggcatcgaattcttggccaaatggtgacggactgattaagctgtacattcaatgccgggacggcgtcttgcgggggcttcatcccgtctcgagggacacggccatcaaattggccgcgctccaatgctacattgaatacggcccttacgaggagggaatccaacggagtgttgagtcagttggccaaatgttaaccgatggaggaccctcgcttttagtgccaaaaatctgttgccgaaagaatatgcgaaggccaaggaattggagaagaatattatccaagtgagcggaagaagggaatggcggagaatgaattggaatgactaatgaatgaatgacctcctaatggactgacgaatgaatcccctcccctaattagactgactaatgaatgccctccccctgaaggagtaccgcgagttgatgtatgaagactcggccgcgcccaaaaagaaatactgcgaattgtgccaatcgttgcccacttacggcgtcactttcttcttggtaaaggagaaattgccaggcaaaaaccgactgataccgcgactgctcggcgtcaacaaagattcggtgatgcgagtggacgaacggaccaaagcggtgctgaaggaatggccgctagaacaggtcgcccccccccctttttaaattggtaattattggacatttcttttttaggtccgtcgatgggccgcctctttcaaaacgttcactctcgactttggcgactataaagacggatattattcggtgcaaacgctcgagggcgaacgcattggacaggtaaaaaggggtaattaaagagaaacaaaggcactgttatttaacgaataagcggatatatcgacatcattctgaagaaaaa

SEQ ID NO: 32062 - DNA, 2137 bp, Heterodera glycines
ctttggcacttctctttgagaagtccacgggagattggtgccggcactagtgaggcatcgccgtcgtccctgctcccatccctcgaccattccctccagcaacactcgacaaccgcctcttcctttgcgattgcccccgcggcgatgactctcccccctcgacccgaacgacgacttatgttcaaccaacagatgcaaagaaacgcgtggagagcaaacacggcaatggtggtcagggaaaaatcgttgatagatttggaatcggagggaagcggaacggaagggcacgcggaagaggggggcggacggaggaagaaaagcaaaataacggagacgaaaccgggcaatgtttacaaaaatgtgggcattggggggaagactctcttttcatttatttatcagctccaagcaacacggtccaacgaatatgccaatacgccttcgccttgttccccgacggcactttctccgcttcaccaccgtttgggcccgtcctcctcaaccgatgccattccgccctcttctggtggctgctccgactcttctcagcccatcaaacaaaggcccaaaaagtcggtggcatcggagcacaaaatgcgtgtccaaggcgcactctttaccggaatttcacagcaaaatgccaatttgggtgggttttccgtgccatgtttaaaactggacgagggttggccaaattttaaagcgtcgggagagtggccaagtcgaagacaggagggcatgggcaaaggctcagtattcggcaccggcacttcctccactaatttgggccgttcgccggtcgttggctcgtcgtcggaggtgcgccttggcgattggcgaagtcgttcagtggactcgtcgagctcgggccacggcggttcgtcggcgatgagcagcgcggagggccttttgggcggcggcgcagcgtcggaagaaacggaggcatacgagggagccgagcaaacgcagctgtcggggcacgaagaaacaacggcggccgtcaattacgttagcatcgcaccaatcggacaattgtccctggggcaataggaaatattcaaattgtttttttttgtacattttgccaaacattccattttcagtgcaaattgtcagtgtattttgtgaatgttgccattatatagtcagtcaatttgttgttacgacaatctttcacatttataaggtgttaaaatgagatccaaggcaatgagtgataagcgaattttgcgggagggaaagcgaagcacaaaaaaaggggagggaaaaggaagaatgatcaatcaaatcacaacgcaaagtgacgtcgtcaacagcagaagtctcagtccaaagtcacaacacaacattgagtgtttgctgctcacaaatcagcggcgatcccttcatttaatggcacggcaccatctcttcggcactttcaatccttccctttgttgccatttcagtccttccctctgttgccatttcagtccttccctctgttgccatttcagtccttccctctgttgccatttcagtccttccctctgttgccatttcagtccttccctctgttgccatttcagtccttccctctgttgccatttcagtccttccctttgttgccatttcagtccttccctttgttgccatttcagtccttccctttttcgccgtttggcaccaaaagtcgcatactttgccacccttttccattttctgcgttgtttatttcactgctgctgtagttgttgttattgttaatgatgttgttgttgttcgtactttttctcttggccgaccctttcggactgaaactttcctctctcagacagttcagcaaattcgccattattcggctgaacgccctccgaaagtcgcggttgaaaatgccgtaaatgaccttttgagaagcggaaattcaaaagattatttaatttaattcaccggattaagcgacgaattggcgtagccgagccaagtcacagcctaaaaaaagtaaaaacatggacagaaaaaggcaatttgcacctgaaaaaggaaaggggtgaacagttggggttggaaggagcgccacacattgacgacgaaaaagggcgtccaacagaacagaaaagtgcccataatcacccccaaagtgacgcgtgccttctga

SEQ ID NO: 32063 - DNA, 1318 bp, Heterodera glycines
  misc_feature (62)..(62): n is a, c, g, or t
tgcctccaaccaatcgctgcgataggtgtgccgtgttcgtcttcggcacaaagtgcgcttcncaaggggcagcagagaaaggcgaacaaagaaaaggaagaaactgttcaaactgtatctgatgaagtgaattattgagtttatataattaatgttattaaaattaaattgagaagattctgcccgagtccgatgggtcagagaaaggaaaaagggagggaaagagtacgaaacggagaggagagcggcagagaagcagagaagacagaaagaaaaggggaggacaacagaaaggcaagggaggagagcggcggagggattttgttctctgtccgcgtctacagtatccaattttgcatttccctactctacagtatcctttgggctgacaaacgaagaaaaggcacaaatccgcgcgacggaagcgaacggcgaacgcgcggaagggtacagctgctgtcgatgcggcaaagtgttcagctacgaatattacaggtgggcagagtaaacaaacttatcattttggcttcttttttttttgcattggctttcccttcccaattaccctaattattcattaattaagtgttaatgacccatttaagggacaaacatttgaaattcactcgatgtgtggacagcggaaatcggtgagttttgtacggtcgaaggccgatcaaattcatacggaaaattggacaaaattaattgacaacaaattatcccaacaattattaggcgcttcccctgctctctgtgctcacggtaagcattaaaattcacccctaatgaggggtggggggtagttaggtgattatatgccattccatcggtcgctcagttccttcgaaaaacgcgaccgcctgcgcattcacattttgcacgtgcacgaacgctaccgaccgcacgaatgttcaatgtgttcgaaggcattctcacaatcgtcgagtctaaacaaagtgagaaaagggcaaaaaaagcaaaagaaacgaaagccgagtttaaaagaagatggttatttatggtaatgaccatatgctttaacttaatgataagtattttattaaaacccttttaacaaaaaattgtcaaaattggaccaaaaaattagagagacaaatatttttacaaaaacaacaaataatcaactaaaaaaaccgctataaataatctttctcaattcgcaattaaatttttgagcaatttgaaaagatttaaatttaataaaaaaataatttaactgtaaaaactttataacaaaaatttttatgaatttaaataactttggtcaataaaaagatgggtacttttccattat

SEQ ID NO: 32064 - DNA, 1251 bp, Heterodera glycines
  misc_feature (47)..(48): n is a, c, g, or t
  misc_feature (54)..(55): n is a, c, g, or t
  misc_feature (64)..(65): n is a, c, g, or t
  misc_feature (1147)..(1147): n is a, c, g, or t
tttattcatctccctttttgatagtgaagcatcagagagccttattnnactttnnaattacatnntggtgcgtttcagagcacgttctaaaaaatatttatgaattaattttgcaaaataataaatagttaatgaaaagtcagaatttcgaaaaatttaaaaacaacaagcgttggcattttttcaggttaagttagtcctttacaatggagaaggcctgcaaaatatggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatcggttcggggggaatgccccgaaaacaaaaaatcgattttttcaagtgtcctttggggtactcaaacaattatggggagcaaaaatccaacgcagaattanagtacaggctatagggaagctattcccgaaggattcggtctccccataaatctgggcgcatcgggtcggggggactgccccgaaacaaaaaatcgattttttca

SEQ ID NO: 32065 - DNA, 791 bp, Heterodera glycines
tattttctatttaggccaattctttttcactgaaaattatcaacttataggtctactttgtaactgttgggggaaacctatgggctggtggtgccgctaggttaaaaatggccattttgagatttcttttccaaaaaacagcaatttttaaaaattttgcgctttgaactcataaaagtactggaaaatggagaaattaattagttaataaacaacctaatcaataaaatttctaaggaataaaaaatcacacacagaaaaaccaacgtgtcgcataaattgaaaatttgtgagttttttgtagcatttttacataaaatgaccagttttgagagatattcccaaaaatcagcaaactctctcatgaaagcatcaaaaatcatcaaatccgcatttcaaaaacatcatcacagcagccaaaaatttttgaaaagataattttggagaaaaatttatttataaattatttaatagtaaaattttattaaataaaaattagcatttttaatatttctagtcagaatgggaatccgctttaatgttatactttattaaaatttattcaaacatattttttctattttagtttaaaaatttacttaattcatgacaaacttttgatatatcacatcatataatgcacccgttttgcaattattatttgttgcgtcttacaataaaaaatttattccactgtttttaagtttgtataataataatttatttataaaagaaaattaatttttatgttttatataggacatgcaagttattgcttttttcaatttttt

SEQ ID NO: 32066 - DNA, 986 bp, Heterodera glycines
atttggcatttttagtccatacaacttcgaaccctacttttattattttaattaaagaaaaacatagtgtttttaattttatgaacatttttactcatttttttgctggacttttttttacccagtaagtttaattttatttacatttctgaacataatcaaataaatgtaaatattttgtaaatactttcctatcattatatatttttatatatagtgaaatttttaattttatttcgagattcatgagttggcacgccgttcggcctttactacatatgcattttgtattaaaataagtactgacaagattaatcaattttatgttttaactgccgtaattaaatatttttaaattttaattggtgctaaaatttaaaatttttaatatgtttttttgtttaatagcttccagcgttttacattaataaattttttaatattttaaaatatttttgtcaatattttcaaatcagctggcacaacttgagtttaaaaaataaaaattcattcaatttattcaatacaattataagtttatttttaatgccttctagatttacatcgttaaatatgcctaggaataaaaattgaatccaatatttaatttaaagtaagagatggccaattttttaaagttcttatttcgttcttaatctgttatattatttaattaataatttcaatattacttaaattataagtagctgtgtccaaacttttgttgatttcgtatataaggtatgattttatttgtttatttatttaaaatataataaatataagcattttatccttaatttgggaaaattagtgtgcattttttcactttttatatgcatatttttctcatttagatttttaatcttgcaaccaatttcttgatcttgttgatctgttaaaaaagttatttatattttattctaaaatttttaattaaatattctattatattattatttttaaatgtatattcattttgttta

SEQ ID NO: 32067 - DNA, 1444 bp, Heterodera glycines
  misc_feature (565)..(565): n is a, c, g, or t
  misc_feature (599)..(599): n is a, c, g, or t
tttttatttaaatggagatccccgaaacttcgctttttattcgtttttcgtacaatataggtagttcggcttcgttcaaaaaatttcaggaataggggaggaggccggcggtgccgataggcgccgccgggaaaatttttcaaaattttgctctgtttcttagcaaatttagcccaaaaatgaccaaatttctctatgaaaacaatatttatttcgtaaatattcaattttatcccgtgtaaatttttcacggaataatcgtgaattagcaccgtgaaacgttaccgtgaccgtgagcgaaaaaacccgtgaaattcacggtaaccgtgaccgtgattcacggcgcacctctagcgctcggcccttttcaggctaaaaagtgccgggacttaagtgccaaaaccagccggcactcaactgaccacgctataaaaagcgcttaaaagcccgtttgaatgatttttttattgcttatcgatttagaccgttgtttttaggcattttttaatttgtggactatgatcaatgttttcccaattttcttcaaaatatttttaggctttgnttgtttttttaattttaattttaattttttgctnatttttaggagtttttctttaaatttaatgaatttaaaaaattgaaaaatttatatgcatatttttcaccttttaagtgcatattttactattttagtgcgtattttgcgattttatatgcatataatttttggaaaaggcgggatttgctggattaatcccgatggatccggacccgaaaattttttaaaattccaatccagcagagggatccacaaatttggtttttttctgcgaaatcccgccgaatccgcattgcattttttgaaaatctcaaagacggaatgccaaatattttccaaataattttatgcatgaaaaacaacattttgtccaggaaggctcccggacatttcgacaatgaccgtttcgccaataccttttcgacaatgccgtctcgacaataaaattaaatatatatttttaaataaaattcaaatttctctaaatgatatgagatagtgctggtatgggatcaatataaaatagttttttttcgtttttgttcaaaattgcattatgagaatggctttagttttcaaacctaaaaatcactaatttattttttttttcgccacttacaaataagataattaggtcattatttttaattatctaattatttttggatttttcgccactaaaaatacccaccctaatacataaaactgctattctttgcaaaatataataattatttgcaaatccaatatccctttgcgatcaatattattattttattattactattcataataatggaaaagatttttagatttcgagaaaattctagaaaatcaaatgaaataaaatttgttttatttaacatttattgaaaattcgta

SEQ ID NO: 32068 - DNA, 1063 bp, Heterodera glycines
  misc_feature (1038)..(1038): n is a, c, g, or t
atggcttaaacttaattggggtgtttttataatttccttaccgggattggccttcgggaaataaatgcctactcaagagcggattctgccttgccctttcaacaaattctttgaatgccgttggctctttattttcacgcttgtccttgttaaacaggtgactaacaatgtcatcaacactgctggttataaatggacgcccaccggctctcaaaacttgcccttcctccgacacccctagagattgggcgtttttataaattaattttaagatttccgtttgtgtgggttgtcgtttatttgaacttgacgaccgtgggttttgataatcatcatcatcagtatcttctaattgttcaacattttcttttcgcgcacgtccaaccttgagatggcgtcgcgtagaaacaacaattggccttgtaacgttgactggttttggcatggcgtcaaccacatcactcaaattttctaatttaacacccacgggacgttcatcttcgtcctttgtgagcttgttgagacgcttaacttcctgctcatatttgactgccctttccgcctcatttatggcgtcatcattttttatttgtttaattcgggtacggaccagcccaattggtgtaccgtctgacggtggcggtgctgccaaactctgataaatctcttcggggactagcaaatagcgctttgtatgctgcattttttcttgtttttaatttttttggaaactatttatatttttctatgacatcagcaataagcgggagagcaattgacgcaatgagccccacaatagcgggaaggccgtctccgtgctgtagcaaaacctttttggctgagcgcgagcagcgtgtgcgggcgagacgacgaagcacctgtgcatgagctttcagcttattcaaatgccggggacgcaaagggactcggccctttagaatgtttaggcagatttcgacaaggcacaaaagttgctcatcggatgcatctcgaataagggcattcgcctttttggcattacgacaatgtctccaaaanagtatttatttattgttattatttg

SEQ ID NO: 32069 - DNA, 978 bp, Heterodera glycines
  misc_feature (942)..(942): n is a, c, g, or t
caaaattacgaaagcggcacgtattttatgcatcgacctagtacatatattccgttatttgaataaactttaattggttgggtcctctggaaaaagacccatagaaattttcaggttcagagaatccgtttcttatattcatttcgagccttgaaaatccgaactcgaacaaaattcgaaaattcattccgcaactggagatactttttttgatgcttacttcctcgagacgagcccatttgtataccattaactatcctcaataatttcgcgtgtttagccaatttttgaccatcaaatgaaattcaaatttttgttggaattcgtttgattttaaatttgcttgagatttgttgtcttccttttcctgtatgtgcatttttctctttaggcgtgagtttctccactgctgttgatggttacggcacagttgacaattggaaacacccgagggcgacgatgggagcgtcgactttgtccagcaaactgttttaggaagaaaagcaaacaatccaaccttcgtttaatgcaattattaaatcggattagctccaataaactttttgtttgtcaatattaccaaaatttcattcgttattttttctctatttttatgcaaaatttaaagaaaatctgttagagaaaagaagtgtttcttagagaaagtaaatgttatttttttctataacagagacaaagaaacagtttttgacttaaagttcgaatcgggtcctaggttcgaaattgcttaaggatgtcattttcgtgttcaaagcatttagtgaaattatcagattaatgcttaaattctgtatatggtaattgagcaggtcctaatctgtgatctatataaaattttgatttgaaatttccgtgttttaattttactatatgggatttgcaaaaattgaaatgacgctcatcacaaacagacggaaattntaatgaaaaaaataaattactatactataatgagat

SEQ ID NO: 32070 - DNA, 1230 bp, Heterodera glycines
  misc_feature (1205)..(1205): n is a, c, g, or t
tcagcatcaacaaaccccttttacaaatttttcagtcgtttgcaggaatggggattgcaagtcaaattcgagaagtgtaaatttctctgcaccgaactgaagttcctgggtcacatcatctcagcggaaagcattcgaccggaccccgaccgatcgcggacgatcaacgagatgccagcaccaacggatgagcaaacattacgctcttttctcggcgcaattaattattattcccgttttgtcagccaaatgcacgagatccgtgcaccgctagacgaactgcttaagaaggatgttcaatggcgctggggaccggatcaacagcaggcatttgaaggggcaaagaaaatcatcacttcagatttgctgctcatgagttacgacccggccaagccaatcgtcgtcgcagcggacgccagcaacaaaggactaggcgctacgatcagtcacacattcgccgatggcagcgaaaaagtcgtcgaacatgcgtctcaatcattgacgccagccgagcgcaattactcccaaattgagaaggaggctctggccatcatcttcgccgtacagaagtttcatcgcatgttgtatgggcgaaaatttagccttttaacggaccataagccgttaatcagcatttttgggtccaaaaacgggatccccatttacacagcgtctaggctccaacgctgggcattaattctgtcaaattatgatttcagcataaggtacatctcgacaaaaaattttggccaggccgatgtcctctcgcgactgatcaaacagcatcgcgacacacttcaagaggaggacaaagtcattgcttctgcacagatggcacaaaatttggactattccgagaacgctaacattgagttttgtgccgcagcagtcgactacatgtttcaaacaacaattgatcaactgccagtcacggccgacgaaatcgcagaacacattgaacgtgacgaagaaatgaaaaaggtcattgaacattgcaggaatggatggccaaaaacagcaaacgaattgaccatggcagcattttatacgcaccgactgcgaatcagtgaagtcaacggctgcctgctcatgggcgatcgcgtcatcatcccatctgcattgcgttttcgcattttgaaggcacttcatttcacccatcccggcatggtcagaatgaagagcctggcgaaaacatttgtctattngccaaaaatagacatggacattgaa

SEQ ID NO: 32071 - DNA, 1312 bp, Heterodera glycines
aaatcaaattaccgttcacgccacagaatcacaaatcattcattcatttgatttgacaaacaatttttaattaacgaaaattaatggccaaatttctttgtcaaaattggcagatgcatttcttctgactttgtgagtaaaggcaaattgccatgttagcattgcaataaaattgcatttcaagaaaacataaggacacagtcactttagcgtaaaaaatattataccatttattatcaatgagaaattccaacaaattattcaactcaaaattggcatgtgcattttctaagagaatgtaaataagcgaattgtcacactagcattaacataattcgtagaaacatcgtcgaagtgtaattagtgagtgctatagttctaattgttcactagatttttcagtgcgggaaaaattcgatttttaccatttaaaaaaaaatattttcttgaactttgtttttatattttcttaaacatttttttagcgtcaaaacataaatatgaaaatatttcatgtttcaatatatgaattttcggctttaataggagttctaatctcaaagtttcatgtaaaaaaaaagtgaaagaattttaatttttttttcaaaaatcggatccacgtttagacaccttcgtgaacgtgttagttaaatcattaaacgatggaattctatttattaatttaggatactaatcttaatgagttttttatgaaattttcacaatcgatttttcagtctgaataattcttataaaaaaaattttaatattcatgtctctttgtcgacaggtgaaaaattaaattaccgttcacgccacagaaaggaatttatattttttgaaaaaaaggtttaaaatatttacgaagtgattcagaaatggctgattttaataatgatacagtaagtgaagaataccaaaattaattttggcgagtaatttgttttttttagttttatttgacgttcaaagatgcaaatccaagctggtcgctcattgggtgcgcttcagtacttggattaatcgctttatttggaatcatttccaattcttctgtaatttatgtaaccattatgacaaagtgagtacaaataatcattaattagtgtattaaaatcagttaaatttaacttaattaggtcattgcgtggcaccgttaattactttttggcactttgcagctttttcgagttgattcatcaacccggccattttctgtttgtttacaccgctttttctggaaagaatttcattgagtatcgtttggccgtaaagatcacttttatttgctggtttggaattggtaaaaata

SEQ ID NO: 32072 - DNA, 1470 bp, Heterodera glycines
gcccatttgaggggggggggtgaaaaacaaagcccccggggactctattatacgaaatacgggtatacatagtaaaattaggtttgcaacccttattttttaaaatttgctcgagaaaactttttgtttttttcgtcttggtttcgagtctcggaaaattttggtgtgcgggcgaaatgtcagactttggcttagtagacgaaatgtcgtcgtgccaaatttttctctctattatcagatcacgcactaacaagctttttctgcgtggacgtacccttctttgttttatgaacccgatgcttttcatatcatcatcgaatgtaactggtactgactgtgtgtactttaaaccaaacaaaaatactaaactcgcttttgaaatgtgcgctggcggtggggttaaaaaaggatgtacatacaaaatatataacattcggtttaggggggggggcggagagcgcgggggatggattaggaggggcgacaaacagcaccccttgaaaattgagtcggtgaaaggacggctaactgactgaccaaagtgagtgcacagtgtttccccacgccgttcccccctcattctcccgaaattaaaaaataaattttaaattagaaaattttgaaaaaactctttcataagaaaattgtaagaaaaattctttcgagcgattttttaaaatttttttttcatttttgaaaaggctaacgagctgcttccgaccgatgctgctgctgctgctgtcgttttgtacggctggtggtggtcgtagtgtcccgcttcttctctctcccctcactcacacgcactcactcacactcattcgatgataatgatgattttgaagaagctcatcatcattattgttcgtcagtcatcctccgtccgccgccggtgtccccgccggcgtcgtcgtcattttgcgatgaattccctcccaccccggcccaaagagacgtgaaaataatcataatggaccgtcagacgccggagagaataaatgaacaatgatcggattgatttgtttaaatatcgtccaattgccatcttacgttttctcaaccggtgctgatggcatccattctgtctatccatggtgtgtgtgtgaccgcgtcaattgttgcggagcgctgaggaatgggattttttttcaaataaatagtaaattaaaaaaaaataacttctttatttaatttataaatttttttgggcttttctcgagtcaaagtctttgggactaaattccatagagttagcgcttaattattcgtcggatgattctcaattttccatgcttaaatccacgccccaaaaatgcctcggacagtgacgagatgcggccgtgtccgtcgcgatagctcggaatgcgttgggcaatgcagcgacaaaaatgggtgtaaaaatttgcgtttttccggcgacggcatgacgtacaagtgatcattcggtgagggggaaaggatgctccaaaa

SEQ ID NO: 32073 - DNA, 942 bp, Heterodera glycines
cagcgccgaaacgcgtgggtccccgcaatagttatgacataaatttcaccgaaaattatttggcgtcatcagcgcttcgctgatggaaaaactgttgaatgtgaaattttggtgaaaaactatttttagattttttgttcgagttcagacatgtgttcgtagttgaccaaaatggatgttgtaatcgcaatcatcgttcacaaaaatccggatatttttttcaatttttaaaaattcaaaattttctcaaaacgatgggatacaatcggcggcacagtattatccaatttctatgatgtattaattttgtacattaaatgaactgtcaccttttttcgattttttgttcatttttgtatacttttcagctttttgtgcatgcctatactttagcctgcaaaatttcttaaaaaaatcgttgcgtctacacccgaagagccaaaaaatgcctaaaaattttctcttttttcagttagacaaaaaattcattttcgcaaattcatttgctccgtcagttggcagacaaacggcttccctgggggccagttccacgtcttccctgggggccagttccacgcttaaaattgtagttgaacccaaattttaatacaaaatatcttaatatgattcgattgtcccaagaatcctctgttagtctgcaaaatttcaaagaattagttctgttaaattttttatggtcttgtattttttatggtggtttaaattacattagagcagggaatttccactccgccgaaataaaaatttaaaaaaaggctaaaattttttaaaatttgactcactttattaagtgcattaaagttttcaaaattttcctgcgcttcagctgcccctccatttgggcagtgatttgcttcagctcgcggtccaacgcctcctgcttcgtgtcgacgagagtctgaaatggaaatggcaaaaaaa

SEQ ID NO: 32074 - DNA, 1375 bp, Heterodera glycines
cttgatggtagtataacctgttttttaagaaattccttcttctattgctctactttctaatatttttccgatgttactatatgattctttacagatttccttttggtgtatttttatataatttaaacgattccattcaatccgagcagcttgatcgaccacccattgttgaaatagttttcgagcaaaatgatgtggtaaaaattttccttcatttcggtaaaataatttgtactttgtaaaatcacataaagaaattggatttcctttttgatcttttaatttataatgccatccttcataataattcggataaaaaataggataaattaagggttcgactaatttatctaacggatatatatttttaatttgtttttgtccttttgagtggacaacaatgtttgccgcaggaatttcttcatttgcatctctaaacaaaactgcacaaacttcattcgatcttggaatgttatatcttcttaaatcaaccccttctcttacactaaaaagcattgtcacatcaggaatttcaaattcattttctgttttttttgatgactcaattacgtctttcatcatttcataagatttggcgaaaatgtaattttcccttaaataattttcaatgtaagacattaaaaatcccattttctctttttcttttggattttcattacacatttgcattctataattcaaagattgatctgtatcaatgaaatacaattgtccattggtaggaagatcttcattttctggaaaagcagcagtattgtatgagtgataaacagccccttgaattttaaaaattggtatttttttattcgggtaacaaaatctcatacaccctaaggatgcgcaagaaaaacttgaattaaacaatcgtatgtttttcataaaaagctcgtgtgtttttttatcaaaattattttgatcaaataaaagttcaaattcatgcggatattcaggaattgtttcttccaaatttgctaatttaccataactacaacaattcccgaattcaacattaatttttgacgtattcctctcttccaaaaaatgaactgctggacagtgaaggcatttaaaattaaaatcactgagttcataaaatttcacatcactattttgtttgttagatgttccaacaaaaaaatcatttgaaacttcatccaaattaatcagttctctatctacttttcttcgcttaaacaaacaatcattgacttccaattcatctttattcaattcaattgagtcaccaatttgttcaaattgcttttttagggagcgtttaacccttttattcagttctccgctttttccgggagcttttaacccgtcatttctttgtgtatttgttgaagtggaa

SEQ ID NO: 32075 - DNA, 777 bp, Heterodera glycines
aaaaatgaggacggatgagagtagggggaggagcccccttacgaattggcgaatgaatttgaaaatgaaaatggccaaattacgcaatgacaaagggagggtgaggagaccgggggagcgcccccgaacaaatgttggcgaattacaaatacaaagacggcaaaatgaatcggccaaaggccgatcagataaacaaatggtaatgcagaagaggggggatgaatgaatgaatggaatgaaaaatgtgcaaaattgggacaaaagaaatgttttcggataaatgacggccaaaggccagcgcaaaatgggagattggcaggttgggaaaatggtgaagaaatgcataaacaatttgcaaatcggagaagtgagacgattggatacgataggcgaagagaagagagagagagagagaataataaatgtgaataaaaataagaaatggcaaaataaatgtggggaaattgcgagggaaatggcggaaggatcgaaattggctgtcgggagtggctctcccggtgaagtgtgggatccgtccggctcatcggcgccatttctttcgttttgcgtcctccggtgcgcgccgcggcggcgctgcggggtgatcaaggacgccacctccccattcgttctcctcttcttcgtccaactccaccggcgtgccgtcgtcccgattgaacaccaggaacccgaggtcgcccacaccgcgccccgggagtgggtcgcctcccgcttccctcctccgctctctcgttgccgaatggaaaaattggcgac

SEQ ID NO: 32076 - DNA, 1321 bp, Heterodera glycines
agattttcgaaaatttttttgagccagctagctcggcgctcatttcagtgtaagttagtcctttaccggggagtatccccgcaaagtttgttacgcttctgctcaattagcaaaaaatatgagtgatcgaattttcactaaaaaagttaagcctacattttttggcatatttaaaaagcaattaaaaaatttttaaaatttaataattttcctcgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttct

SEQ ID NO: 32077 - DNA, 890 bp, Heterodera glycines
atgccaatttgcccaattggttttcggaaatttcaattgcaggcgcaagtaacgaccaaaaagaaagcggcggtcatcacaccctccaagcaaaaccccaagctggaatctgaggaaggagtggaggaaaagccgaatcaaacggaacgaaccgagaaacagtcggttgtttgacggaagcacaaaaactgttggaaaatgctatgtatcatctgaaaattattgacaaacccaaagaagcgccaagagcagtgacaccccaagtgaagagagaggcgaacaaagcctgaagcacggggtcccaattcggaagcattttgaaaaataaaagcacttaaaatatataaaatgttaggcatttgttaagcaattaagactcgctccaaatatgcttcagctaacatttgtgtcaaattggtataaactcaaattagtcttttagaggtgtcatgactactcgtacaaaaggcaactcgtacaattgcttaggttatgccaaggctttaggctcgtggacggtaaaaaaggaaaaaaagtggcaaaaaatcagggacccacgcgtttcggcgctggcgtttcggcgccagctcgtttttccacttaagcttttttctttggcatccaaatccaacaatattggtatcattcgaaagctcttatcatgctctattagccttacaaaaagcggatagattttcaagcctgtaaaaaatttgattaagaaaaaacttcaaaaatttcgacttttcgaaattttaatagtataacttttttggtaattgtctaatcgcgaagcaatctcttttaaaaagctgctaaacatggtaagctttcgaatgatatcaacaatgttggatttggattacatagaaaaaagttataggccaaaa

SEQ ID NO: 32078 - DNA, 818 bp, Heterodera glycines
tttttagcttgattagaagcttctagagtggatttccatatgcatattttgcatatttgtgcatatttcggcatttcatgtgtgcatattgggcattttttcaataaatcctctattaaaacggccccctctattaaagcggccatttgggctctaatgaccgaaaattttttcaaaaatatcagattttgggtatattttctgataaaaaaataactttttaaaaaattgaaactttatgccaaaaatagtcagaaaatagaaaattctccattttttgctcaattttcttcaaaataaataaatattacttttttggttctaacaaataagataatcattcatactatttttagctattttcgggattttatgcttataatttaacaaacttgaagaaatttgaaaatttgccctcaatttggaaaaatttatgtgcatatttttcactttttatgtgcatattttgcaaaaaatgtatgtaaaatctgccccctaaaccaaacaagtaccgtttactcttataccacttatttgggagcttatactcaaatgatcagatccgtttttctacggccgcgaacggccgtaggcgaaatgcttaataaaaatattattttaagtcgggttcatcagtattactagggattacatttataggtgctaaaaattgccaaaataggtaggttttaagttctaaaaaactcccaaaataggtgctaaaaatgggaaaataggtgccaaaaagttccgaatttaggggtgtaaaatcgaaaattttcttcaaaaagcaaaaatattatgccatatcattaagg

SEQ ID NO: 32079 - DNA, 1659 bp, Heterodera glycines
cacacgtgctgttcagcgcgcactttgttcccgttgctggcactgttcagctgcagttgcagtgccgccacgaccaactcaggcgccgctgaggaacatgccgaatacggggggaaatcaacagccacacttttgcgcgccatgccaacgctggacgcagcagcggccatggagggcgcgggagtgttgggcacggacagatgggacacggacagggaggacatgttgctgagacggtgttgctgctgatggtgttgctgttgatcccactaaaatatttacataatttatgtacataaacattttcaaggcggactaactattttttgaaagagtattgcttgttttttttaaagtgatgtcgattccttagttataatatccgatttataataggcttgattcctaatatttcaataaaaaatccccggctacagcaatgtcatggattaagccagttgtaactaccccaatggcaatttggtcatatccatggggagacaataacagatctttcccaaaaataaaaagttgtgtgggttaaaaaaattgctaattgcgagaaatgccacttcattgtgccgttgttcgccattgccgccgccggcgttcatcagagcgtccagccattggcagtgcaaatcttcgctctcgttgaagtcgatatacacggatgggtcgtctgatcaaaattggatgaaatcgcatcgtaccattcattttattatgtcatttgacagaccaaccgaaaaacatgtccaccagtttttttgtatgccaacacggcaaggaaaaaggccaagggaagtttgttcaatggaatggacaaagtctgccgaattcggcaccaaatgggccccaatttgggcgtacactaaaaatgccattttttatgaaattatattgttaatccatttaattactgactttcccgcgtgaaatttgcaggattgcccaacaaattgaacatgctcagccatacgttcttcgcaatactcaaatggccttggaaaatgttcgcagaatcgtcgacggaagtgccaaaaatgcgagtttcatctaaatttgattgtagtaaggttatgtccaattcggttagcagtaataaatcttttattttacctttgttctttttttaaaacatgaaattcaaaaaatggaatggagagaaaaaacgggtgtccgtattgtgtccccaccccgcccctggcagaagcagctcccaaattttctttaaactgaaaatttttgttttctaaatttattgaattaaaaattgaggttttcaaagcaaatttcttcaagaattttttttctttacaattaccaaagaaattttttatataccattggatagagcagatcgacttctattgtggatttttaatattatgcgcccctagcgagaaataaaataagttatgaggcctcaaaaaaacgacattttggcttagttttacttaaagttgatggctcagttggttaaattaggatttttggagctcgggttcaaatccaacataaaataaattttaattaatgtataatataaacaaacaatttaaaaaatcattttttagacttaaaaattgtatgatagtttttctttagtaaaaataagcaaaaaataataataaaagtaaaggttgagaattaata

SEQ ID NO: 32080 - DNA, 673 bp, Heterodera glycines
tgtctgtgccggtccgcctcctccatgtggcgcctgccccgcctttggtgccgctgccggttttgctggcgcgttcttcgtgaagatgtcggcgtccaagttcttgagggtcccgtagttcgaatcagtagctgaaaggggatgaagaattaaaattttaaaatttcggcattttttcacttggtgtctgtgccggtccgcctcctccatgtggtgcctgtcccgcctttggtgccgctgccggctttaccggccgtccgcctccccactgcgaactcatgttcaggtaatccagaggaaaatcatatgtcaaattttgcgatgcggtgcccagtgccgatgttcctccagccggtgccgctgcggtcttctgcgatgcggtgcccagtgccgatgttcctccagccggtgccgctgcggtcttctgcgatgcggtgcccagtgccgatgttcctccagccggtgccgctgcggtcttctgcgatgcggtgcccagtgccgatgttcctccagccggtgccgctgcggtcttctgcgatgcggtgcccagtgccgatgttcctccagccggtgccgctgcggtcttctgcgatgcggtgcccagtggcgatgttcctccagccggtgccgctgcggtcttctgcgatgcggtgcccagtgtcgatgttcctcc

SEQ ID NO: 32081 - DNA, 992 bp, Heterodera glycines
ccgctgatgtatgggcacttcaatttcggtgtcttcaaaaaataccgtatttcttaagaaaatcgtgcattttacagtaaaatgatcaacattgaaattgaagtgcccatacctcagcgggtttaagtcgtagagacttgcggtctttttcatattgtagcaaattttgtcccctttccaaagggcttactcaaattttccaaaaaaattttcagaaccccctaggaatttttttctaaaattttcccgattttaagtcatttttgactttacagatcaccatgaaggagtgatctgatcaggttggtgtaaaagacttttttgaacagcataaaaagttagcttagcaggaattttttcagaattttggcccataaaatattgattctatttacaaataatctaactgtccgtacacttttgagcaccaaaaattgggggcatattgacttaccaaattgtatcggcatacaaaaagcatttacaaaataatgaatggtgcggcaatcatgtcgatcattggtcccgaaatttttttttttttaattttttctgaaaattcttataaaatgtttctaggggtgttttgaggcgctgagcacgaatccgacctccatttcgtcctatttccaatcccgaacccgaattcgaacatttttcgaattttcttttttaatttcaaaaatcatgaaaacatgtttcggggggttttcggggtcgctgatcacgaatccgacatccatttcgaccgattccgaacccctgacccggattcgaataaaataaaaaatctattttttaacaaaattcacatttattgctaaaaatcgattcaaatgcacgaaaaagaaaataatcaatgttcgcatggataaaactcagagacgtgcatttgacgaatggcttgaacagctaggacttctccatgctcgtcgtacatgcccacgttgcggaggatccacttctattctagctattattggtcaaaaata

SEQ ID NO: 32082 - DNA, 1488 bp, Heterodera glycines
ggggtagagtgtggacggttggtcaattgactttaacccgaaaattggggacccgaacagaagacctaacccccctgttttaaacaggctaagaaaacgggctcgaagcaaccaaattagataaaatgccaaaaattagaaatttttcggtggaatggatattttttcattcataggtaaaattctgattcccaaggacatcttggaagcaagtacgcagaacaaggataatcgattttaaattataaaataaattttttacaaaatgatgccaagttacattttttgtttagctatcagacattaaatttttagtgctatttcaaaaatttctgtgccgatatgggccaccggggcactgtacgatttggtacatttgcactaataattccatttttgggatttttgcggaaatttttaaaaattatttaagatttataattaaaaaatacattatggttaaggactttttacaacaattatcaaaagaaaaggagcaaactttatgcaaagagaaagagcaaaatttcccgaaaatttttacttacaaaaatgctaatagatgacaaaatctaatcagttgggaaattttttgggaaaaaatgagttagcaagcagaaagagcataaaattctctacaatatgttaaagaccgagaatctctactatttataatcgctgagatatgggcacttcactttcggtgtcaaaaaaatattgaaatatgaccatgactgtatgctttacgtttttttttaatttgcattcattgtcctaatgtccactgtccaatgtccacagtcgaaatgtccggtcacgatacgaaaagaggaaaaaggaaggacaaaatgtaacaaaattttgtgagacgaaatcccacgcgaaaatccgcaaaaatcccactgggcctacaaaaggtgtgggagaaggaattggaagtgtcgccaacatttggcaccgtggttggccacttcacaaaccgtgcaaaaatcaaaatctgacttttcctatgattttttatcaataaactttcagtttttggatttcgaataaatattgactaaaatttaattaatgttaaataaaatcattggccagtttaatttaaattttaaaatatttattaaaatttaaattccaatggccagtttaatttaaattttaaaatatttattaaaacttaaaaacccgggaccgggaccaaccgggacttttcccaagtgaaaaatttttttgaaaaaaattgaaaatttaagtgcactttgttacgaaaattgccaatattcaaaaatgtacccataaaattttgtatttacgttttgggggacgagttcgaggaaaatttttaaaaattttgttttcagggggggggggggtcttggaattttctgagtcccaaaattctgtatttttttaaataaattaacaatcttttaaattttttgcttttaaatcgctgtttttgtagcaatgttttttccggaaaaa

SEQ ID NO: 32083 - DNA, 1611 bp, Heterodera glycines
  misc_feature (1436)..(1436): n is a, c, g, or t
  misc_feature (1531)..(1532): n is a, c, g, or t
  misc_feature (1544)..(1544): n is a, c, g, or t
taaatgataatgaataaaaatagcttttggaaaaatgatacaaggttataatcccagaagcattgctttttctgaacattcatttggcccaccggttctgtaagtttccagcgctccgttcagcaaaatcaccgaaatgcccaaactttggtcgcttttagccttcgcaacgactccccggatgatcaggaaatcgccgtttacaaagtgtaattggacgggaaatgccagcacaattggcaatgaaatattggcatttgccctttccaatttgctcaaatcagtgatcactgccgggcccctttttcgggttatctttggctcaccttttaagccgctttcgatctaattgaaaagcaaatttaaaatcaatggcaacaaattatcataaaaacataagtaataggaagatgaaaattggatggcacgggagggataaccaaaccaaaaacgaatcagagggagggagaatcatacaacattaatacatttaatgatgatgatcaattaaagctaaaacagcactacttcaaatgcagagttcatttttgacattttccttacccgtactaaattcgtaacccatggcggcactctgtgcgtgtaattcttcacataggcgccgtgaatataaagttcgaatttgtcctcttttaccgtaatttcaattttgaattcttggtcggcgaaaatccgtgaattgcttctttcagagtcgtttaatttcttagaacccttttaaataatacaaatttcaatgttttattttaaatataaaatttcaatatttggttttaaatacaattcaataatttttttaaatataaaatttcaatagatatttgcttttaaatcccgagtcgggattcccgactgacccatttcgtcaaattgctgcttagccacattaaattcttctcatggatttcgttgaattcaaagtgaattttgaatggaatttcattttctgaaaaggcaaaagattaaattaggtaattaaattaattaggcttctgtacaaccgtaaaattaccattgttttttggctcgagtgtattatgaaggaaaaagatgcttaaatatgtggcatttttttccaatttgccttcaaaagttagcgtatcgcctgcagctaaaggagggttggccacaaccactctgtagttcaattcctttatgcgctgaaagaataaatacgtggtgagtcttccacaaaaaagctcagtgattgatggtcattttccggaagcctatcgcaccactttcgggcaccaaaagtgcctgatccggaacccggaccgcccggttaagaacaattttttgttcagtttttcaagggctatctcccaggccgggtccggttcttgatccattcacttggagcccgtcatgggtcgggcacatctgccggaggaccctcagcctcgcccccgacnctgtcgatggccaacccaagctaagcttgccggtacagcgggcttttttgtacagctcgatgagctctacaaaacggtatcaatgggcgtcaggnntgtgtttactancaatgtagaaaattggcgagaagtgatgccaaaaattgaaaaattaaaaaatttgaaaatgacttgc

SEQ ID NO: 32084 - DNA, 1607 bp, Heterodera glycines
  misc_feature (1233)..(1233): n is a, c, g, or t
aagatccaattcatttccttttattaggtaaattgtttaggctcaatggagaacaacaaaaacaacaacaggagactaagaagcacgaggacggattggacgagttcaaacgaccggaaaaatggcgtgcaaaggacgaaggaaatgggcacgcattttgaaaagctttacaattttgacatttgttctaaaaacctaaaattacagggacaattctgccgacactgctccgcactcctccacctcagacagcaacggttggtcaaaagagagagagaggcatggatttcgatacaaaacaaaaattttttttgacaaatttgccgagaaaaatttttttaaaaatgccatttcgcatgagtgagtgtctccctacctagcttcctccctgcctcccttttccaagtgccccaaaatacgatccctgaaagtggttaccatttatagggcgccaattttgcaatttttggaatggacacaaccatcccccccccattttcaagttgaccaaactgctgcgtccactgctggagagaacgatggggaggaggaggaggacgacccggactacaaagaggaaaatgatgccaaaatggacggggaagagaccacctccacggaggaagaggaggcggaagaagcggcgggtgaaacggaggaagagcatgaggaggaggaagaagaagaggaggacgaagaggaggatgacacgggggaggacattgacatgttgctcaactcgtccgaagggaacaaagcgtgagttttcaattacattccaaaaaacatttcgaacttaaaccgaaatgaacaaaattatagtaatataggaattaattacccatgcaattttttggtgaaatttcttttgcgattgtattttttggagagccgatgccattagttggcactttctcattatcggcctaattttgagggaaaatgttcgtttcagcttagaaattagtcaatattttccattaatttttggtttttgggtttatttgaaagcctcaatttattttaattaagtttaattattgatatgaaaatttgtttcagtggcttcgattccggttcaactgcatgtgtcgtactgctcttcaaagtgatttgtttactcttctttaaaaaataataaattttcaggacaaacttgtcgttgccaatattggggacagtcggtgagtgaaattttatggcatttgtttaaaggtaattaacttattattnctctcggttgtgttcaacagatgtgtgctttgtcgcgcgggaaaagccgttgaattgtcggccgaccataagccggaagatttgaaggagaaggaacgcattgaagcggcaggtatgcaaggcgctcagcaaattagtctatttttatgaccatatttattcgttgtaatattctttatttggcacaacattttcaggcggatccgtgagcgaagatggccgagttaacggaggtaatgagagcctttttatcaaaaatagagtaattggactgaaatttttgaagtcagtttgggaaaacccgttattattatttcatccgaaagaaccacattattgaccttcattagcatttttaagccaatttttaaaat

SEQ ID NO: 32085 - DNA, 1592 bp, Heterodera glycines
aaaaaactaaattttatgaaaatattttaaaaataacccttattatatttattataattatggcacaaaaaaaaaaatcagatttgggaccgaaaatcaaaacatttttgggaaagtgtttcaaatcagttcctttacaatttattcgatcaaattaaactaaattatatttttcgtatcccatatcccactacaaacatgaacagattaaagccctgattataatccataaattataatatcagaaaaattcgaattctcaaaattctgaacagcagcagcaaaattttttttcacaatttttaatttttgatcatttcccccaatttgtctgattgaatttttaaaatttaacaccacttttttaatttgtttgcttattttgttgcccccgcccgcgcgttggtgtcaaaaagtcaaaaagcgtgggtgcgggcggcgccgcacactttttacagccggcgacgaaattcgatcccttgacgaactttttttttctcattttttattcttcgaattttacgtacatccacatctcttctcccaaatctttgaacctttgaaaacaaacattttaaaaatcctccttcattttgtaaacccacgcaattttaaatgcatttatttatttctttttaatttaattaaattataggaagtaaatttttggaaaaaattgtttttttttaattaatcgcctttttcagtagagcttgatcgggattagctggattttactgggcccaggtctaggtccaggccttttttcggcaacctggttatttactggacctggatccagactttttttcaaaatttcgaatttatcattttgcaataaaaattaatttttaaattgacaaactaaaaaataaaattaattttgttttaccttcttattttaaaatatattctttaaatctatttttttcttattttttaaatcataatttaaaatagttttcaactattgtcgctatttaaattccattttccaaaatcttaaaaactgccatttgatgagcctctcttttctgctcctcatctcattcccgcccacattcatccacaatttaccacttaaatttgattatcttttcttcaatttgtttacattttcacaaaatttccacccctttccgcctctggtggcgctgagttggcaattttcgccctgcacatttcgcctcaggcatttttgcgtggaagggccggcccagccgagcgctggccagcccggcctcagaacaaaatgccaatgaggagctaacattagcaaaaaaaaacattatgcaaataagaggacacattcaaagggcaaaaaaggtgagaaagaatgggcagggaaaggaaggggcgggcatcacgagaaattggccaaattgacttggactgatgaggggtcgtgtggggcggcactcgtccgtcatcgatgaatggcacaggaatgtgaataatgaggtgccatggaagggggggggggggaaggggaatagagtttggctaactttttatttgttgaaaagtgtgggcggttgacggacgaatgaataacggacggacaaattaactgtaaaatggtcaggaaatgc

SEQ ID NO: 32086 - DNA, 1361 bp, Heterodera glycines
tactcactcggccgcttcgcggcctcgtgtggggccttcccccccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatctatttttttttatttttctattctttttttttaaggattcggtctccccataaatctgggcgcatcggttcggggggactgccccgaaaacaaaaaaatcgattttttcaagtgtccgtttggggtactcaaacaattatgggaagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaaacaattatggggagcaaaaatccaacgcagaattaaag

SEQ ID NO: 32087 - DNA, 906 bp, Heterodera glycines
  misc_feature (68)..(68): n is a, c, g, or t
gttttcttcttctggggcaatggatttctaacaaatccattttctaaaattctaaataaaacaacgtnttcttaatgggggcaattaacgcaaaaataaatattcgacagaaacaaacaaacgcacgaaataaacgaaggaactattttcagtgacaacgcaatatcgatcaaaaataacaaaatcgcaagtaattaaatgacaataatcatataccgcgagtcaatattgggctcccagtttgagtttatcactttcatcaccgttctttttcatccgttttgtaggcggattgctcaaaaaaatggaaatttttctgccccttatctccgttccgtccgcccccatcaaagcggcggaggcgctttgttcgtcggcaaaatcgacgtatgcacaaccctcggagcgaccgttccatttggtgacaattcgcgcgtccactacagttccgaatttctcgaaaaatttcttaaaaagcataatcttactccatttccctttttcttacttactttgagttcctcgcccgtacacgaccaatccaatttcttcacaaacaatttgttcttctccagtccggcgttgtatggaaaacttttctcggacaaactcggcggcctttttcgcttttcactcgccattttgttcgtttccaaggtcattttctcgtcatttttctccttctttttcatcacttcgtcctttttattgttttggccaatgcacggaagaacggggcccattgggatggaagaagtctgaaaatattaggcgtttcataattatttataccgcctaaaaataattggcataattttcgatttattattggtctcattctagccaactttacttcagcaggaaaatcggaggtactatttccgaatctgccacagaattgtcata

SEQ ID NO: 32088 - DNA, 1800 bp, Heterodera glycines
tttttcaaaagctattcccgaattgaagtcgaaaagtacgaaaagggagaagaggacggtgaccataagctgaagcgagtcggcgatgctcaaagcgaacattaagcgaaagcaaattcgggagcgaaattcgcgcacagacagaaaaagcttacaaatagaaaatgcacaattaaaaatgaatatttaaatcaattaaaataataaaataaaagaccggaagggtgaacagatgaagcaacaaaagtgggaatgccacgagcaattggaaggaggcgaccagttccgccttcatttgacagtcagcaggatgccaacttttggcttttcacctgaaaatctgtgcacggagtgccgtctaaattgtcaaaatcaaagaatgcaaacactccgttcttaaaaagtgaattattagcatttaatagaccgcgattaataaatcaaaaccaaattatggggaatggatcgtctagttcaagttttttggcaattttcatgttatacattgctggcactaaaaattgctcctaattatgccgccacccttctgaaaagaattaagaaaaataaatgaatcaaaatcaaagaatgcaaacacaccgttcttaaatgtgaagcagccctgttcatcggtttacttcaattgggcccccaggctgagccccgaagggtcttggactataacgttttaagttgtcgcccaaatccaataatcggtatttccgaaagcttaacatgtttagaagctatttgtaagctcacaaagtacataaactgtatttgccttacaaaaagcataaaagtttttctagcatgccaaaaagttactaattaaaacccataaatatcgagctttcgaaattcgaataataccaaaattgttggaattggtcgacaaagaaaaaagttatagtgctggcgccaaaacgacccccattccaaagtgtgcccccccactctctgtcaatgtgtgcatactgtagttgatcaagtactgtgaaatgtgcttacacttaggaatagaataagcaggatttttaaaacaattaagaaaaatgaatgaatccaaatttggtgctaatgactcggtccgtcaacatttccctagttgggaggagaaagtcaaatgtaattgaccaaaacaaattcaaaaataattactctctacataaagaaacatctgttggctctcatttctccttccgttggcaatattttccatttctttgattgcccttttccgaattgctaattgtctgtgccttccttttttggcacttttgtcccattgtttgttacgattcggcaaatagccgcaagtgcaatggattaagagttcaattcagagaattttattcttcatttttacagtttcttattttgtctattggtttcgagcaataaaatccgtccaaacacatcgattacaaagcttgggtaaacaataattctattatatgaagaaataggcaaagtctctatcttacaattagttttttataaagctaaaaatgttttttaataatttcacgaaattaaaaaaaaatagttaattctttttgaattctcacattgatagttggttagactgattcaatgttgtcgtagtcctacacaattcgaaatcagcttccgtgggttccgaaaatcactacgaaactcgatgatgagttgaatttggtcgggaacctaccgttttaaaggatctatgtaccagggtttccgcaggtcaagaaaagtctggtctcgaatcggtccaaaaaaaaataaaataaaattttggctataaacattggcata

SEQ ID NO: 32089 - DNA, 1537 bp, Heterodera glycines
gaaaagttttcatgcctaaaaaaatccttacaaaaatgcaaaaaaaaaattgaacaaattttcccaaaatttatttttttttattttttgataatattttttgttaaagagttatccttattcgaagaaaaactttaaaatttttaataattcatttaaaaagtgaaatatagccaaaataagttttttgattaattttttgtgttataaaaacaaaaattttgcctatttttatgcctattcgaggggtttttatgtctatttaatgccaattttgttattttttcagccttttttaggtgtctattcgtgattttttatgcttaaaaatggaagccctagaaataataaaatgggatagtaacaggcttttgtcttacccattgtctgttagatctacaaatttgagtgttcgaattagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagattttcaacaaaaaaaggttgttttttgcgattattaagctcaatcttacatttggcataagaagaattgtgaattttgtcaaaataaaaccaaatagagtctttttcgttggtcatttggtctaaattacaaagaggaaaattgtctataaaatgaacgatgaatgtataaatatagtgaaggtgctgatgtccagcccagaatatgaggaagggaacgagtgagaacgaggattggatttggggggaaaacggaataagccaaaatccgggccctggataaatggcctccccaaattggtaatcccttgggcgcccactagatcgaatacgcgtgcggggatgggcgagaaggagtaaaatataagataaatattggccaatcacataaaataataattccgccgcgctttgctctcggctctcgctcgccgattaactgctcgcccaactgactccttatcgagagaatgctcccgattaaatagttggacttatggaacggaaaatggaatggaagagagcgtggatatgtgcttgggaaagagataaaacggatgtgattaattgcgctttacacgtccacccttccttaagtttgtccgcgaagctttgatttacttttgagttggaatgaatcaaaaaataa

SEQ ID NO: 32090 - DNA, 1025 bp, Heterodera glycines
aggatcttttttaaagaattagattcatactctactgatcatcaaaattgtaatgaaagtagggaataaaaaaataaatattttatgatcagtaggaataaaatgtttatttaatcgtagaatactttagtttttatttcattataatctttttaaaattaatttattgtatattctatttacttatgtatgtatttgccatgaataatattctgtcatataaaaaaaattcatttttaatgttttaaattaatttgtttttaggaatatttcatctttgaaatgaaattatgcctaatattttctttaattttgtttttgctcattatatttgatcaaatcggagcagaaaagaaaaagctacaacaaaaaacatttgatgaaatatttggagaaaaatgggaggaaaaagaagaaaaagaaagaaatgagaagaaaaaaagagaaataatcagaaaattttataaaataaaagaaaaaataaagcaaaaagaaagaaaataaacaagaaaagaatgggataaaattgaaggaaaaatagcaaaaaaattgggaacaaatcgccaatatatttatgaatggatcaaagaatttggattaaatcagagaataaatcattcgagattaaaaactgatgaagaaaaactcgaaattattcgaaaattcaatgaaatgtcaaatgaatataaacaaaaaggaagaaaatattcaaaaaaagaatgggacaaaaattatgaacaaattagcaagaaagtcggaattggctataaattaattaaaaaatggaagaaacaatttggaattagccgaaagataatagcggaggaagaaaaaattgaaaaaatgaaaatttattggcaaataaaaggagaaaagccgaaaatgagtgacaaattttgcctaaaaatgactgatgaaagtgtgatttaatggaactaaaagaatttctttaatttgtaacaattaatgttgagtagtgaacagggcttggcgtaattatggattacggaaattacagcattttt

SEQ ID NO: 32091 - DNA, 1073 bp, Heterodera glycines
ccctcaatttggtggtcctggttggtgtattttttattaatatcgattacttctcgcggcatcagcgtcggcgggtgggtggtggacgttattattgatttttttcgcgcgaccgacaacgatggggagggtgggggtagtgtcattatcgattatttttatcgattaatttgcgcggcgatgcatcggcggggagggatgggcaaaaaaaaaagcacccgtgcggatttgggaaattggattgggtgggcggcaattttaaagtggtccaataggtttcgattctgtgcggtaacttcaaagtggtccaataggtttgggttctgggcggcaaattcaaagggatgcacccctcccataggcatgggtccatgggcggcaacatcaaagggctgcacccctcccataggcatgggtccacgggcggcaacttcaaaggattgcacccctcccataggcttgggttcgtgcggggcggcaacatcaaagggctgcgcccctcccataggcatgggttcgtgcggggcggcaacatcaaagggctgcgcccctcccatatgctttgggttctgggcggcaacatcaaagggctgcgcccctcccataggcatgggttcgtgcggggcggcaacatcaaagggctgcgcccctcccataggcatgggttcgtgcgggaaacacccgtgcgcaaccgtgcgctttgctttatctgctcctgatcccctaatcttcaacttttatttctcgactagccgccagctatatatgtaccgctgaattataactgataatatttatttaattttctaaatgaactcattaaaatgcaagtacttacaattatctaattgtaagtttatattaaatcacagcttctttaattgaacaattttcttctcttcttttttattatgttaaggaatttgatgcactatttactgggtgtttgtatctttcacttgtcaaagcaaaaggaaatttaaaaagaataacaattttttttgttttattttataaagtccccaaaaacgaaaaatccgcttaacattgaggacaaaacatttaattaaaat

SEQ ID NO: 32092 - DNA, 1739 bp, Heterodera glycines
tgattttgtatttaatcaattttatcaaattatctgcaattttaaatattcaccataagcgacaagaatcataatgattgtcattatattttgaattattttcgtcaagtaaaggtattgactttgggaaattttgtcccaaataaatatcgctttcgtctccgtgtttcactttcacaagctcaagtgggtagaatcgttcgtgtccatttctatcgcttctcaatcacgcaaggattattagcgtagcgaagacaaatgcggtgccgtacataaaaatgctggtcgacggtcacattcttgaaaccattgtaagccatttgcttacgggcactttctcttgtaattccaccgtactcaaaatctttgtattcatctagttgatttttgtatgttgtctgtagagttttccctttgaggtatttttctactttttgtatctcatccgggtgatttaagcagtcgcacaagttacgtgcgggacagttcagaagagaagcaattattgtgtctaaacggtccatttttataaatgagttaatgataaattccttaaatagtttttatcatttttttaacaaaattcacgacaaacaaatctggattatcttatcctattaacttttttgtcattttttcaaaattactctcataatttcttcctcctaatgagcacatacaataaataaaataaatgcaataataaccgcaattctcactgaacactgactgaatagctggcttattcgaaatcactttttcataattccgtaaaaactggctgatacatctgttcggtttcctaccaaaactatcaaaatagtagacggtcctatcgtcaacgatgaacattgctatccaatgcgttccttccttattcgaaggatcattattcgccaccaatgttgaagggtacttgttgattatgtttgggagtttgtcgcaagggaagcatcccaagtagagttctctggtctttgtgtttcccgctagaatccgatttatcgtcgttgtgtccattttcgtctctacatatatgcataagcttacataaatttctaattaatgaattaaaatagaggaaaattcctgtcataacaagagctatccacaacaaaaccaaaagcatacagtatacccatctcgataatgacctcgtttcttctacattacaaagttgaaaattttcaacaatttcatcaatcattgagaataattcagattgattaattttattcaagtaggaatggtcaaaggaggctattttataataaatgtcagtcatttcgatgtccctggatcgttcagggtagagaatagggctattataactcgaagaaaaatttattaaaaataaaacaaacaaaataaacattttaaaaaaattataaaatataaataataaatcactttaaatacattaaatggttgtatcggtcattactgttcgatttttatccaatatcaaaatagagtccatttcactcatggctattagggtgatcccacccgatgggacaggtgatctaaattgaatgcacacggtagtcgtcccttctgtaataagatcaataccctcgttgtcctcctggtattagtcatattaaacccaaaattgttcaacccttttcatacttcccaaaaaaattccgttactgtctgttgaactggccataccctaacgccctcattccttttctggaatggcccgtgtatattaaggtttttgcggaaattaa

SEQ ID NO: 32093 - DNA, 1117 bp, Heterodera glycines
gtgctccaggaccaatttttcgtacgaagacccccaattttgcccggcgacgaccttttttttttgctattctgaacactttttctgacgaccttttttttgttgctattcaaaccacctttttttgcggcgcgttctttccaaaaaactttgtgggaaggggtggagcggtccggcggtgccgataggcgccgccgggaaaatttttttgaattttctatgggtttcgctacggaaattgttcaaattttaacttttccccccttcgttacgaccccccccccctcctttacagccgccccccttacgacgaacgaggggggggggggggttgaaattcggagatttgaataaaaatgaatttttttcaacaatttttctcgatgggtggtgggatgaaatcttcccctggtacagttttccaaacaaaaattcgctaacttttctccaaaaatccacaaattagcgatttttcggagaaaaatctattataaatggtacaaatactcaccacttttgaccgtttgttggccaccactccgtcctccttcccctcctcgtcgttgtcattgccaccgtcttgcgtctgttggtgccgtcgcgtgtcaatgtggtgctgctgggcctgcacaaaagtgtcccatggcggaatcacccaatggtgtgagtccttctgaacagggagaaaaagtgaagtgtggagatgaggcattattgaacaatgaaaagggcatagcgattggaaacaaaaaagagacgaaaaattcggaggcagttcctttcccgccccccgtgtcgttcccccccccccgaaattttttttatttttttcaaaaaaattttccaaaaaagcgctgaaatttttttcttggaattttcttactaataaatttcctaagatttttttgattaaaatttttaggtttgaaaaatattcgggggggggggggggaacgacccgggggaaatgaagtgcacccaaaaaattcatgccctggcggcccgaattattggtattgtacaagtcgattgtgccccttctgaggaatttttcctggttaatgaactgcttgcccatgttgccgcaccggaattttacaataatctagcatcggaa

SEQ ID NO: 32094 - DNA, 1020 bp, Heterodera glycines
atagttatgcgttttgggggaaacccccacatggtacaacggtgtagaaaaaaagagatagccatttttctgagaatatctattcttctgagaaagcaattttcaacccgacattttgtagggctcaaccgcagatagtaatgcgtttttggggaaaccccatcatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaa

SEQ ID NO: 32095 - DNA, 780 bp, Heterodera glycines
atcactgcccaaataaatgaaaaccatctgcccattgttttgagcttctttcttttctcgcacaatcccatttctgacagcgcgccgtcgagtggattcatagagtgtgcatgtctctcacatttccttctgtctgtgcctccccctcaaaaaggtgcgtcagccgtcgtcgttctcccaaagccttccgccggccaatcgatttgtgaccattaaattttgtctggttctttagccccttgcccacttctcatcctttaatctaaacaatcccttgattcatccatccatcttcatcttttctggttttctaaatgggaaaattcggtcgcattgatgcatggaaagaagccgaataaagaggttgaatggtggagatgtgtgtggaagtggaagggttctttatacatatatgtgtgatgggatgagttgagtggattggatgttcggctgtcatcccatcccatttcttgactccgcttgcctctggcgcatcctcaattcgccagtcgaccggcgtctatcatcaatcaagcgtcaaaatgggcacaagaacaaataatactgaaatctccgcttcctgatgattttattctttgacataaataaataaatttaactacaatttgtcattttcaagattaaattcaagattttcgatggcagctgttgtcgatgaggaagattctgctgagtcaattgcactcgcagaaagccaacttttgcagacgtctgcgcattcgggcgttctcagcacgggcggacgacaaacccaactgt

SEQ ID NO: 32096 - DNA, 1418 bp, Heterodera glycines
ttgttcgaattcgggtccgggatcccgaattgatcgaaatcgatgccatattcgtgatcagcgacttgaaaacccccggatacttgttttcaggactttttaaagcaaaaaaaaaattaaaaaaaaatttcgacccaaaaaggggatacaaactgaattagtagtacccagctttgcttatatattgcagatacaaacgaacacatatttctttcacaatgtcccaccccctttggcggcgtgtctcgagaattggttacgtttccgttttggcgggtgccaccgccggtggtgcttatgtcggcacagtaatctttaaattatgtggtgcatggtttttcacaaattagttttgtttcacagcaatattaccgccacgggtctctgcccgagttgccccaatgggcgcaacaatttgccgatcggatgccacagaatggtaagaatcaaatgcaaatcattgcattttttgtgccaattcggtgcccgattcaactttttgtagccaattttgtgaggaatgtatgccatttttaagaccagcgaccataaaatctcaaaaaaacgcaaaattttacgagttgcacaaattttgttggtaaaagggctgttgttatggaagacaaaaagctgtaaaaagaggggggagcaatggcattggcacaaagcttggcactttttgtaaatcccctatttagttgtttcacttcgtccgcaaaatgaaagtgtggccaaacaaagtggcactgagcggcaaaaggcggaggtaattaatgtaattagaatttgctgtaaaacaattaatttcacacttaatttaggctgtgaacgcccaaaagattgccgaactcgagaaacaattggcggaacagaaagtccgattttccccacattttttcactgaaatttgttggcattttaaggcattggaacggcaaaaaattgcggcagcggtcgaagagcagcgcaaaaaggacgaaaggtatgccatttgggggcttattatcaatttgatggaattttgcgaatgcaataggcaaattgattcgatggcattacaggcgccgtcgggcaaaatattggcgcaacaaatttttagaatttctattttttgtcacgagaattccccttccgtcatcccttttattaagggtctttatgggctattagctgacgcttaattcaatgacttttgcattcaaaacaacttttttgtccttccagaaaggccttcgaatcctccgagccgaaacgaacccgtgacagtgcagcaattgacccggtcgacctgaaggtgtgtttcaaaaggaaaggcttacaatttgtgtccttatctatgtttttttaagaaggcgatgggcgtattttcttgaaaatgaggagtttataggtttttttggaatttttgagtttttttt

SEQ ID NO: 32097 - DNA, 825 bp, Heterodera glycines
  misc_feature (811)..(811): n is a, c, g, or t
cgtaaaaaaacctcccgagaagaatctccacggaccaaatccaaattcgattttcatcccggaacgagtagtacattcttcaccacccactcgcaatccgcctcagagagaacgtcccgctcagcccggacatgtgccatctattaatcgaaagttggctaaaaagaggcaattgactgactgacttgttccttctccaacatttcggacttcctcaaaattttcattgcataaatgtgaccagtatcaattttctgcacaagtctgacttcaccaaatgcgcctctaccaatcacctacaaagcaatatgcaaagagaacaagaatttgattaacctttaaggattgaaaatcattcgctgaaagttttgttcttcgctgtcgcaaaaagtcgttttctttggcagcgtggattttcctcctgtcctccttttctaactcgtttagcccttcctccgccatttgtttttcgagcttttctgcacgttgttctcgttcggccaaatggaccaccgcttgggcataataactttcgattgacaagcgcgttctgtttgctttatcccgcacatattgagaagcggaagtcattatatttgagtgctctatcaccagcagaatgagatcggaattcatcaaaattgtgagtcaaatttttcaagtcccgggttttgaattagggttggacccctaccgtcggggttggaaaagtcggggtcgaccaaatcgttcggggtcggggtttcggggtttttcaatttttaccttatgcctaatagcaaaatttggtttctagtcggttttatgcgtnccatgtcatattat

SEQ ID NO: 32098 - DNA, 1062 bp, Heterodera glycines
  misc_feature (16)..(16): n is a, c, g, or t
  misc_feature (55)..(55): n is a, c, g, or t
  misc_feature (1024)..(1024): n is a, c, g, or t
atgcaaaaattggtcnaagtggaattttgaagcccgccgagaaagaaattgtttntaatgaaatttgttaagaaaataacattttaaattttcttttcataataaagttttttagagtcgcccgtcgctgcgaaaaggacgggtttttgaatttaaatttaattccatttcattttccaacttaaaaaatccaaaatttggtagttaaaattctttttttgttaaaatctcattaaatttcgaattgacactaactctcctcccttccccagaaatccaatttaaataagctgtcactcttctaaaattatgactccagagcatagtatcatccccaaaaattctttaaaaatttgagtttttttaataaataagaattaacgaaaattctcgtcctttgatttcctccaccttttcatacgtcgatgaccacctccttcggctcggctgttattgctgcgcgaccttttcctgttcgctttacgctcgtgtgacttagaacgcgaccgacgctggcggcgctgccctcctccgctggttgccgacatcggactgcgactggacaccgtccgttcgggcgtaacttcatcgcgcaatttcaacttaaaatgaatgatacaaatcctttccaaaataataaatccaagcatttctccacataacattaagattaaataccttcaattccgccaaagtggcagtgatttttgcatatccgaggtgttgtctcccctgcatgtggtcatcaatgcttaattcaaaataattgcaacataaacaaaatgaggttttttaccgctgctgaacatcgccaatgatcaaaaaacttccgcacacttcgcacacgcgcatcggtttcggcgcgttcgggtctttgtagccggcctggtaaacctcgcgttgtctcgcttccgggtcaagcaactgaacatttgttcaaaggcatgaaatttcagcgtaaattttattggaggaataaaattatataaacgcacgcactttccggacgttctccaactccgcngtgacttcctccgcccgtttcacatatttctgagattt

SEQ ID NO: 32099 - DNA, 738 bp, Heterodera glycines
attaaaattaaaaatctagcattaatcatttaaaaaacccaaataatgttttgtcacaatgttcactttatcaaaatctcaaatgcactaatgggataaaattaaaggatgatatggaatattttgttataagttcataaaaaaattcataaaaatttatatttaaaacattactaattcaaaaatagcgaattcactattcataaacaaaattacgtagaagctttttcaatttttccacaaaaaaaaacattagtaaataatgagattaagaaaaattttgcgagagccgaatgaggaaccaccgaattttgttgtttcggaggcaatccgtcccgcaaatgaaattttagagagcgggagcattctcggcggcgagcaatttcgacaacgacatttggaagtgaatgttcatgaatttgaaccggcagcaaacgaagaaaggatgagtgagcacttagcgttggtggcaccaatggttaatgcaggttcggggcatctcgaaaattttggaagaaatatgggagaacggaatgctgtcgaaataagaaatttgccaccgaatggccatctttttggagacaatggaaactttgaggatggttgggcccgatcaccgaactcaccgttattcgaatcaagtcgccatgcttatctgaatgtgggtagagctgacaataggggaaagcatttaccgccgaattttccatatcgtgtcgtcaattcgtatgtcaccgg

SEQ ID NO: 32100 - DNA, 1691 bp, Heterodera glycines
tagggctggaaatttaagtcaatgactttttttttgttgactctaaatgaccttcaaatgactaaaaagtgttctgaactccgtttgaagcttctaacatgcattgtttgtgacttttttttgactttttacactttttgggatttttatgactttttgaggcaaaatttgaattttatcgaagaaaatgccgaaaaatacaaagaaaattccgaaaaataaaatttcgacaaataaaaaggcaatagaacctggatgaattttttcttaattgttggaagaatctcttttttatgcctattttaggtacctatttataaaattaagtgcctaaaaatacgatcaaaatgttattctataaattgttaaaaatgggattttttttaactttcacctaatttttcaggacttttttgcattttttacgtgcttttttggattttttcgtgactttttgaagattttagtgacttaaattcccagccctaataataatttgaaaattaaattttttacaattgtctaaataactcctttacaaattttaacaattttgtctatggtttttcatcaaaatcataaagcgcagccaagcgggatcgaaccggcgaccccgtcttatatgacccctaagggatcaataattaaatttcaaaaacttgacttctcagaagattcaagagctcattcgaaatttctttttgagctctacaatatctgtgtatgagttttttacttaattttttttaatgaaatacttgatgaaaccctatttgaaatctatcatttttttaaaaatataacttcagatttaggatcaacgacttttttaccccaggtttattgagaaaatttttaactttattcttccatcgggacaccaattcaccagtattgccaataaatgtatgtttttatattcgaacgaaagaaatcacaaagcatttatgagagaacatgagcatcaaatccgtttcccaattggtgagatcggtcatttctcaaatataattaattcattttcgcgcaattagacgacattttcaaaataatcactcattccgccgctgttccacttggccccgggagtcgtcgagaacatttcatcgttgctttgacccgctttttcttcttcgtccgctgggggcgacaatggcctaaaattaaatacaatttgaatttggtgaatgaattacctatcttttacacttacccaatgaaattaactgcgatatcccacaaaaaaaattggacactgttcaaattgtcatccaaatgttcgtcgttttcccattgaaccgccgccgccatctccccaacaattattggacatcgcttcaacatcccataataattaatgacttcaccgtcatccataatcagtgtcagtttctcattagtccgttcgttcaccaattcaaatagctcaatttgcgttgaattgttcaatttgaaattcatttggtaactgactgaagtggtggcacggagaaatgtctaaacaaaataaaagaaacgtaaatcaaaggcaatcagtcaatcaatccgccaaatcccacgccggggacaaaatcacgccgctagaaatttttaaaaaaattttcaaacctagaattttttcatgaaaaaattcttagaagatttcttataaaaaaattttaaggaaaaaatttgtttttggaaaattttca

SEQ ID NO: 32101 - DNA, 1285 bp, Heterodera glycines
  misc_feature (91)..(91): n is a, c, g, or t
  misc_feature (101)..(101): n is a, c, g, or t
  misc_feature (121)..(121): n is a, c, g, or t
aaaaagagatagccatttttcggcaagatttttttcgttagcatttcaaatatcgtgtgagtgtttggtagagccagactagagaaggcanatgttggtancaagttgcgggtcaaatccncaagagaaaaaagagatagccatttttcggcaaagaatttttttcgttagcatttcaaatatcgtgtgagtgtttggtagagccagactagagaaggcaaatgttggtaccaagtttgcggtcaaatctagagaaggcatatgttggtaccaagtttgcggtcacatccacaagagaaaagagagatagacatttttcgacaagaattttttcgttagcattacatatatcgtgtgagtgtttggtagagccagactagagaaggaaaatgttggtaccaagtttgcggtcatatccacaggagaaaaaagagatagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagacagccattttttcggcaagaatttttttcgttagcatttcaaatatcgtgtgagtggttgggagagccag

SEQ ID NO: 32102 - DNA, 1404 bp, Heterodera glycines
cagtagcaaaaacagaatttggtaagtgataaaatgccctttaaaataaaaattgacctgaacaaccaaatgacttcgctccacgactcgccacaactgacgccaaatttccaaattacgttcaaagggtgtgatcacaatattacgctaaaattgggacaaaaataccattgatattacttgatatttacaatactaacaatacgacatatcattggagcaggccatttccagaaattaaatgccaacccatcaaagctaacctcgctcagtttggccaattgtcgacgccaagcaacaaattcctcggcttccaacgcgttcagctgttctgcatcttcgtaagtgttgggccgaggacgacgcgggattcgcaacaaatgaccataatcggcgttcaatcggtcaagcgaattggccaaatccatttgttttgtggaagaaattgccacattgccattgctgaaattgtgccaagaacaaacagtatgagaagttgagaacaaaaaagggtgaatgccaacccggacaacaatttgatgtccccgcgttccgcctcaaatgtcgaattggccaactccgcgttggtgagcagttcctgcacgtccgactcgtgcgttttcgactcgagcagcggcttttgcgtggccgtatgtcccaccgattgtcttgcactccttccccgtcctgtgctgtgtgtttgtgcgcgtgctttgctgttcaacaacgccttggccagcccggcgttgaacccagtcagctcacatgttttgtgtcgtcgtttcgtcataattctggcaaacaaaaaatttaactaacaataaaatcaaaattatttaaattgtatataagcaaaaaaaaaaattttcagtacttctatgcctatttgttagggggaggatttcatggtagattttcgattttttttaaatttagtcataaaaagtgtttatgtaattttaggggccgctagtcctagtcactgatcatgaatagaattcgaaccccgaacaaaaagccaaaaattaaaactttcttattttgcgttttttcgggcgacctttacagtcccagaaaaaatcttcaatttttagagttcatattttattttccaataaatttttgatgaaacaatagaacagcttgaataaatgtgcagaacaaatcagcaaaaaagaaataagtttttcgtcgccgctaattggcaccgtctcgagggtcctcctgaacgataaaatccggcaaaggttttttctggggctgcgcctgctgcgggcccggcccgccgtcattttccgcgtcctcctcgtcctccggcgggggcggggcctcgccccccggcggcgcctcgtcccccggcggcgcctcctcctcatgttcctcttcctcctctcgcatacgcat

SEQ ID NO: 32103 - DNA, 1332 bp, Heterodera glycines
aattttcttttatatgaaaactggtgtaatattcctctttgctgagaaattataaatatttgtgctactcatttcttattatcaaatatattttattatttttataattttagatttatgttcttttgtaattcaactcaatttgtcttccttgcattatatgtttagtatttgtttgaaggcattaataaattaaatttctttttattcatattgcattgattttgaacaaagatgaattttcttggagcggacgaagttcggccgatttttgtttgctccttttggactctccgatacaaatcccccattatcaacgtcttccgattggccttttcctataattgatgaaaattggattgatatttttaacttgaataaaatgtttatttaaaaattacaattaaatttcgtagctaaatataaaaaatttgtattgcttcatacgactttaagaatgatgctttcttttctttatttgattagttagttaatttggtactttaaaattataaatttttattttattagtcattaaatgggtcatttttcttgctctcttcgtattgctcttcaactcattttgtatggttttttaatttttatatgtttcattggtaaaacaaatttgaactaatttattttcaatcttgctaaaaattgttgtgttttttgtactttaattattcttaatgtgtattagtgtttaatatatttttagctgcaaataattaatttttgtttaatttataatgttatttcactattctatttgcataactttacacccttttgtattttatgcgttgacactcctttatatttataacattttacaatttttaagcatataagcttatatttactttatatgcctctattatgtattcataaaattttctcgaattattattttgttttaatgcttgcttttattttgtttttttaatgtttaaaatattaaagttaattgttttaaatttttacatatatttaacggaggattttctatgcaacaaatgcactgatgacaaaccttaatataaatttatttataccagctaacttatgaaaattaaaatttacaatataaagtttaatttcaaatttattattttatccattaatatttacgttcattatcatcttttattattcttgggcttctagtttaaaacttttaatattataaactttatatcaccgtttaaatattgcttcagttttaaatcatgtgctgtcgaagcaaagctccatcaatttattctgcttgtttttattaaattcattttataattatttttgcctttctgcacattttcatactaggaa

SEQ ID NO: 32104 - DNA, 1150 bp, Heterodera glycines
  misc_feature (9)..(9): n is a, c, g, or t
  misc_feature (56)..(58): n is a, c, g, or t
  misc_feature (60)..(62): n is a, c, g, or t
  misc_feature (67)..(67): n is a, c, g, or t
  misc_feature (101)..(101): n is a, c, g, or t
  misc_feature (107)..(107): n is a, c, g, or t
  misc_feature (117)..(118): n is a, c, g, or t
  misc_feature (138)..(138): n is a, c, g, or t
  misc_feature (140)..(140): n is a, c, g, or t
  misc_feature (156)..(156): n is a, c, g, or t
tgttgatancatttggaaatgtcgagcccgcctagcgccttttaagaacacaaaannngnnngcatnagccaccaaacaatctttttatgacgcgccgaangaaaangcacaaaaanngggcaccggaaaaacggcanancggcaggggccagcanaataaagtaaaccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccatacctcgccagagagtggagatagaccctttgttgatacatttggaaatgtcgagcccgcatagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctaaaataaattatctc

SEQ ID NO: 32105 - DNA, 1465 bp, Heterodera glycines
  misc_feature (34)..(34): n is a, c, g, or t
  misc_feature (47)..(47): n is a, c, g, or t
gggaaaattctgacccaaactattaattgaaacnccaatcaaaactnggaaaaattgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatattacacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagacccatgcttctcccaattgtggcgaaaacaatatttcacatttcacttcataactttttgagttcggcagggatcgagacagggataagaccattggaaagaacagctcgagctttacaagaagctatggaaagaaaaaatcgacatttcagggactttttcagaaatcatgtttaattccccaatggggccccattttgggtcctcatccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttcgtcacggatcgagaccgggataagaccattggaaagagcagctcgagctctacaagaagctatggaaagaaaaaatcgacatttcagggactttttcagaaatcatatttaattccccaatggggccccattttgggtcctcagccacagccccatgcttctcccaattttaagtcttggatttgtcaaataaattaacgatttcgaattaataataaaaaattctattataattttttttttgtagagggaaaaattctgaaccaaactactattttaaaacccaatcaaaactgggaaaaaatttgaagtcaaaaaattattcgaatttctcccaattttgtttcccataatttccga

SEQ ID NO: 32106 - DNA, 1354 bp, Heterodera glycines
ttagccccatttttaaactgtattttctgtcccccctctaaagtttcgacgtttcttgactttgtccgttcctcttgtcctccgcgctgacttttcgcattcgattggcagccccattcagccgaaacaatggctttgtgccgccttcagcgatgctcggtggatgcgacaaaataaattggtgcttaatgccatccacggagatgccaaaggccgttttttggacggagagcgtagaacgacgaaattttgtggaggaatttgtaacgggttggcactgaaatggaaaggaatgattggcaaaagctgttttggctttggcctactgttccacgatgaatcggcatgccagcggcgtaactgcgcctgcgttgtgccgttactcggttggccgtgccaattatgcccttgtcgtcggtgcgactttggtgtgcacaggatgaactgcagttttggaagagtacgccatgacgaaggaagcgtcatttacttgtacaaattggcatctgtccaagtgggccaaaaggcattgcccgtcggcggattggtgccacggcggaaaggcgaaagggcacaaaaatggcactttaaaatgcggagaaacatttcgcggaagcgtttgttgaagattgtgtagatgattgggttcaccttgagggggaagaaagtgtggtcaaatgccgcgttatttatttgcattttacggtggacgagcagtagccgaaccaaagggcacagagcgaagcccaactcggaaaaacgcactgctgcaacccgcagaggcccacaacgatgttgaggacgaagaacggagtccaacagatgaaaaaggaagagaacacgacgatgagcacctcaaaggggccgactcattgccagcctaattaccccctaatactcaccctcgtcgccttttgttccgatgccaattccgccgtccgttttgccctcccccggcggactctgcgccggcggcgctgccgcgcgttcgccgtttgcgaatcgccgctgatacttccggatgattttcgcaataaacttttggaccaaagagacgagccgaaaagcgaactaattaagaagaaggcattttgttggtctgatcagtgagtaataataatctgatcactttttacctttttctctgtactttttgctgattttttttttgcaaaaattcgtcgcattcattcgatgaactttttgagaccaaatgacgagaagcaccgttatttttactggacaaattatcctaaatttgttgactattataattccgctttttttaaattatttgtgcctcttttctcattttttcatcggttgcgactgggaaaaatttgatgatcggtga

SEQ ID NO: 32107 - DNA, 1790 bp, Heterodera glycines
  misc_feature (1704)..(1704): n is a, c, g, or t
tctttctctctctctctctcctcttttctatctctctcctcttctctcccttctctcctctctttctttctccctcttctcttttttctctctctctcttcctctctctcctcgttttctctctctctcttcctctctctccttttttctttctctctctctctctcctcttctctccctcctcttttctatctctctcctcttctctccctcctcttctctctctctcccttctctcctctctttctttctccctcttctctttttctctcttcctttctctcctcttctctctctctctcctctttctatctctctccttttttctttctctctcccccctctctctcgcttctcttatttttatctctctctttctcttatttgtctctgtctcattcactcccatactttctctcttttttcctgtttctctaatcatttctctctcctttactctccgctttttgttcctaactgtcttcatctctctctctccttcactctttcttacaatacaacttatctctattatctctgttttttcacttcatttcttccatccaaataaaaacaatcgcgtcaaactttatttaaattttttgtttactttgtgacatacattacgaaaattaactgcataagtgacccaaaagtccttagcgaaatattcgtgagtacatcttataggtatgtcagcctttctggctgttttgttgttttcgatttttccaataatgaagaaatatgtgctcgctcataacacaaaaaagacgtaaacaacaaacagaaaagaaaaaaagactgaactattttccaaaaggaattcatttcgataaattgtttacttttaaatgtattagttacagcgcaaaattaatatatagatggcaaaatcgtttattttggtgaaaatctgttaactaatttcactcagtttttcaaaagttttcccggcgaagtttttggaaaaagagcactgcaaaaatgaacgttcttaatgagttttcttcatatggagtaaaattcaccaaaatgatgatttgaccctatatgatgatttttttttgtcggccaaaagctgattttgaaaatttaagttcggagccctgcatatgctcttgtcaacgatgtgaaagaattgtgaaatttgtgactactcatttttggaaccgatctctgcttgggcttatttcaatttgcctcatattactgatgagacatcatatcactgaccagaccaaatcattttatcaaaatgaaatataagacatcagccaaattccgtctcagttaaatttaaatttcttttttccatcaatttcctgacgtcttaatttgctgtggtgtcagaaatatttgcaaatagaaacagcattatgaaaaatatgacgtcaaatcagtgattgatcataatgttttcgtcacagacggcaatttctgtagatggatatcaaaggaaaaagacaaatcgcttttaaatgctttatgcatagatatatgacgtgtaagcattttaatctgtacggcacttccaaggggggggggggctattggcagtataatctaaaaggtattttttgtttgtttgaattttggtatttaaaatttattaatgaatttattgtcaactcttcaatttaattattcaaatttgtatttctaagttctttttttcaaaaacagaaaagaaatatttggaanaacattgtacactagagcccgcccggtgcgggactggatcccgcgcgggattttgcgggatccaagtcatcaaagtcgcatttttt

SEQ ID NO: 32108 - DNA, 1435 bp, Heterodera glycines
ttttttaatttttttccatgccattccctaatttttctccttggcacagaaatggaaggcggtgacacggtgtctccgctggacaagtgctttcgccgtgcccgttacattcgggatcaggcattggcattctcagcctcggcagtgttcgctgaccccaaccaactctttgctgccgattgtgaggaggaggaagaggagaaggaataaggggagagcgagccgagtaacccaccaataattcaccacacacatattttaaacacatatttttttttctgaaattttgtgtcatttattatacaagaaaggaaaatacatcatatacccattatttttgtcgaatttataaatttcaactagggctggtcaataaacattccagaaaaatggctatctatttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccgtggccattttatttttcaaataatttttaaatttaattgatattccagaaaaatggctatctctttttttgagaaattttctatgcaacaaacgctctcgaacatgaaacgaagtgcggtgcgccgtggccattttatttttcaaataatttttaaatttaatagatattccagaaaaatggctatctctttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccgtggccattttatttttcaaataatttttaaatttaatacatattccagaaaaatggctctctttttttgagaaattttctatgcaacaaacgctctcgaacatgaaacgaagtgcggtgcgccgtggccattttatttttcaaataatttttaaaattaatagatattccagaaaaatggctatctatttttttgagaattttctatgcaacaaacgctctcggacatgaaacgaagtgcggtgcgccgtggccattttattttcaataatttttaaatttaatagatatcccagaaaatggctatttatttttttgaaaattttctatgcaacaaacgctc

SEQ ID NO: 32109 - DNA, 1597 bp, Heterodera glycines
caaagagaaaaagaatagacaacccgaatgttattgattttatttaaaaaggacagtaagggatgagagaagatacagtaagattcagggtaactatcggtgtggagatattgccgagtatggaccacttcagtctcaaaaatgattaaacacaaattatggcgattgtactattttcgatatttcaacatctttttggaaaatttattaactgaaatgaataagaaaaaccaaaaatacacccgccccctaagaatcgaccaaacttaaaaaatcattctcacattatcaaagcggcaccaattcctatcgcatccttccattgttggtacccgtcctttggcactaaacaattaattaataatcaagcaattaaaactagggttacacgagtccggaacccgaccgggtctcagacccggatgcccggttttttcaagacccgacctgaactcggtataatttaatttacgaatacacaaattataattttattaatatgtatattataaaaattataatttattaatatatatagcttataaaaatgtattaataatttaatttacgaatacaaaattataattttattaatatgtatattataaaaatttattataatttaatttacgaatacaaaattataattttattaatatgtatattataaaaattataattttattaatatatatagcttataaaaatttattaataatttaatttacaaatacaaattataagaccgcccctgctggtcccgaatatttttcatgcttttttaaaagtataagcatttcttaatgaaaaaatggaatttttttttggattcttttaggacccgataccctggcctggaaatacccggacccggcttttctggacacggcttttctggacccggcaatacccggacccggcttttctggacccggctactatccggacccggcaatacccggagccggcttttctggacccggcaatacccggacccgtgtaaacctacttaaaacatttgataaactacactattatggtaaaattattacgagctctttcgtcgaatgtgattttgatcggggattcggtccatttttggcgtgcgttgtattgtcgttttttccgctgactttctatttcttcgggcttaagcccacaaactgtgaattttaatttggatttgtaattaatttaattacttaattaattaattatttgttaaatttaactcactctccctcaatctgttgtactgttctcgcagcgtttgtttgtcacatgccatgtccccatcgcatattaatgtttcggatggctttttccatggcatttctggcggaagtggggcccagtctggctttttgaaaatctgaaattatttttaaatattattttaaatttttattttaccgcattgttttcgctttcgttctttccacagtttgccaatgcctcaattttcaacaacaaatttctgatcggcacgcaatctgcgccgtattcatcacatgggtctagactgtcttaaaaagtgccgaaattaattttttaaaaattaaatttattttttactgactgaatttgttcgggtcat

SEQ ID NO: 32110 - DNA, 926 bp, Heterodera glycines
caaagctctacaataagtctgctggccaccccccgcccccactggccctggcgcggtattcacttggtactgaagtctattttttgagcacgcttcagttgccattttttgcaggccaggggtttgctcaaaaaaaattttaaaaaataccagcatttagaggacactttggcggagtgccctcacagcgggcactttttgattcgagttttacaaaaaaagttaggggccttcaaatgcaagcaaaagtgagaaattagccgccgggactcagttggccaccggaccggaaaacccttatttttcccggatgctcctcaaaaagttgtaagacccttccactactttcagggcgctcccggccttcggccgggagaaaatggttttagcaacgaaactccttgtcaatataacatatatagtaactagcgggtgcgtgaaccgtcggctatttagctgggaaaaagcgcttcgcgctttcggagcttcgctacctaggctgtaaagcgattcaaattgatcgaattggttggagatttttttttgaatttttaaaaaactatcgggttgtgaaaagatttggaatttttaaaaattattagcgatttttaggccgcttcgcggcctcgaacgggcacttcgcgcccgtttctaatttttgttatgcttttcggccgcttcgcgccgttttttaaattgtgctgagtcggacgggcgcttcgcgcccgttattaaattttgatggactcagaaggacgcttcgcgcccttttttgtggcctttttaggccgatttgcggcctcgaacgggcgcttcgcgcccgtttcagatttttgttgtgcttttcggccgcttcgcggccgttttttaaattttagaacagatacaatagtgattagaagaggtacaacaggtattagaagagg

SEQ ID NO: 32111 - DNA, 974 bp, Heterodera glycines
tcactcattggacgcgtaaactggaatagagcccttgttaggtaaaacgaaaaaccctgaatccttaaaaaaaattcacgacaaaaaaatgatttcagaatgatgaaaaatttcttactttttttggtaaattttttttttgtttaaaaagtcatttttcagtgaatgtttgcctagtcaggaaacgggagagagaaatgcggtcgggttgggtttggcggtcacttagtcaatagtcgatggacggagttatttggagacggaaggacggattggggagggatggaacatgaggaagaaatggggaataagacaagatgaatttttgcactgcaaatttttccatttttattcaataggtatttttgaatttttcaattcataaatatttacgggccaggacgttttcgcgtgagggccgttttcgcgtggtagaataagctagctatttttgcccacccttgcgatttttgtccaagcgatttcgaaactgcttaataggcttgggcactattgagtagtaggcttaaacttttgagtatagctctgctcattctgaaccaaatccagaaccgatgacaccattagaaagagctccttttctaggttttaatagattaagctagctatttttgcccacccttagcgatttttgcccaaccgatttcgaaactgcttaataggcttgggcactattgagtagtaggcttaaacttttgagtatagctctgctcattctgaaccaaatccagaaccgatgacaccattagaaagagctccttttctcggttttaatagattaagctagctatttttgcccacccttagcgatttttgcccaaccgatttcgaagtatatgggggtttgtgggtgtgctgaacacgaatttggcatccattttgggtcttgttcgacttttagaccaaaagtctaaaagtcttacaatggtcgaacagggaaaaaatggatgcca

SEQ ID NO: 32112 - DNA, 1281 bp, Heterodera glycines
ctcgacgagaaatgcacgaaaaacacatttttagcccttaaattcttcgttttaacgccactattcatcactaggaatcactattttggagcttcgccactaaaaaaaactattttggaagttggccactaaaataattttttgccactattttggcgtttcgtcattatttttgccactattttggcatttttggaaaatttcccaaaaaatgcaataaaaacgaaaaatacaccccaagaatcgacctaaaaattttcaaaaatacacccctaagaattggaaaattttcacaaaaattcttccccaaattttttttttcttgttcaatatttgctaagaaaatatttttgtaactgcaatcagtgaataaaatctttttccttaattttaaattattttcaaattaaaaaacagcctatttaaaaaattacacccctaaatttggaactttttcgccactatttttgccactattttgccatttttttgtcactatttagttaattatttggggattttttatcactaaaaatccgggccctagtggaaagtcaggagaaagtcagcctctgaattttaaatttaactgttttttaaatgttttgcgccaaaagtgacaacttttgcctgcgcccatatttcacgagttgaacaccgagaatggtgctctcgaacatgatactcatttaaaatctgaaccacgagcctaagttctaattaaattataaatttcaattgcgtcttaagaaaaacctagtcaaattgagaagaaaacgcagtgggcaaatcgatgcatgagagagagagagcgaaagagagagagagacaaagagtcagagatacagagagagagagagagagagcgaaagagagagagagacaaagagtcagagataaagagatagagagagcgaagagagagagagagagaaagagtcagagataaagagagagagagagcgaagagagagagaaagagtcagagataaagagagagagagcgaagagagagagagaaagaatcagagataaagagagagagagagcgaagagagagagaaagagtcagagataaagagagagagagcgaagagagagagagagaaagaatcagagataaagagagagagagagcgaagagagagagaaagagtcagagataaagagagagagagcgaagagagagagagagaaagaatcagagataaagagagagagagagcgaagagagagagaaagagtcagagataaagagagagagagcgaagagagagagaa

SEQ ID NO: 32113 - DNA, 969 bp, Heterodera glycines
gctccgctttcaattcgttttgtgtatatccactttcggctcattgacccgtcatatcgtctactggtattattatgcgctgtacaacaatccaccaattgtcctagaattctgaataaagtgtgtcctaatttattagtatttatttgtttttttcgtgattttgtcaatttattttgaataccgtgccattgataatgaatggtaaaacatcgtctttttccattaagttttgatcggcaaatattgtgcagggttgacttaatacaatcatcagtcataatggacacgaagcaaaaggcgaagcagttgatgaacgaattgggggagatcgacgccctaattaaacagcacggggccgttctcgcggaggttgacacaatttatgagggttgggagattattcatcagcaaggacgtatccagacccttggcttcgtgtggtggggtggagaaattgctttttagggtgtatttctttgggctttttaatttgttattgaatgccacttttaaagaatcgtattggtatgagcgagccgttggtggatgctaatgggtttccgcgagatgacgtggacgtccgcgctgtgcgaattgcgcgtcatgaaattaattgtaagtgttcgaaaacgctctttcgcgttttgttcactggggtttctcccaattcatgtgatatgttgcaacccgttttaaatttcactagattgatcaggacggaaccctgtcaaagtcaaaaaagttcgtatccaggaggaaattgttgaaaaacctttttggaatcaaaatcttaggattgatttttttgttttgttttttttttgaaaaatccttggtcctgtatacgatcctggtacttaaaacaaacggaaccagcagtccagttactctattattgatctctctcgaaaatctggcccggttttcaaactttaccacgtgagtatttcctggagaaaaagaaaa

SEQ ID NO: 32114 - DNA, 1389 bp, Heterodera glycines
  misc_feature (11)..(11): n is a, c, g, or t
gatgaaagtgncaatgcgtcggatggccaagcggtgaccaaatggctgttgacgcctcgtccggatggtctgccgaaggagcttatatgccctgttaattcaacggaagagcaatggtcgtcaacggtggaacactttaaagcggtgattatcccaatttaattgtttttttccatgattttttgtcccatttttaggcattttccaatgcttcttctccggttacttttcgcattcattttctgccgttttctccgcttgactcggttgtgccatttgatcagatcaacgaagtgactggggagaaattgacactggaacaaattgagataaatcatttttggctcagccgttgtccaattggatggaatgagcgaaattttgaaaatgtgagtgcggaaatgtatgttcgaccgaacccaattcatattcggatcagagacgtcggattcgacaatgggtgaacaattttttttaaaacaaaaatgcacggttaatggacaaaattgtgatacaaaaaccatgtatggttaggttgattggactcataaaatgcaattgaactcataaaaatttaatttcttataatttgcaatggaatgaatcatcgttttttcagtcttctcgacaacgcttctcccgggtctagtgatcagcagaagaaatgaattaatcaattaattgatgcgattatgatgagcgaaatgatgttggcactgtgccatttcaatattgtattgtgcataatttgtttgtttgtatttgacctttgcttgctcgcaaatgcgtccatttccattgtatttatgtgcatttaattaattaattgtgagtaattgttgataaaatggctaacaataaaacggtaaaaacctgtggatattcgcgatacaacaataaatgccatggcacaacatttttttgctgtccttaggctgtaaactttttagtcaaaattacgatcgtggtgtcacacaccccaccccttcgatgcctttgaatttccgtgttattttaattttttataataatttcaattttttggatttcaaaaattgctgttgatcaaagtcacagcacctcctgtggttattgttgttgttgttttttgttgctgacagaattccattttcatgactataaaaatgtttgttttttctagggttgcgaccccgccccgaaccccgacatttttggccattttcggggttaaccccgacccccgacgcttccaaccccgaccccgaccctaaccccgagtcggggtcggggttaaatatacacccctcaaataagaatgacatttttgtgggggaaaggcaaaaaatttatacaaaatttgaattgggaggaccaatttgccaaattttattaaataaagtaaatttg

SEQ ID NO: 32115 - DNA, 1226 bp, Heterodera glycines
  misc_feature (15)..(15): n is a, c, g, or t
  misc_feature (34)..(34): n is a, c, g, or t
gtttttgtggtcttntgaaaaattaggtatattnggcaaaatgttcgaacttttcttcaaatcttaaacattttttcgtaaaatcctcattttgcaataaattttaattgatttcctttagaaaattttatacaaaaaaataaatgtcatcaaaacgaaaatttcttctttcttacgaaaaagaatttaattgagtaattatgcgggccaaaaataatgcggattttcattgaacttacttaaaaaaagtagctaaagcaaaaatattccataattataatttagccgaacctttttgccgaatttaataattcaaattaaaatattttaatttattattagaaaataaagagtcaaaagctacataaattaaattaaaatactaaaaacgcaaacatataatataaactcaaataaattatttacactccattaatatagaaggtttagaattatataaataaatattaaatatttttaaaataaaattagaaggaattttcgtaccaaattatataattattatcgtaattttattttttatcaaatcgacattcaagcaaaatgcatttaattcaaaaaaaaaatactcaaaaatacacactaagtaataacccgaaaattttcagaaaatacacccttaaaaattgaaaaattttctaaaacaaaattgaattttttttcttgataaaatttttaatctgaatttatttaaaaaaaatattaaattctataacctgcaaaaaaataaagaacatttattggcaggatacttacatcaataaaagaaataataaaaagaaaattcaaagaatctagataagtaatggaatattaagcacgcaaaatttttgcaaaagttgccaaaaaaatttataaaaaattaagaaaacaattgctaaaatatccaatgtgaactagagggtgctcgagacaagtaatataaacctaattaatttgatataatttatcttaatcttgaatttaaaaataaaatttaaaatcacaaatttgatggcagagttacaattaacaaaataaaagtttatttaaaaaaacatcaaatgggctttagtcaataaaccatcaaaagaaaatattttttgatatatctttgctcaaaagcaaccaaattttaaaatattgataaattcgatagccctatgtttgttcaattctcctgaaatgtatcaaaaaaaatcgataagtttcaaaaaattatgacc

SEQ ID NO: 32116 - DNA, 442 bp, Heterodera glycines
  misc_feature (326)..(326): n is a, c, g, or t
  misc_feature (341)..(341): n is a, c, g, or t
  misc_feature (377)..(377): n is a, c, g, or t
  misc_feature (429)..(429): n is a, c, g, or t
aaaataaaatagtgaagctttaaaaattaataaaaaattttaaattcagaattactaggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaaaataanatagtgaagctttanaaattaataataattttcaattcagaattactggangtagcatcatagcagtgcttttcttgtcttttgatgccctcgcaaatctggntcgcttctgatca

SEQ ID NO: 32117 - DNA, 947 bp, Heterodera glycines
  misc_feature (14)..(14): n is a, c, g, or t
  misc_feature (844)..(844): n is a, c, g, or t
  misc_feature (902)..(902): n is a, c, g, or t
  misc_feature (920)..(920): n is a, c, g, or t
  misc_feature (924)..(924): n is a, c, g, or t
attcggatcacatnaggagcattaaaaatttgttcgaattttggtcgccattagattagaaattaaaaatttttcctatttcatggttatatttgtgtttagggttaggcaaggggctatataaatgtcgtattcgtattcagcgaccccgaaaaccctaaaatagacccattttccggctttttatgagctttttagacttttggacaattcgtgggtttttactcttttggacaattcgtggcttggacaaaacgtggcttggacaattcgtggcttggacaattcgtggcttggacaatttgtgggtcagcggtattggggttatataaaaaaatagtgaaaatgaaaaaatttcattaataatgattagccaaagaaaatttcattaaaaaataattgagatttggcttgaaatagacgatatacacttaaatttcattaaattaagtttttctttgatttattaaatatccttcatattttatggtcattttgtcactatcgcccccattcgcgctgttataagtagggctgggaattatatgcacatgcatttttttttcctgaactatgggaggcatgaaatatacgaaaaacatatttttagcttgttttgaagcttttacaacttatttccatatgcatattttgcatatttgtgcatatttcgcgatttatgtgcatatttgcatatttgtgcatattttggcatttcgtgcatattttatgtgcatatttgagtattttttcaacaaatcttctattaaaacggtcccctctattaaagcggccccttgggcctctaatgaccgaaaaagtttcaaaaagtatcattttttgnggcattttctaataaaaaatttaaaaatttatgccaaaaataagtcagaaaatagaanattttccctttttacccnattntctttcaataaattaattttact

SEQ ID NO: 32118 - DNA, 1706 bp, Heterodera glycines
  misc_feature (34)..(34): n is a, c, g, or t
gaaatgttattaataatcaatttcctacgcccgnttgtcctctttatgttcgtgtggtctcaaattggcatcgaatgtggtctaattcagtcattgtcagcacattcaaagggaaagagagaatattcatttgccactgaaataaagcgtaaatttattaaataattaaaaggttattaattatgcatttaatggcaatttaatttcaagagagcgaaattagtgataaaatactcaaaaaattgaaaaagcaatgcgcaaaggtgaaaaagatgaataaatgcgcaaaggcaaaattcaaacacaacagcacgaagtacacatgcgcatgggattacgtacggacatcgccaaggggagggatcggctgctgttatccgtccgtggaaagctgcgaaaatctgcgcagcatggggtaaggtaattagcaaaaaggcattggcacaattagcgaaagggcattggaatcctcgctgggggaaacgtaattaattgattacggattacgcacctttaaacctggacctccaaaaattcgaatttaaccaactgagctaccgattatgctcattttcctcaattgggcactatctttgaagggaaaacacagcgaaaatttcgacttttgaggccccataacttttttttttgctatggaacttaatattaaaaattcacaatagaagtctactttttgctgtttttgacgccttttgttttccaattttttaagaagcatttcttaattatgcacttattagacctctgattgattccatttaataaatttattttatttttgttggtttttccttttcttttaggcaattcgaaatgctttatctttttttaaggcatccaatttaagtttttgggccaaaatcatgcagcccgtacccattctcgaacgatcggacacggtggtttggccagaacgcttttggtcctcaaccccgcgacagttgtcgttcagggcctgacaggataaattttaatccgatttcctcattattggctaaatttgtaccaaacatttatttccatttcacttttctattgattgttgcatttttaatggattaaaatctgattttttttttaatttgaagtgtcatttaagcatcagtgcgttggtaagaggagcagtgactgaactgaaaattgagtccaaccgttggaaaatgtaattccaattacatattcaatttgtgtatatgatttatttagtttgttacttgttattttggaattaataattattattcccttttggttgattggttagcctactaaaaatggactgattaaaactgatcaacatttcctccgctttttctgctgatcggaatgtgactgaatggatggatgggttgggatgttcgtccccccctccctgctgtccgtccacccgttcattctttttttctacgctttgctcagctgccaaatgaaacattcccttcccccccaccccaaaagtactgcttcaattcgtgctttcccttttcctgaacatgttctcctcctcttctgcttttgcttcttctttggctgttcgtctcgacggcgtttcattgcctttaaatttatttgatttgtccgtcttccgaattggggtcgtcgctgacaaatgattgtggcgcaaaccgaaaatgaattgctgcaacaaaaatgcactcgctcatccgtcggaattttccggttta

SEQ ID NO: 32119 - DNA, 1214 bp, Heterodera glycines
atttaatggagcgaaaatttgttcatttcatggcaatgattccattttaggagaaacactttaaaaaaacagtcattcaagaagaaatgatctggaatcataacagggccattcaacaaatcgcttttggcaattacttcaaattggccattttgccatctttggccaattcgaatggcatttaccgcgtggtcattaattgtgccggcagcagagggctagccgaattcacttcgttcacccaatccgaaatggtggtggtaatgaacgcggaggagcccaaatgcaacgagaacaaattcgacatttccatttggaaaatgaaaaaggagcaaataaaaaataaggcaacataaaagggaacaattaaaatatttaattaataatgaatgattaaggctgggatttttatgtttttacatcagtgatggcgagagaagcccaaaaatagcattttctccgaacaattttttgatttaaagcaacttttaaaacataaaaacgcatagttcggggtttgtcatgtattttacacatattttggcatttttgagcaaaatttgtaagaagaaaaaacatttgtattttttattcgaaataccattgtcccttaccgaaggaaaaagcactatatctaggcgtccaagtccatttagttcaaacagaggccaagatatcccatgaatttcattcagaaactccatgggcacttggggcggtccggtacaactgggcaccaccgactggacgctgactaactgggcaaccataagagcaatccataactagcttaatcaccatttacactaaagctttcatcttcaaaatcgagtgacaaagactgcaaggaaaaggtcagccaaaccgtatgaattgcggttatggcgcccagttggtcgcgctcagttagtcagcgcccagttggatcggcgccgatggcgtctagttagtggcgctcagttacccgcccaccgcacttggggttcatttttaggtattggcgtggcattgtgtgttactaaactaaaacgggtttactactagagtagagcgggaccgggaattttgagcaaaaccgggaccgggacttgccgggaccagagaagccgggaccgggacctcgatttttgtccgggaccgggaacctggaccaaccgggaaattttaaaaattcaaaaaatttaaaaaaatttaaatttatttaaagtaaaaat

SEQ ID NO: 32120 - DNA, 1065 bp, Heterodera glycines
  misc_feature (76)..(76): n is a, c, g, or t
acgactttctccgctgagacacccgacgaataaatttaggtcaccaaaattagtaaaaatcacttgggttaaattnggaagaagctctcaaaatactttggaccgctcgaattgataattaattactttgcacaaaattgactgttggctattgattttttattccgcattttatgcttgttttcgggatttcgaaaaatccttatgacaaggcccctggtttttttattaacaaaaaattctagaggttggttgttcgcgccttatttccttcacacaattttttccctgccctcaaggcattcattggtgagggttttcgctgtccgtttaattttaagtcttcaaattggaggaaatgctttaaaatggtagagaccaaattaattgtttggaatcatttaacgaggcagaaaaaataattttttgatttggcgaaattgacttgggttcaatacactgtgttaatttaaaataaagacaccctgttttttgggagtttgaccacttcccatgaaccgatcgagctgaatttttaactgtacgtagcaattctgaaaatattaagattctaaaaaggagaaggcgaaatgacgatggaaaaaaattttatgaattttttcccgaaaaaggggtgttaatttaaaatagagacacttgataaaaacgaatcaaatctcaataactaccaaaaagaaactgataaaataagctaaataagaaagaacaaatcttttttcacatttctatttcttttgcagacagaaatctgtcttttaggcggagttgtgttgaattttccaagttttccggagaaattaagggccataaggcttaaatcacctcaaacatgtgacccactgaattaaactggaagcacttaacactaaaataacttatagacctcccttaagcattttctattcactttatgtaagaaaaaattcattaaacacaaattttttgtgggcgaaaaaatgtaaaaatctgggtaaattcgaaaaaaaaaaattctagggggttgggaaaaattttccgtataagatgattatgacgaacagaaag

SEQ ID NO: 32121 - DNA, 964 bp, Heterodera glycines
ggtctcgaaaacctttggaaacatgttttcatgacttttgaaaacaaaaaaatttctctaaaaaatgggggcgaccatctttacctatttaccaattggccaatccgtgcaaatcatccctggactttggcatggattcttttaactgctctatccattttataaaagcttgaaatgagaaaaaaaattgctgacaaaggtcaaaaaggtcgttcttggtcctcaattcccatggcttttcaatcaatgcaaaatccttttttgtttgtgtgttagaatttgagaataaatggaatccagctttatcagtcccaaaatttgaacagttaaggctcatataagttccgtctctgtcaattgcgatgggtctgtcattgcctttgccactaatacgccgaatggaccgtttgtcgacatttttgacattgttacctttacgccgactgttcccaatcaaaaggttaattgctccgataatcggaccaaattctaatagcccttacaattttttagttgtttccgatcgcgaccattcgcttgtcaagcgaaaacagttcgaaatttgttgaaatgcagtggaacccggtggagcccgagctgttcgtggctttggccagcgacaatactctgaacacattcaaatattctttgcaggcaaagccaatgcttaatagggcattcgttcgttaattgtttcgtctgtcatttcagatgggctcttccttttctctgcttggttcgctgaatgtctgtgcgacttgtctctgttggagtccgaagggaaagcaattggccattggcgatgcaagcggaagggtccaccaactgaagcccgacctttcctcggttcgcgttgttgacccaccagcgcaaattcccattttcggtgtttattggtgttttctttgtcattgcctaattaattcgtttgcttttcatgtgcctccttctaatttcgccctgt

SEQ ID NO: 32122 - DNA, 1191 bp, Heterodera glycines
  misc_feature (1100)..(1101): n is a, c, g, or t
  misc_feature (1157)..(1157): n is a, c, g, or t
ttgaattttcactaaaaagttaagcctaaacattttgctcttgtttaaaaaggaattaaaaatttaattcatcttcctttttgatagaaaaagcatcaggagccttatttaacttgtaaatagaatttggtgcgtttcagagcattttctgaaaaaatattcatgaattaattttgcaaaaataaataaatattgaaactttaaaaattcttagaaaatttaaattcataggtactactgctaaatcaacgcagagacgcctttccttgacctttttaggcccatgcaaaacctggtacgcttctgagcactactcgaaaaatgagtgattgaattttcactaaaaagttaagcctaaacattttggcctgtttaaaaaggaattaaaaatttaattcatcttcctttttgatagaaaaagcatcagagagccttattaacttgtaaatagaatttggtgcgtttcagagcattttctgaaaaaatattcatgaattaattttgcaaaaataaataaatattgaaactttaaaaattcttagaaaatttaaattcataggtactactgctaaatcaacgcagagacgcctttccttgacctttttaggcccatgcaaaacctggtacacttctgagcactactcgaaaaatgagtgattgaattttcactaaaaagttaagcctaaacattttggcctgtttaaaaaggaattaaaaatttaattcatcttcctttttgatagaaaaagcatcaggagccttatttaacttgtaaatagaatttggtgcgtttcagagcattttctgaaaaaatattcatgaattaattttgcaaaaataaataaatattgaaactttaaaaattcttagaaaatttaaattcataggtactactgctaaatcaacgcagagacgcctttccttgacctttttaggcccatgcaaaacctggtacgcttctgagcactactcgaaaaatgagtgattgaattttcactaaaaagttaagcctaaacattttggcctgtttaaaaaggaattaaaaatttaattcatcttcctttttgatagaaaaagcatcagagagccttattaacttnngtaatagaatttggtgcgtttcagagcattttctgaaaaaatattcatgaattaanttttgcaaaaataaataaatattgaaactttaaa

SEQ ID NO: 32123 - DNA, 1035 bp, Heterodera glycines
ttttctatcaaagggagatgataaatttttaaaatttttaattctttttaaacaggccaaaaagtttaggcttatatttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaactcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgcttttactatcaaaaagggagatgaataaaaaatctaaaa

SEQ ID NO: 32124 - DNA, 1267 bp, Heterodera glycines
acaatgcacacattgtaaaggagaggaacggggagggggagggcaggaacgaaagtgatcagctgatcagtaaagagggaaagccgaaaaaaggaaaataattagaaattctgatcactgatcagaaccaggggaaatagttaaaatgatcagacgggtaataattgtgatcatggtttagttattctcttaaaaagtgatggaaaaaaatggaaactgttgagaagtgataggataatcagaatggatatttagccttctgtcagccactggatgttatcgttctgccaccatcgaccttaaacaggtgtgctaatattgggaattttaattagcaattaattaattaatcgaagggcgtccccattggcagtgaaatgatgcgtgatcagtgccccttggtggagaggtgtcggcgtgccgtgcctttctacccatcctcaccaatttcttccccattttcacagctgttcaccaaatccatgccgaagtggtggccaatgcgttcagaacggtttcgcctcgttcagctgcgaatgcgagcaaaactacacgggacgattttgccatatttgtgaggaattttaacattttgaagaatgaatttaaaaaagaataataaattccagccaaattgccacattcatgcgaagagcatttcgcgtccggcgccgtttccaaacgcgtgttaatcgatttggacggcggtgggcccctgcagccattcaccgtcgaatgccgtcgcggaggacgagggccaaaaagtagagctaatgggactggaaatttgggaaaaagggagcgggaaatgccgaaatcggaaatgggatttgcttaattctaggaaagcctgggattttttctagggaacaatcagtaatgatcattttgcttctctaaatcaacaaccacctatttcttcttttttttaattgcgaattaaatttcaaatatattttttgtgtgatcataaaagcgcaaaaattgaaaataaaattttaaaattaattttagaaaaaagatttcaagccaaattcgacatatcagaggatgaagtgattacggtgataagacacgacgcaccgccgcaggggataattgtgagaggtgattaacggacaaatgagttgccaaaaagcaataacagcaatattagaggcgaaggatgaactcaataatggtgctatgacgttactcaaaaaacccaccaaaacgaaaaattttttgatataactttttgctcaaaagtaacaaagttttaattctt

SEQ ID NO: 32125 - DNA, 1091 bp, Heterodera glycines
taattttgcaaaataataaataattgatgaaaaagtcagaatttggaaaattttaaaaacaacaagcgttggcattttttcaggttaagttagtcctttacaatggagaaggcctgcaaaatttggagagattatatcgattttagtgcgctaggttcgatgaaactttataaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatatttatgaattaattttgctaaaaaataaataagtagtgaaaaagtcagaattttgaaaaattttaaaaacagaattactggagttagcattttttcaggttaagttagtccttgactttttgaagctctcgcaaaatctgagattatcgcttctagagcgctaggttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccgaaggaacctcactcggccgcttcgcggcctcgt

SEQ ID NO: 32126 - DNA, 1023 bp, Heterodera glycines
tgctcggatcggcttcaaacaaaatagaacagctgttttttaaggattctgcatcgaatggtgaaaagtatttttttaaagctctaaaagaaaaaaagtttcttcagaaaatttttgaacatgtttcagaaaaatggctgtagcgggtcggtgtgcggatagcgtcttgggcttggagaaagggcacatcagaagactctgacggttcaaatgagctatagagcatgattatcagggctgcaaaaaatatgcacgaaaaatggccaaaatatgcgcataaatatgcaaataaaatcgtgaaatatgcatcaaatatgcacaaaaaaacttgaaaattaggggtgtaatataatttaaaaaaaaagtttcttcagcataaattttatcggttatttttgcaattgtagatcaaaaatttttcaagattttcggcagtaaagctcatcctattgtctgccaaaatattcttataaattgaaaatgaacgttcaacttcgcaggattgatccatcagtcgtgtacgttatttttccgtcaatcctattgatccactcgcgtatccatgcagagttggatttaattttaggcataagcaaatgtttttctgagggatattaaaaatcggaaaaaaatataccgaaaatggcaaaatatgcaaaaaatcggaatatatgcacaaaaaatggctaaatatgcacgaaatatgcagaaaaagccaaaatatgcacaaaaacctcgaaatatgcaaaaatatgcacataaaagtcccgatttttatacgcaaacacaaaaaagaaagtgttttttcctgctatttagagcatggagaagccaggaaaaaaaatccatttgcatattttttgcagccctgatgattatagtcttggatatgaattgagttacgcttccgacacgaattcgcaaaattcggtgtttttccgccctgattttcagaatccggctcaggggatacgcagtgattcagggagttttctgagtgaaacttggaaaactaacacataa

SEQ ID NO: 32127 - DNA, 1297 bp, Heterodera glycines
  misc_feature (1283)..(1283): n is a, c, g, or t
gcgttgatttagcagtagttcctatgaatttaaattttctatgaatttataaagttttctgtaatttctttaagtgcaaaagtggtggtgtctgcaaaaaattttcaccgggtttaaaaaatctaggaaaattagtaagcatttgtagtgttccgatacgtattcctgcataatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgttttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttggggttttcggggcagtccccctgaaccgatgcgcccagatttatggggagaccgaatccttcgggaatagcttcccgatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagctacgctatagcctgtactttaattctgcgttggattttttcgtgggggtaattgtttgagtaccccaaancggacactgaaaaa

SEQ ID NO: 32128 - DNA, 1076 bp, Heterodera glycines
  misc_feature (13)..(13): n is a, c, g, or t
  misc_feature (61)..(61): n is a, c, g, or t
  misc_feature (136)..(136): n is a, c, g, or t
cctccctccattnccctctcatatttgttctctgtccaattccaatttctctctctgtgtntacctcccttttttctttgtctctctccgttttctcctctcaccccctcttctctctctctcccccttgtctctnttttatttctcttcccctcaccactctctctcccttgtctctttctattttctcttcccctctccacactctctctctctctctctctctctcttgtcctctctccgtttcttttcccctcccaactctctctctctcatccctctttgttctgctgcgctgatcagccagctgcgcggctggctgatcatttttcatcaatttatcccccgctgttcgcgcccatcagcagcagaaagttttgtagaaaaaaaagctgtgtgcgcgacacgtcctgaatccattttatatatttatttctcaaaaaaaaatcttccgaaaatccttcttcactgacttaatcctcttaaagaaaatccattacttcactttatttggaatcatcccatatgtgcgcaatatagtttatatagctttacttaattcataaaaatggcatttacaatacaatttcattcggcatttttttttgccattattttatattgtaatgcctgaaaatgcccgcatttttgtcaaaaattggttaatccctttaaattttaattataattattttttaattccgtggaaattttaccttataattttaaaattttgccccaatttatgccgcccgaaaaaatgtgttcgaataaattttggtcattaatattccatggacctcgagaacccatccattcatattcattcagtgtttttgcataattttgtttcctttcgtccgttcctttcgcatttttttttgcatttttaaaatttttccggccataatttattgatcagaggagaaaacaagttttcggagatgtcttttatctaatcacattcagcaatggtcgtgatgatcagcaggaattttggaataatttcaatttagaaaaaatttggtgttaaaattttatgtattgtatgtctgcaaagggaccaggcgaaggag

SEQ ID NO: 32129 - DNA, 1091 bp, Heterodera glycines
  misc_feature (1078)..(1078): n is a, c, g, or t
atcattgttttttcagttgatattacctttctgagctttttaattctgaaaaagaggtaatactgaatgcttgctacaaatgtaaactgcttatttcttgaaaaccttaataaaaaatatatttttaacgaataattaaattctttgttgaaaaataggttttaattatctttcaggcgaattgtaaccagctgactaatccagcagaagccatagaaaagtgatcagaatttaaaaagggaccgaatcacgcaattctgtcattttttggcatattgatacaaattggcatttgcagctcaaatgtccgctgttgcgatgtatataaaccgtccttttcaacaacgcttctcattcttgagcagttcgtcagttccattcgtccacgacttccgttggtttttgctcaattttcttttttttttgaaatttccgttccaattaagtcaatgcaagttcatcaccaccaccaccacaagagccaccatcaacgccacaaacgttcatattcttccgcccgccatgtgttgatcaatttcggcttccaatttccgcatgatttcaaacttggcagtggtcgttacagcaaagtgtacaaaggcgagttcgctgatcgtctcttcgccttccccgtttcagtttttccattttcaggattttaccgcgaagcaaatcgttattttgcaatcaaaattaccgacttggaagccgtttctgacagattcaagcataagtttgtgccccgtgaactcaaagtctggcgcgagttgagtcacccgaaccacgtccgtttgtacaaggatttcatgaagaatgactttctgttcgagatcatcgacttggctgttggcggtgatatggtgggtcaaagttaaagtttagtgcgttgtccataccttctttcagctcaattatttgcggaaccatggaccggtcaaagaagcggtctgttctggctggatgcttcagctcgtcgacgctttgagttacctgcaccaaaagcgaattgttcaccgcgacttgaagctggagaacatcctcatttttgacagagatgtgatcaaaataactgactacngattctgcaagca

SEQ ID NO: 32130 - DNA, 1500 bp, Heterodera glycines
  misc_feature (1315)..(1315): n is a, c, g, or t
  misc_feature (1380)..(1380): n is a, c, g, or t
  misc_feature (1404)..(1404): n is a, c, g, or t
  misc_feature (1458)..(1458): n is a, c, g, or t
tacttgtgggttttgtgtcaacaaaaaaatttttttttgttaaatttatttgaaatttataaaaattgtttctataggttatcggtgtcgtagaatgcgaatctgatatccatttcgaaccccgaacccggattcgaacaaaaaaatcgaaaatccaaaattttaaaattttctcctaattatgattatcagcgcaggaaattatattgccgttgttctgcagggaccaggtcgttttggcgccaacgttttggcgccaagccaaaaatgaaaaaaaaggcaggaagaaattgtaaaaattataaaaaatgaaatttttcgttaaatataataaatttaacaaaatgaagaaatggaaacaatttatttggtagaacattggaggtgccaatgagaatgtgccgtctccgaaacattctttcattcgatcagcccaccggccgaagctggccttcatgcgttattttaggcttttgtttcttcgtatcaatttgacgattcattacctaaatacaaaattaagagaacataagccaaagcgaaaaagagtaaatgaagaattaaatccggctctttaatagacttcgtcagaaaaattataacgatttcatcatttctaccccccccccccctacatggcgtcaaaacatcggcgccaaaacgttttggttgttttaatctattttagaaacaaaaagagaattttgaaattttttattttcgattttttgttcgaatttcggctccgggttccgaattggtcgaaatggatgactgattcgtgagcagcgaccctgaaaaccattggaagcatgttttcatgacttttgaaaacaaaaaaattttcttcaaaaaaggggggcaaccaaccatcggcagtattaccttcgcgaaaaatacgttttttttgttgttttacaaaatttttaaatttgggtgtttttctttttttattatagcttggcgccaaaacgtcggcgccaaaacgatatggaccccctaaaacatagacggtgtgcaagaaacggatcaatcataattaaatcgattagtatgcacaatgattgaatgattctttgctcaaaaaaaatccgttcattgttatacacataacagttatttgtagtatggtggacgtgctagaaaattgacactaatagtgatgattagggcctgaatttttaggcaccaaaattttcaaataggcacctaacgtatgcacgaaaaattggaaaaggtatatgaacaagttcacgaaaaccctaaaaccgtaccaggtgttttcgacagtgattagtttcgacagtacttttanattaattttctacaagatttattgtacagatgaatttatatgaatttacaatttgcatatacaanatttataattgaagtaagtaatanaaaataagacttgtatgattttttttgtcaaaattatcgcttttatttttctanaaatatctcctgctagactgtagtcaaaaatacacaaatttc

SEQ ID NO: 32131 - DNA, 1309 bp, Heterodera glycines
  misc_feature (87)..(87): n is a, c, g, or t
agaatctgtcgtactttccggtgggctgaattggggatttttgggtcggggacagatcaatccgcatttgtcggtcgagcaatttcncaaggcaattttgcagttcggcacgcacaccaaattctccgactgattgtccaaacactcgcggaaacaatctctgaacgcgacgtagcatttgtggcaacaggcggcggtggacctttgaaattaaattaaattaaaattaaatttaaaaataattaaataaattgaggaaaaacgcactcatcggcattgttggcctggttaaaggaagggaaaagaagaaaaagggcgacgaatgtgaagaaaaacattgtgaaatgatctgaaattggggggaaaggggggaggggagggagagaatggcatttggaaatggaaaaataattaatcattaatggcatttggaaatggaaaaattatgtatttaatatcctccgatggaattaaaattcataaaagaaaaaatttacccaaagggacaaatggtaaaaaacagaaaaagcattgagcaaaatgtgagcaatctgctgatcaaatgaatggtgctttgtttaatgattaaatattcatatattccacacacacatttatgtgatggaggaatgaactgaaaaatgaaaagaattaatgggaggacgacgaaaaaaactaagaaaatggcagaaaattacgaaaaatgtatgctaattgagaaaagaattaaccaataaagagaacaattcctcaatggtgatcaaatgtttgtcacttcatttttccatcgtttgcctttcatttcaatggcatttttcagactgatcattgatcattgatcaattcgtttcctttgttcttctaccgttcgttgattgttaattcgttaattcgacatttcaagagtaattaatttatgttaattacggtattatactgtatgttaaatgccgattgccctcccttcagataagggcattcattcgtcatttggagggcgttcctttaattgataatggcggtttacttttttgaagggaatgatggtaattgataatattttccgtatgcatacaaaataagtgattattaattaacagttatcacttaaaccaatgcgaaaactaatcgatttgttcattttctgtgctttttctgttttaatttaggtaaataataaaatattaaatacacttttataatttcactcaccatttttcattttaaatggcgagtggcgaacgccaaaagttggtcaacaattcgacagctgaagtaaatatttacttgaaaagaattaattatttat

SEQ ID NO: 32132 - DNA, 1330 bp, Heterodera glycines
ttgcgcctatgttcaaaaacggattcaaacctacatttttcaattccagatggactaaatagctttaaataagagattgaaagtgattatacgcgataatttgatcgttagcaaattttgaaaaaataactaatctttcaaacaacataattattgttcctaataaaccaaaagaataagttttcttatctttaatgctgcttaagctatcagggcttgaaaaaatctaagtttgaacccgattttggacataggcgaatgtcaagagcgcaaattttggacacgagaaattttttttttgctaagtttagatccacttcaatttttttgaaaaggttattcttttctagtgaaaaaattgtacgaaagcctactgtgcgaactgccactgtacgaatttttgtacgaactcccattgacccagaagctgttactattcgcagaaacgccagagaacccatcgaacctcaaatccgttcctcctcccattttgactgccaccagcggatgacggaatgcgttacggcattcgtcgtttgttaaatttccattgaaaatccaggcatttgaatcaggtgaaaacatgtctggcgtgataagtgttaatttaagattgaatatttctcaattctcaatatacataatgatgctttaaaataagtaagaaattcaatgatagaaataaacattcatgaaaaactatgaattcgttcgaattaaatcattttttatcgtttacgtaataaaaataaataaatatcgtagaacaattaaagaaatcatactaaaactaagaggatatcaaggataagtggttttacattcattgagtatatgacaaaaacaattgttacaaatgtgaaaagcccattccgattaagaagtaagtttataaaattcctcctcgaccaagctacggttgagcatggttcgacgtttgatctccgaacgcggcattcacagtgagagacaaagaattgcacgggtggttgtgctggaacaactccgactcgaactcgaagaccggaacgttagaagccgttgagaactgaggagtgttcggcagattcgaagggaccgaacgcagttccttcatggttatgggcaaacaagcagtcggaaccgaatctaaaagaaaacaaaaaatggctctgaccggcattttcttcaattttaatattttaaacaaacttgcaaaagcccagcgtttgaatattatggcacatttgcgttttgtacagcgacatcttactctgacgcgcattattacagtgcgaacgctgcttgtagccgcagcatctgaaggattcgcggaaacattcgtcgcact

SEQ ID NO: 32133 - DNA, 1261 bp, Heterodera glycines
  misc_feature (26)..(26): n is a, c, g, or t
  misc_feature (79)..(79): n is a, c, g, or t
aagaatgatggcgttggcacagtgtntaatgacatcgcaccgcagatgatcaatggcaccatggcaaaactgcttcatnttgtgccaccatcatcagatcacaaaatgcccgtgtttttccaaattgaagaccccgaattttcgaaactgatcacgtcaaatcattggcttagtccaagcgaaaatgatccgagaatgtggagtatgtgaaaatgagttaccgtatttgtaaatattaagactagttcattttttcaaaaattgggatgaataagggagacggaaatcgctaatgctaaacaggcaccgccaaggaaaactgatctaagaaatttatgtaaaaaaatattttttataaagtttagacatttttctttaaaaaaatgggtgggggtgggtggtagtgctgttctcgagagtctcgactcgggaactctcgggttttttggtctcggggtttcggtcttggtataggggtcaagactaatctcgagtctcaagtctctggaaattttcggtctcgaacagcactaatggttgggaaaatacacccacaaatcaggccccgttcccccctcccccttggctatgccctggcttctaaatcgtttgtttttaagggaagagcgaaaggtgtgatatgtatggcaaagattgctacagggtaaaaggacttttgaaaaaattggaggcactgatcggttgcaaacggatgaaaagggcctcctccaatgagacggtagggttttgaattttttttaaatttttaatggtcaaatttattacttaccgccagggttgtgccaagcctatggctaaatcataaggcagggactctttttttgttttattcaagatacctaaaaattttgactaccctaagttcataaaattcaaaaaattcgcatttttatttacaaaaaacattaaacctgcaaattttgaaaatttttttacaaaaaataaaattttaagcaatttttattactaattcgtgaatgatggggcctgtccattccaacaccgtaacctacagtaactattgcatttaaaggtgccgtctttggctaatgagggccttggttgttacgatttaaagccaagcgaaactttgctgtgtgattgtgatattgtgtgcgacaaacatgaacttcagcaacgattagatgcgagaaaagaaagttagtttcgaaaagaaaacaaaacttttactattaaaacaaagaccaaatttttcaaaattcgagatcagagcagaatt

SEQ ID NO: 32134 - DNA, 1662 bp, Heterodera glycines
tctgtacaaaaacaaacaaaaatctgttaaaactatcaatttttttaaatccataaatttttcttttaaatgcactgccaatattcgctttcagtctctttgggcaattattaatcatagcaaaggctactgcctaacaaatccccctgcccctctatctcaagccccaagaaaaagacaaaaaaaaagcgaatgaacaactcgtaacaaatttattattaaaagacatcatcgggattattagcaagggaaaatttgtacattgtgaatacaaaaattacaaatcaaaaaataataaaatagcgaagacaaaaaacagccaaaagttcattggattgaatgagccccgttttccgaattcaaaaaaagaataaaaaaagttagtacaaataaatgaagcagtagcaaaaggacatatttgtatggcaaataaataatgaaatgccgtgtcagaaatgaatcaaatttagtgacttaaacaagcatttgctactgctttaacactgacacaaaacaactttgcttaatgactcgatttggcgcattactaattaggaaattaattagttttaattggtttgtccgctttcaacatgtccctccgttcatcatcccgtgcccgtggctttgctgcagagtgatcggtggcactgcgctcgatcgccgtctgcgcgatactgtgccgcgccgggattcctccgaccgcagcaaataggtggtcattagtcccttgcccttcacattgatttcgccccggcactcgaaatggaagccttccctttcaaggatttgcttcgtctcatccgtcaccttaacaaaatgacaaattaaaatcattctaatgaaaataaaagaaaaaaataaataaatattctaatttaatattaatcgaataaaatatttggattaatattctttgattagaaaatttggttttgatttgtggaataaattcgtatgctaatttaaatttatattttgattaaattactaaaaataaaattctatttctccacctgaattcgtcccggaattcccgatgagtccattcggctggcaacattcacagtgttgccccaaatgtcatagtgcggcttttccgttccgatcactccagcaactaccgggccaacattgatgccttaaggaaaattttatcagtgatcacaaacattaaaaaataacaattgtgaaaaaggcataaaaaacggagaaatcccccccccccccctccaatccgtgtcatcgaatttttaagaattatttttaattttattcaaatttttgacaacatttttaaaaatgtttaaaaaatgtcaaaaaaaaaatttttataaaattttgttgtaaagcaaaaacttttcaacgacagcgaagtgatccgttcgaaaaaatgagaaaaattttaaaaatattatataaatcatttctcaaatcttgccttttcttttttttcgttggcatataattagtatctaatttgtgaaccccactccccagtcactctccaccaatttccctaccgattctgaggttgaaattgccgaacgagttctcgttgaactcctccatccagccgaacagtgccagcgcgaaattgaccaccgccaccacgtgactgtttgtgccggtcgaattgccagttaatccgctggccgccat

SEQ ID NO: 32135 - DNA, 1413 bp, Heterodera glycines
  misc_feature (14)..(14): n is a, c, g, or t
  misc_feature (105)..(105): n is a, c, g, or t
cacaatttatgacncaaccgaactcactcttcaatatttcacgatattctttgctaaaaaagtttatttattaaagataagatttatttattaattctaaattgncctgcaaatatataggattggtgcattgatcgcccctgcaattgtgaccatttgtaccactaatcgtgtgatcagaaattgagatgacggatcacttgtgatcagtccgcgccccacaatgttaaccaccagacaactggtgaaccaaagacagaagatcactgccatgatcacagccaaaaatttgaaaatgcgacgagtgatttcaatttgggactgggacgaattgttgcagttgttctgatcacttctgatcactgagaaatgaaaagctattgttttaataatgaattgtaataccgtcatttaaattttatatagtaatatatttttaattgtgtaattaaatttaccctttagcataatagccatgataatataaattacagttgtagccaaagtaaaaataatcattataagagaagcaaacacaattaattcgccttgaaccatatcaccaggctcacaatagatcattcttttaatttgaaaaatttattaaatagttaattaattaattcattcattataatttgctacatttcgggatgttgtagagcaaatacaaacgataaataaacaatgtaaaatgcaattgacaatgaaaaaacattggcaattaacacatattttccggaaaatcttgagatgttacgaaaacttaaagaagattagattaatttcaagaataaaaatttataaaattacaaaacggggaatgccaatgccacaaaacgatcaacgcttatccaaaacagatttataaaagtattaatatttgcagtgacagcaaagaattgggcataaacgcaagtcaaaagaggaatccgcacacgaagaaaaacgaggactaaaataaatgaaaaattgaaaaaataataaaaacaaataataaaatattttatttttatttatttattaccggtagctaatggagtggccaattcagtgagtgcgtcacaaaaagaacagatggccaacagaaagccgaaactccggtgaagtttcctaatttcataattaaaaatgcatttttataatatccaaaagtaaagtcaaaacaaaattaaaattcaaaacaattcctatgcaattttcaaatcttctcttttacttgtgcttgatggtgatgtaaacgatggcactgtttagggcaatgccaaaaagtgacaaaatttgttgaatgattgtcacccaaacggtgtacacgtaaatttggtcggattctccaaattcattaacggacgaagatggtgatgaattaccgttattactcatattattagtctgatttatttagaatgttat

SEQ ID NO: 32136 - DNA, 1571 bp, Heterodera glycines
tgaaacaaaaataggcctcttgagcctgcctgtacgtcctgaggcggaggcggtggcatgggtgccgccgctggctcggtctgagctgcatctgcgatgatctgagccggcgtttcaattccgccaccattgttgcctgtaaaaaaagatttatataaaagttgtattttcaagagatatggacattttgtcatgcctgtctacactttgtccgttcaccacaaaaaggcctaaatgtttgtgttcgggagacaccatttgaatatgtgtgcattatgtttttgttatttccccctccgcacattcattgttgaccccttatatttttgcatggagattggactcaacatttggcttcaaatttgcgagtttgaaagccaatcggtttttcagctttcagggaccgagaatattatcttagaaacaccgaaattttctatttaacaataaatattgcttatatttatttaaataaatattgcttatatttatttaaataaatattgcttatatttatttaaacttttagtgatgtttgatcacgcgggattggtggatttgaaatttcaaaaaaattagtatcaatttccgacggtgccaatacagctgtccaaaatttatagcgtcaagaaacttttcgtcactttacctacttccccaaaactttgaagacaggtaacttattttataggcaagaaaaaatctgaaacatacttacttattttgtccacaaatcactaaaattaaaattttttgagtttttccccttttttcagacatttcgcttaaaaattaattttttgcattttccattttgtcccaaaaggtgtcactttgttggttgaaaattttcctattttttgtgttttttgtaaaaaaaaaaatcgaaacttgtgtttttatagcgaatattctataaattaaatccttaagatattttattataaatatttaatttattatttgcgaaagaaaatgatatttatatttaatcattattttaattttttaaataaatattagttatttatgaatatggatattaattaaataattataaactactctactcttgtaattaatttgcaatgaaagtagggaataaaaaaatatattttttgatcagtagggataacaattttatttaatcgtggaattattttattttttatttatttattatcttcttaaattatttattctaagaaaatatatgaattatatacatttatttgcgatgaaaatgctgtcaaattaaaataataaatttattttttaatgttttaaattttatttgtttttagaaatatatcatctttaaaatgaaattctttttaattatctttttatttggaaaattggatcagtggataaaaaattgcaacagcaaacttttgatgaaatatttggagaaaaatgggaagaaaaagaagaagaaaatttggaagaaaaaagagaaataattcaaaaatattataaaataaaagaaaaaataaagggaaaaggaagaaaatattcaacaaaagaatggagtaaaattaactcaaaaatagcgaaaaaattgggacaaa

SEQ ID NO: 32137 - DNA, 1244 bp, Heterodera glycines
ccatgtggcagataaatgcgctcctttcttcgtgtccttttgcaagtttgatgtgaaaaaacccgcttgaacagtccgccactgagaaatattttttcccagagacttcgtcaaggatcgattgaatcctcggcaaataatatgtcgatcgtttcgtcaattggttgagcttctggtagtcaacgcaaaatcggtaagaggcatcaggttttcaaacaagcacaattggggatgaccatgccgacgtggatggtcgaataacattttgacgcagtaattctttaacttggcgctctatctcgggttgaagtgcgacaggataacgatagggcctctgttggaccggccgtgcgccatcgattaggtcgatgcggtgtatcgtttgtcctttgaagagtccgacttctccaggtttcacaaaagcgttctcgttctgtcggatgatgtttttcagcttttcaattccgtctcgactcagaatggtgtcgtttaatcgaattcattccagtattggcgcgactgcttcttccttctttggaaatcccaaagtctggtccgtccagtccgcctctggcgaaattttgtcactttctaatttgaatttcatccactcctcgtcagtcattatcatttccgggttttctttctcatcttccttcagtgcattaatttcagtgccatcggctattgcttccagtcaccaagtcgcgatccctcatacacttttattacgctgtttccgaaattaagcaatcgtagtggcacaattcgcgttgagcctggacttgttagacagtttccgactcgcagcgggaaataatcgtgctctcgctcaacagtgatgaaaacttcgtctagtcccaaacttcggttaatttttccccaaacgagcgaatcagacagcggtggcaatgtttgggtctcaataagttgtacttcaatcggttgcttctcgatgctgacagcggcgatcattggtagttgcgtgtttccaacacgtaggagtcctcttttgaagttcaatccaatttcttcttcgccttgttcactgatgaaatccatcaaatccgttccaattatggctgtgcatggacagctatcgtcctcactgacgagaattgggaatttgccttcaaaatctcccagttttatgttggcgagtgccgagataaaacgaatgggagttgagttcgctgctcttgcttgtggatagtccccttttcggaccatcataaagcatcttt

SEQ ID NO: 32138 - DNA, 1218 bp, Heterodera glycines
tctaaaattatgcaaaatgacataaaaaaaagatttagataaaatcatgaataatttttcaagcaaaatattcaaatataccaacaaaaaaaaattgaaatcaccttttacttggttaagaattaaaaaatttagcctattaaaatgtttagaaaattttttattatattttatatttttgaaaaatttccgatttccgatttccgacgtttttggggtcggaattccgatttccgaaaatttttggggcctcagaattccgatttccgaaaaatttttgaccctcggaattccgatttccgaaaatttttggggcctcggaatgccatccatccctggtgtggtccagtttgctgattggagttgggattctggattagaaaaatctttcaccgaaatgccttttttgttcactgtgcttttcattgtctgctttatcccaagttagaagcatactcacattttttctttttatctataaacttttccgctctctcgtgaatgccttttcttttttctctctgctttcttttcctgcctttcgtctcgcctcactatttctgctccattgctttctctctgttttcttttccctgtcctacacaattacgcactattttttctgtttaattaattacaatataataattatttgattttatttttttgcgcaccaatttcagcaatccgatctgccattctcattcaaaaatggtaccggcgctgtttggcacgtttggaagcgcgaagaagaggtttgaattatggcttatttaaatttatttatttaattttaaccaaaaatatatttaattatttttgaaatttaatttaagtttttttagcaaataatgtgtataatatttattgaaaaaactacaataattataaacaaatttaattgttttttatttaataattgaatttttatttaaatttaatttattttcattttctaacaaagacattttcaataataattaattattttattttagcaacatggaacatttttaccgctttggaatacgcgggagagcaggaccaattaaaggtaataaactaatgatattatttaagaagggatctaactaaaattcaatatttttatattattgtttggactaaaaaacggtaatcctcttaaaatacttttttcccgcatcaatcggctttaaatggttaaggacctaatacaattttctttttatttcatca

SEQ ID NO: 32139 - DNA, 1967 bp, Heterodera glycines
gcccaccaatgtgtcggtgtcgcgttccttcttccgtgagctgttgccgctgtccaccatcagtcaggagggaccgtatctgttccgcatgttcaatgacaacctgtgggccgacatgtctcgtgtctacctgtttctggagttgtccatccaaaaggaggacgctggcggacgatgggtaccaattgaagcggcagaccaacttgtcggacctatccaatgcattggacaaacgtttgttcaacaactcaaggtcacacatacaacatccgaacactcttcacttgcagaaaattaccaatatttaggttgaagtgcaaaacacagttgtatgacagcggcacattgtacccctacaaagcgtatctgaccaacgagctgtccttcccaaacagtgcaaagggtcatttcatggccagcgcgggctaccatccctcgctgaagcatgacagcgcgacggatgccggcttcttggcacgctgtgctcgctttgagggaggacgaaaggctcgcttcctttcccgcctggactttgacctgggcaaccaggagctgtacctattaaacaacatggacgtcctgttcaccatctaccgtgcaaagaacacattcctgttgcaaaacctggcgccagcgccggcggtaggagcagcggccaggcagcagtatgccttgtatctgcacgacataaagctgtacatgaaggtggtggaggtgcaaccctcgctgaacctgtccatctacaaaacgctggagaagcagccggccacctacgcggtacggaagacggaggtgaagtccgtgttcctgaccgccggccgtaccgagatggaccacaacatattttccgccgccatcccccgtcggttgaccattgcgctggtggcaaacggggcgttcaacggacagctggcgcagtcaccgttcaacttcaagccatactccatccgtgagatcagcgtgcacgccggcggtcaaatatacccggcggtgccgcaccgcatggacttttccggcgccgcctacattcgaccctttgtcgacatgtacgaggcgctgggcatggccaactctgaacgctccatggacatcacactggaccagttccgcgacggatggacaatttttgtggtgcccatgacctcgacgctggatgacagttgcggctttgaactgctccgctccggcaccaccagcattcggctcacattcaacgaagaaattccggccggcggcgttgagatggttgtgctcggggaatttgatcagttgataatgatagactacaaccgtcacattgtatctgactcgaaaattgcataaataaacatggtgttgtgcaaaagaccattctgttgtttccaaaaaatcgtaacatcatcatcatcatcatcataaacacattgacatcacttcccaaatttcaaatttaagctggatgattttgtatgagccgcgtgcgggtggtcgtatggtaccccacccgctgttcgaccccggtccggaaatgtcggcgcgcgtcattgccaccgcaccgctttattcgacatcatatttttgtttgttttttattatcttttaccttacatgtcatgacaatgcgcgcatcacaccgctccgtgaataataataatttttaagccacccaacacgctaatgaatcagacgaaagcgtggcagatgctgtcatctccggcggcggtagcggtgtagcatacactgtaacagaagctgcgttgctgaacaacaccaccagcacactaataggcacgacgtcaaccaccgccgtgacatcaacgacggcgatgaccacggcgggggcaagagtggatggggctgttcagatttggtccaccctgttccttttcgccaactacgcaatcgtgctgccaatgttcctactgtgttggatgatggttgtacactggctccgccgctccggcctcatgccgccgcctcatcagtca

SEQ ID NO: 32140 - DNA, 1936 bp, Heterodera glycines
cctcatccaagaaaatggccgattatgggtggaccccccgtacctatctgcacaccgaggagacgaaccgcgcgatccgacgcacaaacaattggccaaacattggcgagactcgcaacaacgacttgaacatttctggcgacgatggcaccgggaatacctcatggccttgcgagagagggccggctggcatcatcctcaacgacgggtgaatgcacccggggcaccggaagtcggggacgtcgtgcttgtagaagacaaattccacccccgcaacttatgggccatggggcgaatcgaggcgctcagaggttcagacggtcacacccgcagcgtgctgatcagaatggcaaatggaaggatttgggggagacccgtaagcagaatttgccccctggagagaagtacagaaatgggggaagcacaggaccaacgagacgaagcagtacaggaagaggaactcggcgcggttgctgggacagaagccgaaggtcagcccggggaggacaacaatgctccccgtggcttgagtggcagtgagggagaaaaaactgtggaagctgaagaagtcgcgcaagacgaagcagaggaagggcccattccaccgagtttcgttcaaaacgaagtcgggagcacctctcccgtgtcgcagacaaatgagcagatacgggaaaccgtgaaccaaaagacggaagcggagaaagctgactcaccggagggatcgaacagcatgcgagaagttgaaccacgaaggtcgcggagagtccgacgaactcgagaagtatggtcaccggaacgatgtgccacgaaaaggagggggattggtggccccctggtcagcttggccatgatgaccatgttggtctacccgactctgacgtcagggtgtcagccgactatccgacccgaaattgttggacaacagtcacaggaattgccaacaacgatgttgccgtgccatatgcggtgtacggaacgtggagtgaaagtgctgagcgggcagcgactcgaaaaaatggaaatttgttgccctgatggatgctgggcaattgtgcccacttcgacggagatcagctacgagctaccaactgaactgctcgtccacgattaccagtgcagtggtcaatgctggagggggtctggccccccttataacatcacacagcgatgtccagcgagagcagaatgcgacctgatcaattgctccttctgtgggaagcagctggccaacccgacgtgcaacccgcgatgggcatcctcgctcttcgggtttggagctgcaattttgctcgccatcatcggctgcttctgctcaatttttgggcggtttttgtcaggagccaagctgctctcgagagccgtggcatggggagttcgttgccccatcgggctgatcaattgggcaaccggacgcgattttcggaaaccgaccacggagcaaatcgaacggaaagtgaggaaaggagcgagaaaggcacgaacggaaatacgtgagctgcagcagcaactgcaattgggaagacgggctcgggcgatggccagagcgtggcaaaatcccgacgggactcgaaaagcctttcccgcaaaggcagtggcagccctcatcccattgctgctcatcatcggcccggcaacggccaacaaacctttgtccgtcatggtccgatcggaggactgttcgaggacggcggcgggactcaaatgtgcagggacagcagcgacggtgctgacgcttctgccggcggaccagacaaactcattcgtcatacggactcaacaggacgaactgctcggggcagtgaggctcagactggcctccctcaccatggtctgcgtgccaaagacggaaagctggctacgatcatactcaatttcgacgacggcggtcaagcggtgaacagcggcagggtcatgccgcggcaatatgtgcaactca

SEQ ID NO: 32141 - DNA, 981 bp, Heterodera glycines
  misc_feature (29)..(29): n is a, c, g, or t
gcaaaaaattcgcgaaataggggcgaaanagtttcaaatgcaggagcgaaatttttaaaatttactgtttttatataaaaatattttcaaattaaggcaaacaatttttattgattgattacagttgccaataataaaaatattctaaaattttcaatactttttcaaaacaaataaaatttgaaaaaccaaaatttggtcaagaaaggaaataaaattactaaattttaggcaaaaaagaacaaatttatgtgaaaaatttttgaatttgccaaaaacgtgctcgcgtcaaaaagtcttttttaattgcattttgttaaagaatttgaattttatgtgaaaaattttaaaaaccgcgaaattagggcgaaaataggggcaaaacgccataatatggataaaaagttattttaagggcgaacatccgaaataaggatttctaaggtcgaataagggcgttaaaacgcaaaattttcgaacaaaaaatgtgtttttcgtgcatttctcgtcaagttaaagccgcagaaaaaaaaataaaaacctaaaaatccgggccctactcataagccatcccttaccgtgcataataccagcagggtctcgcagcagagcggcagagagtcgagtagcggcaggcagaggaacggcttggagttgacgagcggcaggcagaggaacggcttgaagttgacgagcggcagggagaggagctgcttggagttgacgaccggcaagcggagcggcatggtagtacggagcggcatagtagcgaggagcggccgcatatggagcagcggcctgccgttgaggagcggcagggagaagagcggcttggagttgacgaccggcaagcggagcggcatggtagtacggagcggcatagtagcgaggagcggccgcatatggagcagcggcctgctggcgttgaggagcggctgagagtcgatggtcgcgtcgtacttgcgaaaacttgcgagcgca

SEQ ID NO: 32142 - DNA, 947 bp, Heterodera glycines
tgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatttcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattatttagataattattctagacgatttttttatatctcagtgcttaactattgcctttttgtatgataactggtagatattgggagtaaaaaaaagttttttgtgactatttacaataaaaatttatgcagcatttctaaaaaggat

SEQ ID NO: 32143 - DNA, 1196 bp, Heterodera glycines
tccaaattaataaggaaaatattccaaaaacctcaatttaagcaaagaatttatattttaaaaattcactaaaaataagatgtaatcacacacttcggcatggtcaccaactgcagcaaaatggagtgccgaatatccttcaaagggcggggaaaccctagggcgtccttgaaaaaaacactttcccagtgtattcattcttaattagccctcacactataaaaaacagagcatatatgtgaaaaaaattttaaattcaaacactcattaaaaattaaatatctattcattatgatattttttaaattttttttgcaaatcccttaaaagatttttttgtcgagaaatgttaaattttaattgttcaaatacataaaattttttgtaattgaataaggatttggtggggccgaacatattaaagaaggcttttccgttgagttaatttgctaactttaagcagtgaagaaatttttaaaaattttacataatttagaaaataattttttagaattttcattaaaattcttaattggacctcaaaatgcgtcagaatccgtaatttaaaaatgttcacctccctttttgtgatcatttttggcacctaccaagtttattcaggtgaccagttttggcaccacgggaaagcaaatagagcacaatgtcggccttcccatccagcgacacatggatcaacggcgtgtttccaccagaatcagtacattcaatgtccgtgccaagtctttccacgagaaattttgctaaatttgatttctcgaaaaacatttaaataaaaggaaatttttaatttaaacctagccctagccctcaggcaaaatttttaaacagaaaactttctttgtcatcgaaaattgacagggataaattgccgatcagtttgagataataagcaaacaataattaccagtttctaatttgcccttaaaacacgcgaccaaaagcaatttttggttgtcaatttcttcttgagtgtaatgttgtgcagcttgtgtttgtaaaatcagtagcagcagacaaactgcgaagcttgcacagtgctaaattattttaaaagcaaatcactaatgatcagttggtctgggcctctatacaggcctgaggggctatagtaggcaccgtccggcaagtgccagaaaggtacggtacgacaggcgccccccggggggggggggggg

SEQ ID NO: 32144 - DNA, 1070 bp, Heterodera glycines
  misc_feature (957)..(957): n is a, c, g, or t
  misc_feature (1044)..(1045): n is a, c, g, or t
aaatcggaaaatcattggcaaaaaaacaaacgccgcagggcatttggcgccgtcctcgcccgccgaggacataattgtccctttccttttgctctttacgcatttcctctcggcgcccttttcttacttttccgatttgattttttcgcccggaaaagcgccttttctttccctcccaaagttaaaaaaacaattggacaatgactaaaatcttttcgcagtattttccgtcgtttcaatttgtaaattcctaaaaattaaaattccaattcaaatatttattttccaattttaaaaaccttttaatagaatcaaaggcaaaacgttaaagtttaagaaaaatggcccaataattttcggaccgcaaaaatattgtcacgcctttgaactaacaaataagggtttttggctttttcaaaatgatcggttccgtagtatcatcattcatctaccatgccttttgtccatgccttttgtcttttgccgattggctttggcatttgccgtctccgcctggccaatgaaaagggcctaattcgtcgggcattgaatccctccgtccctttttcgcgtcatttatttgcgcagtttactgttttggccttctttttcccccagagtctttccttcgtccgtccaattaaaagcttcttccgcttccgtttcgctttggcattcgttccattaaaggccaatggattttaatatgtattaaaattcaaattcatcgcttggcaaaatccaaaagtgccaataaaaccctcggatttgttcatttttatgagtgtttccccctcgattagtcacagttcgctttttcgaaaaattcagcaaattattcggcctcagcaaacaatccccccccccatcaacagattgctttgcccgggttatcacttcccagtgccaatttctcatctcattttgccattttccctctggcaatccttccaactntccctttaaccctttcattttccacttttcgcctcgtattttccgctccgacgctttgtcattgctttttttgtgactgtcccttgnnagcatgacgaaaaagccaattgaaa

SEQ ID NO: 32145 - DNA, 1541 bp, Heterodera glycines
  misc_feature (1514)..(1515): n is a, c, g, or t
  misc_feature (1524)..(1524): n is a, c, g, or t
ttttcagcgggtttaaaaaatctagaaaaattagtaagcatttgtagtgctccgatacgtatctctgcaaaatttggtgagccgctgatcaattacaaattatttatggacgatcaaattttttgaaatttttttaagtgcaaaagtggtgggtgtctgcaaaaaattttcaccgggtttaaaaaatctaggaaaataagtaagcttttgtagtgttccgatacgtatctctgcaaaatttagtcagcccctgatcaattacaaattatttatggacgatcaaattttttgaaatttttttaagtgcaaaagtggtgggtgtctgcaaaaaattttcaccgggtttaaaaaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtgtctgcaaaaaattttcaccgggtttaataaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtcttacagcttaacaaggcccaattaagcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatgtttggattttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggtgggttcattatttatttatttttgcaaaattaattcataaatttttttcagaaactgctctgaaacgcaccaaaatttatttacaagttgaataaggcactctgactcttatattatcaaaaagggaganntgaataaanttattttaaaaatttct

SEQ ID NO: 32146 - DNA, 960 bp, Heterodera glycines
caaaattttttccattcccgtaagagctgcggaaatgtgaaattaattctcagaaaaatggctatctctttttaagacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaattcgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctttctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctcttt

SEQ ID NO: 32147 - DNA, 2185 bp, Heterodera glycines
agaaaggctaaatcgttcgataattgaaatgttacggaaaacgatcaccagtccttgggaatgggacaaacgaattccttatgttgtattttcatataatgcaaccccaaatgagtcaacgggacattccccttttactatttttttcggacgtactattcagtttccaaccacgttaacagcaccaaaaagagttaatcctgcttatacagtagatatggatgactatctccaatttttccgagaaaattatgaacaaattctgttagagacgtctcaaaatattgctaaggcacaggcaattcaaaaagctcaatttgatgcaaaaagaaatgtgaatccagaaaaatacaaaattggagacagagtaatggtctattttcgtccttcagtcaaaaccgatcacaaaaaattaggttggaatttttatgggccctttttgataaaaaatctcactcccactgcttcatttgtcattcccataaatcatttggatgatgtacctattaaagtgccaattgaacatttggtttcggcaccaattgaaatttccgatgaagttttcctaccaaaccaaaaaaggaaaaaatttctaaacaaaatgccatttttaccggaaaacaaattagaacacagaaaaatccaaatcaacttatttacaaagaaaccatcaattttagacccggaggagaccagtggaatgtgccacaattcgttgtgcagtggaatcgaggagcacagcaattgtgcggcaatcactttggcggatcttcaccctgctttggccgtgatggacaaacttcgaaatgtcaaaattgagatgctcggggagctgatctcacttatgatcgccaaggatgtcccaattgcgcaaattcgaaattgggcaacaaacagaaacacacatggacctgattttcttttaaaattcagttcaaatctgtccccatcttcccaggaattcatctcaatcatttctctttggattgaccggtgcgactttgcttttcacaacctccaggcttcagggtgcaaaaaaataaaatttttaatccccaaagaaaataagagctatccattccaaaaagcgattgaaattgctattgaggatgtgaaagctcgatctgtgttgggtctgtctaaagtaattcgaagtcctttcattgtgttcagtgattcggttggagaagtaatgaaaaataagttggaggcggaaatatttttggagaggagctacacggcactctcaaacgaaattgtcaccacctattttggtgaagaagttaaaaaaattttgattatggccggcaccgatgacattattggaaatgtgccaattgaagaaacgaaaaaggccattaaaaaaatttcatttcatttatccaagttttccatcaaaacttttattattcccctgccattcatttcaaaaaaatcgatggcacatgaaaaatttcttgatttgttggatgaaattgtgccgaaaagtggtaatgtgatcttggcactcacacgaggccatagaagcattgcagaaataactcgttatggagataaagaagagaaccgaaatgtcgatgagagcggtaaattgaaagacggtggcgcaaaaattacgctcaaatttctttgaggcggtatttggtatgaaaacgccgctcaaaatttcgccatttcctgatccacgcggaaaggaaaaaaatgaaaatgaatcccaacaaccaccaaacttaatgaccattcaattttctcatcaacaaaaccggcaatttcacccaaatccgcgccaaagttatcgcggacgaccatttggtggtaatcagcattggcgtggtaatcgcggaaatccccgatttcagcaaaattctcacaacgatttccgttttgggacccatcatggaggcccatacccaccaaaaaggggccgcttctcataaattattgttttattgtcctaatctctcaaagatattgttgctaaatacctcagacaaaattatttttctcccatttgcttctcaatttattattgtattttgcttaaatttgcttaaaataattagcgaataaattattgactatattgctttcattattagcaccagctatcgccctttcacgtcccttttcatcatatccctctcctcattatatcccgcccctacccgacccccccctcccttcc

SEQ ID NO: 32148 - DNA, 1368 bp, Heterodera glycines
tcatttcctaataattccttcactttttctttcgctgtccgctgggcccggcattcatttttggacgtttttttgcgttaatttggcccgctttttgaggagacaacggcctaaatgaaatggaaattaaatgtgacggcaccaaaaaagaaaatatgttctcacttacccaatgcaattttcaaaaagttcaaaagtgattttgttcaatttttcgtcctcccattgaattgtcttcccaatttgccatcgcttcaacaccaaatagatatgtttaccatcatcatcatcatcatcttcttcatcaatactttcatcatatttttcttttgccagtgttagcatttcgttggtccgttcgttcttcaattcaaatggctcaattggcgttgattcatcaaatagtagtacaagtcgaatgatatagctggcagaagaaatagtggcacggagaaatgcctataaaatggaaaacgaaaagcaaatggcatttaatccaacattttacgaaagtggccacacacttctttgaaattgttgatgaatccaatggtttctgacgtaccaacacgacaactcaattgctttggctttccatcttttgtcggagtgttcaaccatttggacaatgcttggccaatagttgcatttggcccatcatcagcaattgcatcgggcaaatctccggaatggattgaaataatgttgaaatcggtgagaactgtcggcgatgtgtggcgacgtaaattgtccaaatcatggagatcggaaacggtcaaatagcgaatgtttgtcgcaaaaattggccaaatttcacgagcaaaaacatcccaaattggttggacatcattggcctcaacataaaaatccaaatcgatgcctttgtcaaagatttgttcgttggcacggagaaattcgatgacggaatgatcaatgtaactgaaaggaaatacttttatcatttaataattctttgaattttgtttgtttaccaaatccaaaggtcgttaaaccgaattttgttgtgcatcggatgatcgggcaacggaaaatgcacagatttgccattgcttttctcaacatacaattttgcttttgttccattcttggcaattctgatttgtctccaaattgtcagttcgtttttgccgtcaaaatgtttgtccaccaaaacattgaaacgtggcgaaagaagtgccaatttgaggccgagttgagcatggtcaaaagatgggagaatgtccatccaaacatcgctgcacatccaactgaaaatgtggaaaaaattaataaatgagaaatttgcgtgctattaaaaaattctttaccgtcgtttcatttttttcacatttagccgttttcaaaatt

SEQ ID NO: 32149 - DNA, 2041 bp, Heterodera glycines
ttttgtcgtcttcaagaagaccatgcattattgcacctcctgggaatgaggtacaaagcaacccattaaccatcttaagatggtctgggtctccaggaaagtgacgcataagtgaatagagcgcgaacctttccgggtccgatgggggtacaggaacaattcggccgataggtggccttttaatttgctgccttttgtacaggacccatttgtcctttgcccatcggaaccgctctgggactttttcgaaaagaatgtccttaaactttggatcattcttccactcattttgccattgtttccaataggctgaacactgcgtttctggcagttcgccttgctggatttgttgagctttgctcaccagctggaatgccctatatacaatgggctgttggtttggcaaatgaattgccaatttgacaacatgatgcgaaagacgggcaaatggcattgaatgaacaatggcatatgcttccgttgcaccacggaagttcatcttggcatattgagccggctcatcaattccaattttattgccggactcttctttgcactcgacataacaatgtcctggccctttgaaagggtacttgagtgcgtatttaatatttgctttgttaccatatgcaaacagtacattatggtgtactcggtaacgcagcagaatataaggattatacggcacgacatgtgagttgtcgtatatcaggccgtttacctctaattgggcaccaccatcagatggtgaaggccggaaatacatcgcgggcctgtccgggcgcaaaatcgtacattttgagtaaggggctgggaaccccttcttgcaccgcccgtaaattgggtcgctaggaccacaccaactgtcactgcatctgtgcagttgcatatgcattgtttcgcggatttcgcgatgcatttttgcaatgggcgtgtcgtcatctttatcaggcaaagatggaatgtgcgcccatatgtattcctgaatgacatatggaactgcgtccaggtctgtttgcgccacaatgtgggcatgtgggcctcctcggccttggaactccattgattcaccgtaaccaaggattgttccgaagaactttttgtcataaagttcttctcggaactcagcgattttgctgctccagactcgcatccacatgtcaaaccggccagtaaatactggaccgctcttcagtaaattagtcttcgggctcgagagccgcccgtctgaggccgcgaagcggcctaaaaatcgctgataattttttaaaaattccaaatcttttcacaacccgatagctaatctaggtagcgaagctcccaaagcgcgaagcgctttttcccagctaaatagccgacggttcacgcacccgctagtatatacgttatattgacaaggagtttcgtttcaaaaactaatttgagcttaacggctaatgggacgggtctgaaagtagtggaagggtcttacaactttttgaggagaattcgggaaaactataggttttttgatccgagcgccaactgagtaccagggactgatttctcattttttcgtgcgtttgacggcccctaactttttttgtaaaactcgaatcaaaaagtgcccgctgaaagggcactccgcctaagggtcctctacaaggaggtattttttaaaattttttttgagcaaacccctggcctgcaaaaaatggcaactgaagcgtgctcaaaaagtacacttcagtaccaggtgaataccgcgccagggtttgatctgagcggggggtggtcagcgaacttattgtagagctttcaaagctcgattttttgaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaaatttttggcctcagcgggacatttgagtcc

SEQ ID NO: 32150 - DNA, 1470 bp, Heterodera glycines
  misc_feature (145)..(145): n is a, c, g, or t
  misc_feature (1412)..(1413): n is a, c, g, or t
  misc_feature (1439)..(1439): n is a, c, g, or t
aaatttttacgttacttatttgaaatattttattgtttattttaccattttgaaatctgtcttcaaaatgccaataaattgtccactacgaaaaatttgtcgcaattttcttatgctgtctgtccaacacttcaactatttgttntggtggcatttgccatcatatcaatttccatcttcaattggtgcgcgaactttgaaaaaaattattaataaaacaatttttcaattttttttaagaattattttcacctcgtcaattttggcataaatttccgtttgctgagcattttgcatttgagaaaacagatcaactaaacaaagagagaataattagcaaataattacaagttaattagtaaagcaattagtcatttccgccaaattttactcaccaacaaaattttccatcgacgccattttttcacataatttttgttgtgcggtgtccaactgttccaatttctgcttctgttgttttagcatttcgccgaattgaccaaaagtttcttctaatttctccacagtcgcttaaacataccgtaactttatttgtttgtgttcccaatggctaccgtaagttttcctaccgtatttggcggccttcgcttcctgtttttgttgctgctgcatttgttttaattgtttctcgagtttttcagttctatccaagactttctcaaattgaccagcagacactgaaaagggaattcgaattttttggtttatttatggcattttgtttctccgttaaaattatttgggaattttaaaatgcgacaaatggccaatttttaattttccaaatttatttaatgatttttccttttcaaattttcttatttctaccatatgcgtttcttaccgtattttcctttttccgacttcagtcgcttctcaatttcgcccatccgtccgttagttgcttcgcatttttccacaatgacttaaccatggaaacaattttaattttttcttttttttcaatttgtttcactaattaatttaattggtctctccgtttcattaattaattaactgacaatttttcgctgctttcatcatccctttctgctgctcctcttctttttgcttcgtaccttccaagtcactgattttctccaaaatggcgttgaattgttcggcgtaaactgaaaattgagtcgttattttgaacaaataaaactcgaaataatacagtaggttttttaaatacaaatacagtagtaattttcatagaaatacagtagtaattgtccatttccctaccgtatttgctctgttcctccctttccttttgctgccttttttcctcttccattttgtctactttcgactgcagtgtattaagctggaccatcagttgctggagctttaacttttcttggagttctttctttaaatcatttctnngtaaatgcgctttatcccaaatgatnttttgtatctttcacaaatgcaatttttcat

SEQ ID NO: 32151 - DNA, 1218 bp, Heterodera glycines
tcccctgcaccggcattggcattctcgtctgcgtctctgtcgagaaatacatcgccggtttgctttcccaagtgtgccttccacttttaaagtgccaacattcattttggtgcttcacccgcttttggccctcaaagtgctcaccccgcgcttccgcgttttgctaatggcctccatttgggctgtttctctcatgttcaacttgccctattacattttcaccaaatacatcttttacaagaatgttgcggtgtgtactcggttgatgcctttggctaattcgacaaaaagtgccgaaaaaaggtcgaagaatgccaaaaaaagagaagaggggcgctttttgtgccaaaatctctgataaactttcaaattttccccggatttttttggcctgaagaaaagtccttggattctctctccaaattttttctgcttccgggcttggtctcaatgatttagtggtgggtgactgtttcgaattttgctgcttcatctgctgactgatcagaattgtcacaggttagcactgtccccttcttttgagcacacgtgaccgaattttcaattattattaaattttagttgtcattgtattccaattcccttatctcaaaaaagcaaagtatttgtttggaagggtttgttgtgaatgatacgataatgggcagatgaatggtgcaaaattggaaacttaattagcaatcggaattggccaaaatgggaaaatgggcccagattgaagggggcgggaaaaacaatcgctgtcattcgccgctttcactggcattctccgattagtctgatgagcacccgcaacatcgtcacctcctccttcgtcctttggtactgcgtcccgttgctgatcatcctcttcctttacactcgcatcggtttggtcctttggcacagtgcgccgctgaagaaactgacacaagtgggcaaattgcgaaccaacagcaacggtgggttaagagaagggaaagcaaaagcatcagcagaagaagaaagcgattgatcattgttcagagacgacgacaattgttgcctcgggcaatggcagtgccaaaactagggccaaacgaagtgcgacgcatccgccgccgtcgccgccgccacaatcgacggacggcgccgaggagagggccaaacggacgaacagtgccaacgaatttgtaatggcacattttcgaagggcgacaatgagcagcgacagcgaaa

SEQ ID NO: 32152 - DNA, 1183 bp, Heterodera glycines
  misc_feature (1063)..(1063): n is a, c, g, or t
atggcaaacgcagtgtcttgtccagaaaatccacaattttgtagttgcgaagataaatgtgatgaagaagccatttaattccgaggaaaaggacaaatgtttttggttctattggccaacaaatactactagaagatgaatcaatggtggttcgtcggctggtcgctcgggtgaaaaggtcgttccacccacccatcccaccccctccctcgttcaacacacatttgcatcaatttacataaaaaaacacctgcatttcatttacacccttttcaattctataattcgtaatttaaaaaaaacatcgttaaacatcgttggcgttatgcacatcgttaaaattaacaaaacgatgttaaatcgtttcttttttttaaacgactaaaacgtcgttttgtcgttcactagaaaagtcgcacagagttcggttcgttcgtcaattatcagtcgaatcatgctaaatgaaaacatatacattggcaccgaatgcttttggtcaccatgaattttgctggtcccatccgatgtccatcaaatagcgcgtcgctgtccatccaaaatgttctctcagctgcgcaatttcgaccgagtcgaaatagaacgcaaattgttgaagaggcatccaaaatgtgcccggaccagccgcttcacccatggcgagttcccttctcagctggtgagtccaaccaagccattcgctgctaaattcaccgcgccaaacaaagtttactccccaagggttgcgcaacagtatcactctatgtgggacagagacagagatattttagactttttcctaagttaccgatgcccatcgctggtttggcgaacatccaacagcgaataggcatgttccggcgacagtccaacctgccgatattccgcctcctcaataatgcgttcacctttaattctggatttaattttcacagtaaggacattgtatttactttggaaaatgggacaacgaagggtcgaaataaatttgcaaaaaaactgacctgcaccacaagaacatgtcatcaaaaagaacagctgtctcgcacttaacagcttagcccanacgatgtcaaagtcggagtcactcaaaaattcaagggtctataaaaagggttggctgcccggtgagggttgaaaatcctaaaaaaaggcatgtagtaactgcccaaacccactaaattta

SEQ ID NO: 32153 - DNA, 1708 bp, Heterodera glycines
tttttttaccaggctggaatgaccaccgtggaaaggtcattaacccacggattttggttcaaatttgcgaaaaaaaggatctcattttgctccaatgagacactgaaccatgcttggacataggaaaagcgattgttgtgctcgtcaacaaaatttgtggcagttatgtcgacaaaaaactgaaaagcttaaatttgaattatgaatttatttaaaaaaagtaaatcaatatttccagcttttaagcattcattaattaatgaccatatgtatcgccatgagcagttggccaaagaaagtggccaccgcataaatagtcattttgcgctcaatggccaaatcttggccattttgttggtaatagctgcgcaatttgtaggccaaaagggtggctaaatttatcaaaaggcaaacaatgaaaaaaataagggcagagaaagcggcgagttcgctgttatttatctcctaaaaaggtgaatttagataaatttaaattaaaaataaataataattattattaaagtcaatacatttgcggtcttatgatcgtcaatagtgaaggtgacattgtcattttggatatggatgtacatgtccaaacgaaaaattggagcggtaaaaggcagcggaaagatgaaagagaaagcgacaacaaagggcaggccgacacgccataactaaatgaaatgggaatttaaaaataacctttaaaatagctcaataaaaccttttcgtagttaatcaggaaaagaatggcgcttagtcgatttaatagcaaaaaagcggtcaacaaattctccaagtgaaaagcataatgaagcataaaataaagaaatgccagtaaaatccgcggaaatttgaggtaaatgggcaggaaaaggccaattttgcaaaatcggatggccaaaaaggtgacaacataagtgatcaaactctgaataattgaaaatcaattaattcttggccattcattaattgccataattattggccattcattaattgccaattttgattatgttcttactaaaattgcacggataataatgaggatgaaaaatggtgaagaaaaatgtttgaagttggtgacaatggccagcaacagcgagcagtacagcacggcagacggaatgccaatggccaaaacgaaaaaaagggggaacaatttcgaattggccaaaatggtcatggcggagaagaacggagcagagacggaggagcccattgggggaggatgaaatggtgtaacggggaggaaataataaattttaaaataaaattagaaaataaattataatgtggcattttgtcgtttaataaaacatattaagggtgctattgttaagctttgttcggctttttagtgcactatatctaggtttttattttatagctaaaaagcccaaaaatcgatttggaactttgtcaaaaatattaatttattgtcaaaatttcatttcaacaaattataatatacaggctgagaaaacattactagaggcctatttgccatttttactgcatattttgagggttttttaaagccttgcctaaaaatattttcggagtcatggcaaaagatacaaaaggcataatgtacaataaaaattatggaaaaatcattataaatttttcaaaaaaaaaaaaactgaaaaacctaaataatatatttttttttgcaatctcttattatattttttattcttct

SEQ ID NO: 32154 - DNA, 1699 bp, Heterodera glycines
  misc_feature (10)..(10): n is a, c, g, or t
  misc_feature (35)..(35): n is a, c, g, or t
  misc_feature (66)..(66): n is a, c, g, or t
  misc_feature (107)..(107): n is a, c, g, or t
  misc_feature (171)..(171): n is a, c, g, or t
ggatcatttntgggtccttgaaaggctttaaatcncagtttttagggaccgggctttttaatcatncatttcctaatctaccacacgctttcacagctccacgacgntggccttggctcgccccattgttcggccgatcgggaggaatggcggaccatgttggaaaactcncaagacacatccatgttgtgccagggcaactgcattccgttcatccgatcgtcgacaccgcctgcaacagcgttgggcacaatgccaatgccgtcgtccgaccatggcactgttgttggggatggagcagttgaacatgaccagcaacagcagatgatgtacacgcgagaggagttgagcaacccaaacttggacagtgtgcaaatgttggtggattatggtggaaatgaattattagacaatacgccaaatgtgtccaagcaggcctattgattttggatgccaaataattttaattaacgcctttctcaaactgccattccccaatttaaaattattgaaaaattttgaaaagctgaaaaatatttaataattccataattaaattttacaagaaattttctgaaatttccaaaaatataatcatttttttaaattttaatatttttatctagaaagttccttaagaaaatttcaactttctctgtgaattttacgttgaaaatttttcatgcatttataaaatgaaattttctcaaaaatttttatagtattctcgaattttttcaagaatttttcctgttgtgaggatgcagttttaagaaacgcgccacacggatataaataataataatttttgatttatttaaagtctaatcgctttttcagcttgggcattgcgctgatgcaattggtccacggcattcggcgtgactgcttctacaacacatttatgatgactataaaaaagaataatggcacgggttggttggtgttggcatttttgcattttgaaattactcatggcttttcagtgctcaaaaggccgaccccctcatttatggaatggcaaaaggggctcaaagcgtgccaaagtccgtcggccgttgcactgttcgaaacgacgctggaatttgccatcaattgggacttcaaggcggaggatggcacgacggttagccaacagcaaaaagcggtgagaaaacaaagggaaaaatatccaagtattctattctatccggatttttccctggtttttttaacagaaatccggcggacgccgtcgacagatgccccgagacggaagtgccaaaacggacgacgaaaacaccgaaaatgaaaacaatgcctcaacatcggcggcgatggcacaaaagcagcagcagagacaacacacgcgacagagggaggtgaacaatttgttggtggaggcgggattcttgggcggcatggcgatcggagcacggacgcgcaagccggtgaccaaatacggtaattattcaaacacttttaggggcaaaacatatcaaaatttttattttccgaccattttttatatttacgtttgtctgttggatacatactaatttccggaacacaatgtttaggtgacgtggaaatggatgtggacaagctgaactttgacgaggcggaggaggaggaagacgagcaacagcagcggagagaagaaaacgcggaagagatggaggaggagtacaaggaggaacaaagtggcgacgaacagcaa

SEQ ID NO: 32155 - DNA, 635 bp, Heterodera glycines
taatcatttaccaatgcatatcaaattccacatttactgtgcgaaattgaatggcccattcagcgttttgactggtacaattcgcttggttgcttctgcaatgataaaatttttttttttttttaatttggctatttacaatcaaggtaattaattcatcataaaagtttgaaaaaaaaattgctgaattttttttcttttagttttcttattgaaaaattttctaaaaattttttcattgtaaaatttctgtttgaaaattttttttttccaaaaaattttccggcgactttttggggtgctcgtcaaaattcaaagcctcccccccccctcacgtcttacttggccatgccagccaatgcttcgcatcgtttgttcgccttttcggcatccggaaacacgtgttggccacatttgagcaatgttggtgccgcgcccgcataagtcatgtacaacatgttgcccacctgtttttcccaaatttaaacgaaattttttttaatttttgaaaaaccgtatcccctgcaaaatgtttggggaaaaaatacgcaaattttgattttttgaattgtaatggggaaaaatttgcgaattttccctaattgatagtttgttctaaaaaaaatgagggtgaa

SEQ ID NO: 32156 - DNA, 1103 bp, Heterodera glycines
  misc_feature (111)..(111): n is a, c, g, or t
cccataaatctgggcgcatcggtcggggggactgccccgaaaacaaaaaaatcgattttttcaagtgtccgtttggggtactcaaacatttatggggagcaaaaatccacngcagaattaaagtacaggctatagggaagctattcccgaaggattcggtctccccataaatctgggcgcatcggttcagggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgataatattaaaaatcgtatttctcttcatagtatccaaagtttggggcacttcagaacaattatcggaaaaaaaaatcaaacccaaaattaaaggacaggctaaaggaattaaaaattccgaaaaaattcagtcatccccataaatctgggcgaaaaagcatcagagggactaaatgccccgaaaacaaaaaaatcgattttttcaagtgtccgtttggggtactcaaacaattatggggagcaaaaatccaacgcaaaaataaagtacaggctatagcgaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattcccgaaggattcggtctccccataaatctgggcgcatcggttcagggggactgccccgaaaacccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctttttaaaaaggaattaaaaattttttaaaatttattcatctccctttttgatagaaaaagcatc

SEQ ID NO: 32157 - DNA, 858 bp, Heterodera glycines
aacgacatgtcgggggtcgggtcgggggattggtccaaaaaacgtctcgggtcgggtcgggggccggggggctcggggtcggggcttaaccctaatacaaagaaccaaattttgtaaattttcaaggaaaaaaatgatttatatggtcgagcagcgccgacaggcgccgctggggaaaaattggaaaatttggccatatttcttaacatatttccacaaaaattgccaattattgggtcaaattttgtaaattttaagcaattttgtaccaaactaaaagaaataagcaaaaaataagaacccatgttgcgcaataaaatggaattttataaaataaatttttgaaatatataaattttggaaaaatagttcggttcttttacaattttactagaaatttttctttaataaaaattcttctcaagtgatgatatttatactttaattggtaggccgtcccatttttgaaaaaaaaatttcaaatttcttctgacggcgcctaccgatactccggtccaaaaaatcatttatttatttttttaaatgttaacaacgaaaaatctttcgtgagaatttccttaatcatgaacagtcgaaattcgtcggcagttagctaaattaaatgttatgcattgactctcttgtcatagagttgaaaatcacaaaagcatagggaaaaaggagtttatgggaatgataaaacgagaatatttgacactcttccagcttcgtgtcgcaacattttcgcttgttgcaatggcaattggtctttgctttgtgacagtagcaaatgtcgtccaaatgcatttgcttactgcactttttgctgacgaactgactccaacgccttaaaatgga

SEQ ID NO: 32158 - DNA, 1717 bp, Heterodera glycines
  misc_feature (8)..(8): n is a, c, g, or t
ggattttnttgaaatttgtcttagaaatgagagaaatgttgaaaaaccaattcggttttaggaacatctcaatttatctaatgacaataataaatatatttttaattctataatccttttcttgataaatttaactaaaacattggtcacttgaaataacaaattcccaaaatattatcctgaaaacccaacttttcgtgactaattttaatatttgctattacatttctcttttaattaaatccgacttttggggatccgacacttagtgaacccgaaatttggggatccgacacttagtgaacccgaaatttggtgactcgacatttggggacccgacgtttaaggatttcaataaaaaaaaaaaaaaaaaaaaaaattaattttaggcccaaaattagacagacttacgtctgctttagccagtgttaataactctgtttccggactcactgcgaggagatagcagaattttgagcccatactaaccacaagacaatagacaaatcacaatacattttttaagtagtacacctctttccgatttttatttaaaatacctttcccaaggccaacgggaacagaattcgtcaagagccttcaaaaagttcgagacgactttgctgtctaattgcgtccaacaaatgccgagatcatcttttctgtttcttatctttcgagtgactttgtgcggtgctttaaattaattttttttttgactcacttgcaaagaaaatctcagtccggaaaaagagttatttaaaaaatattattattttttttcttgcaatggaatgaaatctggctaaagcagacttaaatttgtctaattttggatataaaaataaaatttaaaatttttttttgttttattaaatccccaaatgtcgggatccccaaaagttggatccccaaatgtcgggatccccaaaagtcgggtccccaaatgtcgggatccccaaaagtcgggtccccaaatgtccggatccccaaaagtcgggtccccaaatgtccggatccccaaaagtcgagtccccaaatgtagggatccccaaaagtcgggtccccaaatgttgggatccccaaaagtcgggtccccaaatgtcgggatccccaaaagtcgggtccccaaatgtcgggatccccaaaagtcgggtcccaaaatgtcgggtccacaagttgcaaatccccaaaagtcgggtagccccgttctcttccgttgctaatgtttgtcctaatatatatttttatttatgcgaccgaatagtagaatgagcgaggaataagaagtttttcattgaattaatttgaacattttttaaaatggtcatttcaatatacatttattttaatattgtttttattccattttttggtttttatttttaatttgttcgttaaattaaactctttccaaagtttctttaatttttcttttttcaaatctcatttttaattaaatactcgtcacatcaaaagaattattatatttttggcgatttttaagaatggagagtccataatcgaaatttaatttttcgctttaaaataggcttctgctgtggattttcaatggtcatgttcacgaatttgaatcttttttaataaaaaggcaaaaaaaaaagtcaaaaacaattatttttttttaattattttctaaaaataccttaatatttattgaaaaaattaattaattatatttatcttttattaaaat

SEQ ID NO: 32159 - DNA, 1113 bp, Heterodera glycines
attttttcaaaaaatagcttaaaatttttcaattttttttctcgaaattttcttggaacaatttttttctaataataagattttgaatttcctattttggttttttttaaaatttttctatgggcgagagctgttcccggcaaaggcccctacccaaaaatagattttaaattgggacattttaccaacaacaaaaaaactatcaatttttgatgacgaaactaattaatattgcctataaaaaagttgaattgaattgaactgttcgtccttgaaaaagggttgactgtgaaaaaaaaaaattatttgtaagaggcgagcgaaaatttacaaaaaaaatttaatttttaacgtgcaaaatccaattaatttattgcgtatcaataaaatgcgaagtaaagaatttttcactgattatttaaaaaatgatttcatagcttttgtctaatcttaattttttaaaattttacgcccattttatctatttttccgaacttcttgttgatcaattttttctgatcacatttcaatgtgcatataatctatttttttaaattttgcctattccgaatttttaaaatttttttgtgtttatattcgcttgtgtttgtgtgtgagctgctgatttttttttcattccatctcttaatttgttgctgactaatggaaagaaaatatgagttatccctttttggactagcttttgtaagtgcgaaaaagtcgaaatttgttaaaattttgattcgggatagcgaccaacttgggggtttaggattttcaggctgccttgggtgggtgggggatgggggctgtgcccaatcgaaataaaaaaattttttagatcatgtttaagaaatttacccacttgggggagggggtgtgtgtactcagtgtacataccctcggaaattgatcaaaaattttcgatcattttttgatcaagcaccccctaaacagcttatagcgggagaggaattcacgattttgtttgaaacaaaattattttcaaaaatatagcaggcggacggcagacctgaatgaattagctaacatataaatcaaatgggttttcattgtttacctcgcacaaaaaatatataatcaaaaaaataa

SEQ ID NO: 32160 - DNA, 1936 bp, Heterodera glycines
  misc_feature (1579)..(1579): n is a, c, g, or t
  misc_feature (1872)..(1872): n is a, c, g, or t
ctatagggcgaatagtcggtggaatattagtcgtagcgattgggcgaaatgtcggaggaatattactgatagcgattgggcgaatcgtcggaggaatattagtcgtagtaattgggcgaatcgtcggaggaatattagtgatagcgattgggcggattgtcagaggaatattagtagtagcgattgggcgggtcgtcgaaggaatattagtcatagtaattgggcgaatcgtcgaaggaatattagtcgtaataattgggcgagttgtcggtggagtatgagtggcgattatgggaattgtcgatggaatacgcgttgtagagacgggacgaattgtcggtggaatattagtggtagtaatagttggacgggttgtcatggcgatttcagcaatttgacctcttcgcaaattcggccttcttgttggttcaattctcggcacatttggttttctttgtccaggttttagactcgcggtctctcgtcttggacgcgctcccttggttgagtttactttaccaatgacatgcacaaaaacattgttgtccgtttttagcgcatcttcaggcactccaaacacaggaaattttctttcctgatttcggcttattggaaaagtgtattggagctcgtccacgatcactgccttttttggccaaatttccgtgattactgggccaatcacaaaatgtgaatgccaaaattcatccgatggaattttccacatgagcaattccacagctcctggcagtctgatccagctgccgtcttcccccaggcttttatcaatttttaaagagtctccccacgaagttatcagccttttcccatccaaaatctctgcttttccttcttcaatcactgtctgtacattgttgaaacaattcacgccgtaccatccgtactcttttcgaattggcgccaaactttcccatcttgtctcgctcactctgttcattggcgaatggtgtattgaggcctgacagtcctcgactgaagcttcggcttcaattttcttgtcaggatgatccaacgtcatgattcggagaaaagactcggtgcatgtgactgttgtcacattccagcatttaaatgtgggaaacactcgcgaaatccgaattggtatgtaaagatttgacttcaccgtcagtggaggcttttccaccggaagagtgcaattttgttcctccggaaagctcatagtaacagtaatcccttctgtcggtttggacgggcataattggtattgtccgtcagcgggtaagaacatcgccgccatgatggtcatcagacaaataaatggaaaattcacttcgttgacgcgccagccagtccgtcctcgattggcatcacttcctccgcgtcctctgttgggacctgttggtccacttcctcttggccaattttggttttggttgatgttcggttgaaaattgccattgttgtttgttgttgtgcccgcctgggcttgggccacctgctgaaagcacctccacggatttcgtccttcccttctctttccaatctttctatctctctctcgtgcattactctttctctgattgctccatcccaaatnatgttgccattgtccccgtccccgcccctttccccaatcgctctaatcagatttaaggggaatgatgttgggatttgagtcagttgttgatcactcggccttttcgatcattcaccatttccctggctttttgctacacattctggtcaataaaccttttgttattggcttgacattttggtgagcagctttttgggggagggatgcgctctcccacatttcaggttctgcctgaaatgctgggagggcccaacacccctcgcgtaattccccgcacattatggcgctcctgngtggatttggaccattacaccgtaccactcgcccatatatatatatttgtttcgcttttatttt

SEQ ID NO: 32161 - DNA, 1229 bp, Heterodera glycines
cattctacccaatcaaaaccagtcatcagaaagaaagcacgcgagaaatttttctggagtatttttaagagtaaataattataatttgtcaatcctaacattttaaaatatattaagcgcatttaaatcaccattctacccaatcaaaaccagtcatcagaaagaaagcacgcgagaaatttttatggagtatttttgagagtaaataattataatttgtcaatcctaacattttaaaatatattaaacgtatataaatcactattctacccaatcaaaaccagtcatcagaaagaaagcacgcgagaaacttttctggagtatttttgagagtaaataattataatttgtcaatcctaacattttaaaatatattaagcgcatttaaatcaccattctacccaatcaaaaccagtcatcagaaagaaagcacgcgagaaatttttctggagtatttttgagagtaaataattataatttgtcaatcctaacattttaaaatatattaaacgtatataaatcactattctacccaatcaaaaccagtcatcagaaagaaagcacgcgagaaatttttctggagtatttttgagagtaaataattataatttgtcaatcctaacattttaaaatatattaaacgtatataaatcactattctacccaatcaaaaccagccataagaaagaaagcacgcgagaaacttttcttgaatatttttgagagtaaataattataatttgtccatcctaacattttaaaatatattaagcgcatatagatcaccattctacccaattaaaggcagccataagaaagaaagcacgcgagaaatttttctggagtatttttgagagttaatgattatgttcggggatcgtggcgtaatcagtatagttaggtctattcaaagccaccattactcttcagatctagtcacgagtcatctatgaaatgaaatgcgacgaggatgagaattgtgtgtcgtggcaagtgattttctgatgatgtaaaataatctatcaatttagtcaaatcaatagcattatataacatatatataaggacaaaatatattaacattttttttaatcatattcagtcatcagaaagaaacctcacgagaaatttatatggagtattatagagagtaaataattataattcgtcaatcgtaacattttaaaatatattaagcgtatataaatctccattctacccaatcaaaa

SEQ ID NO: 32162 - DNA, 1316 bp, Heterodera glycines
  misc_feature (74)..(74): n is a, c, g, or t
tgcctttttgtatgataactggtagatattgggagtaaaaaaaagtttttttgtgactatttacaataaaaatntatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaaattttcagcttttcttgaaaagttttttcccagaatttatacagctttcccgacaaattgttgagataattattctagacgatttttttatatctcaaagcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggtccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttatttaactttcccgacaaattgttgagataattattctagacgatttttttatatctcaaagcttaactattgcctttttgtatgataactggtagatattgggagtgaaaaaaagtttgtttgtgactatttacaataaaaatttatgcagcatt

SEQ ID NO: 32163 - DNA, 1731 bp, Heterodera glycines
ggggacctctagagtctgctcattttggtgagcatttcggcacactgacatctttaatggcttttatttatgtaaatgtacattcagatcagctggttccacttttgggtgcacagctcgtggtccgttccacgcactttgagtgccgccattccctttttgattttcatttgtttgttggtacgcacgggtcgagactctcgagagtattgccaattcgtcccccccccgttcagctgcttgctcccgcccagtcggctgcgcttcgcacttggtttctgctctgttccgtgttcgcactgctgtccctggtggagtatttcctggtcatccgtcattacaccaccgtcgccatggggtgatgacattattcttttttaatgccatcgaaagtgtgcccttttcacgctccgttccctctcagtgggaatcggctggccacgctccaacgcttttcgcggccgttgagcgcattggaccacccgcagcaacaccaagcgcagaacggacacagccatttggaggaggagcggaaggcgacgccgacaacgaccacaacggtggtggtcactcaggacgaagtgagtgccgtgccgaaaggaccttcagcatccgaagaaactccctcctttagccgctcattcaacacggcgaatcgaccgcagtgctcgggcacggcgcgtggcactccaacaaattggacgtcgtctcccgcgtggcttttccaattgcctttctgctggccacttgcatttacatccttttctatctgtacttttaacttgcaataaaacaataggcacagcagggtgtcctggagaataaataaatgccctcaggcgcctgagccgtccgtcggtctctttgatcgttgtactgtatgtgtactgtgtgtgtatttgctgataaatgggagagggaacgtgatttttgggatttaacactttctaatcaccaatttgtgtagaaagcgcacgtaaaagattaacgaagtttggagatttgcacaaatcaattttaatgaattgagcgaagcgaaagttagggacgaaccaatgacgacgcttttgttatcgacaaacacatttatatttatcaatattgggacaaccattaacagtgcgtagcgagcaaattgggcgggggaaaaatgggggggggggcgccggagggaaaatgcggggaatccgttgccaccgccaaatttaatgttttaaacagaaacactccatccctctctgcacggaattgtcctttttatgtgccttataagcatagtggtgtactattaatacccgtctccctaattttaattgctttcgatggagaggcggcgaagtggaaaaggtaattaattaattaggtacttatttgattaattaattgcctaattaattgatcggttactcgctaatcgatttctctcctttccctttccgttttgcgccgttccctcaaactgtgccgtgcccatttgctcctctcgctgacaatttcctccgtttttgtcggcctttttctcggattcgctcttcgcattttccaactttcccctgaaaccgttcgtctcgtcaattttcccggtctctccttcgcctaatgaatgcccttttcaatccgtccgattaaaggcgaaattttcatgcaagtgttgaaaatgatgattttgccgttgatcttttcgtcgctcgtctccggtaaatttttattttttggctcggcacaagcgat

SEQ ID NO: 32164 - DNA, 1381 bp, Heterodera glycines
  misc_feature (21)..(21): n is a, c, g, or t
  misc_feature (1205)..(1205): n is a, c, g, or t
  misc_feature (1308)..(1308): n is a, c, g, or t
  misc_feature (1357)..(1357): n is a, c, g, or t
  misc_feature (1359)..(1359): n is a, c, g, or t
aaatgtgataaatgtactacnatgtataatacaaataaaatgtaggcacaaccaaacatagtatgtaaatgtgatgtaataaatgaacccctcagggtgggactgatcaaaggaaatggggggaaacggcactgagcaaaagaaaatgtgtgccaattgatcaaaaggggaatggcattgatcaaaagagaatgtgtgcctaatgatcaaagaaaaattggggaatggcactgatcgaaagagaatgtgtgccaaatgaacaaaaagaaatggggaatggcactgatcaaaagagaatgtgcgccaaatgatcaaaaagaaatgggggaatggatgatcaaaagagaatgtgtgccaaatgatcaaaaagaaatgagggaatggcactgatcaaaagagaatgtgtgccaaatgacaaaaataaatgggtgaatggcactgatcgaaagagaatgtgtgccaaatgatcaaaacgaaatgggggaatggcacgatcaaaagagaatgtgtgccaaacgatcaaaaagaaatgggggaatggcacgatcaaaagagaatgtgtgccaaatgacaaaaagaaatggggaaatggcaatgatcaaaagagaatgtgtgccaaatgatcaaaaaaaaaattagggaatggcactgatcgaaagagaatgtgtgccaaatgacaaaaagaaatggggaatggcactgatcaaaagagaatttgcgccaaatgatcaatgaaaaaatagggggatggcactgatcaaaagaaaatgtgcgccaaatgatcaatgaaaaatgtgggggatggcactgatcaaaagaaaatgtgcgccaaatgatcaatgaaaaatgtgggggatggcactgatcaaaagaaaatgtgcgccaaatgatcaatgaaaaaaatagggggatggcactgatgcgcacaatataatcagtgaaaaatgggtaatggcaggacaaatgatcaacttgaaatgagggacacttgatcaatgaagggcagttgatcaaattaaaataagggacaaatgatcaaattgaaatgaggggaaaatgtgagaaaataagtgggcccctcagggaatgccattgatcaaaagaaattgtgcgcaatttgaatgggactgatcagaagaagaagcaatgaaactcaccaatagagttgagacaaatgatcaagtgaaaatgagggacaattgatncaagaagaaaatttatcagattaaaattagggataaattgatcatgagggacaatcgatcaatgagggacaattgatcaaattagaacgagggacatttgatncatgaaagacaattgatcaaatcaaaatcagggacaatttgatcatgangngcaatttgatcgatgaacatga

SEQ ID NO: 32165 - DNA, 1835 bp, Heterodera glycines
  misc_feature (1830)..(1830): n is a, c, g, or t
ccatccaacaaagaggtgctccatcatcgactcttcttcgttggttcacttttcatcatttggcgaacgagaacgggaacgacttggagttggggagcgagaacgagatcgggaacgagaccgaccattttcagctagaagggatataacaattaaaaccataaatgacctaaaataaaaaattattcatgaattgcgtggtgcttattacgaatctgaacttggacttgcccaattccggaccccgggtacgaattcgaataaaaagttgaatttttttcgaagatgcatttttgctttggtaaaagtctcgaattcatttaaaatttatttattttaaagcaaaacaatgcttcaatgtcaaatgaataaaaatgtcagcaccctcaaaaaccccaggaatttgatttttatcacaaaattaaaaaaaagttaaatagggaccacaattttttaccattgcacctttatttatttttattcatatgttataataatcctaagaaattaatcacccagtatcatcagaatttctaacactaaaatgccatgggtcagttattaccaggcgaagcgctgcgcgaacgaggagagcgtgaacgagaaggcggtgaacgagtacgagaacgcggagagcgggaacgcgaacggggcgaacgagagcgactaagaaatttgcgagggaatggcattggtcaaaacgtacgtaccttttgcgcccggcatagccttcggagtcatctacgagtttgattctgcgcccgtttatatccttgcctcaaagaaaaacaattattatcaatttttacatttttatttcttaccctgataacgttcgactgcacgtcgcaaatcctcatgggtggcgaagcagacaactgcttcatttctcacttttttgtgtgcgtccgcataagtgacttcgccggcatttcgcatcagatccttgaggtcctgaatgttggaaagcaatgaatagcattaaaacaacaatcttaggaagaagcggactacaacatcaaacccattggggttgtaatgtacgctttaagttagtttttcaatggaaagtgaacacaccatcctgctcatttgtcagccctactcttcctccctcttcttcttcctcctcctcttccaccactgtttttctgcagttatgccctcttcccatcagttcttctcattgatgagcacaaaaaaggggccatttgtgtctcatctcttccattcggaacccaacagaaagagggggacaacgctctcatcacacggagaaggtgcccataaattcattagttcatcttcgattccttctcgaagagacttcccctccgaaagcgaagaatgggaaaaacatagagaaaggcgaaagtggtgaagagccatcgaagaaaccacccaaagagcaccgacaagagcctggatttttgttagacttcgaaaataatttattgatttgcgcaaccaccagcgcagcttaagctggtttttaaataatgaattggatgcatacaaaaaaggcaattgggtaatttttgaggaattttaacatgttttttttacgtttggaaagtgtaaaaaggcaacctgccatgaacagcgtgttgacaaattagtcaccaacattcgataacgcgtctgtataggcggtccataacgagaacttaatagaaagctttcttcgttaaaaaatgaatttattgatagggcaccagaattttggtcgtttattaaaacataacagttaaaagcactaaccttaaaatgtttttaacccaaaacaattagtgtgcgtcgtgaaagggggaatttttaacccagactcgnaagaa

SEQ ID NO: 32166 - DNA, 1259 bp, Heterodera glycines
ctgtcctattcaatgcaatggtcggccatcacggcgcattccaaggcgtaaccatcgggcgcaaaattataattgctttgattttattaattaacaaattccatttagggatgagttgtcattgcgaatttcttgcaagttcctcgcacttttcaacttcgcaggcctcagagtttgtcactttttgaacagttaaatttgttgcaatttgccattgccttcagattgacgccgcattgcgtgactttctcggccatgtccaattgtgtggggacatttgccagagggagcgactgttggagcattttgccaagcgatatttcgaatgcaatccgaccgtgttcaattcggccggtcatttttattttctgactttccaccaacttatttgcaatgttacactgcactttgcttttagacgatgtccgattgttggcctcggcactgattttgctgagcgcggatttgcacggcacagttgtgagtgttcaagtgacagttcctttggcacagtccgtccgtcctcatttagcgcagattttttatcttaaatactaaaaaatgttccataaaggtgcgaaatgcgtctgaaaaggcgatgagttgtcgcgaattcatcgacaatttgtcgcattctgaacacaaatttgacacggcgatgcttcgggaattgtacgtcgtggtcagcgaacggccgatcaattggcgacggacggaaagtgacgagatggaggggtcggttcaggtgcggtgccattttggccaatgggcgagccatgatttcttttcagaatccaattttttttccttccaccgtttagtcgtcctccaccgaccatcacaacttcgagactcgctttggtcgcattctgtcctcaaaacgacgcggttcttccgtaatttctgagttgagatcggacagtttggccggcacgatggtcgacccggagcatcaagtggactacaaacacgggtggctgtttaggaagtccatttacgacgcggacggaaaacgaagtcggcacggccaatggacggagtcggcaataatattcgcttgttttagcgccatttggaagacggaaatggctgatgcattatgtcactgtccgaggaatggtacaaactttcggtttttgcccctttttttgactttttgccatcgttcaggtgctttacctccaccaaaatgaacacagcttctcctcggtctgccgttacgtcacattccgcaattgcattctcctccaccacgcctt

SEQ ID NO: 32167 - DNA, 1354 bp, Heterodera glycines
  misc_feature (37)..(37): n is a, c, g, or t
  misc_feature (54)..(54): n is a, c, g, or t
  misc_feature (59)..(59): n is a, c, g, or t
  misc_feature (70)..(70): n is a, c, g, or t
  misc_feature (90)..(90): n is a, c, g, or t
  misc_feature (122)..(122): n is a, c, g, or t
  misc_feature (137)..(137): n is a, c, g, or t
  misc_feature (1270)..(1271): n is a, c, g, or t
  misc_feature (1289)..(1289): n is a, c, g, or t
  misc_feature (1328)..(1330): n is a, c, g, or t
aaaaaaaactccagtttgggcgatgcaaaaaaactcnagtgatgataaaataanttaantttaattattntattcattaaattttatatntaatataatataatatatggggaagtattttntcataaattattatntaaattttttaaaaaagactaaatttttatttacctattcttgaacaaggaaattatagaattgaataaatcattgtctatacggctatcttaaggcctaacaagcggattttacatggattaattgcatcttacaaaataaatccattatacaaatgactttttgactgcaaaaatacgtgtaattgaaattttcatatggtataaatttttttttgattggagatagaatgctgtaagcatacccttttgtttgcatttcccgcgtatagatgaaaaaagatatttgtacaaaaaatttagaacaaaaatggctaagttttatattattctttttaaatttatatttaaatattaatggtataattaaaggcattacacagattaatattattaaatttaattattttatcttcactgatttttttttcgcatcgacctagcaccgaataaaacaatggaacccgttacttaaaaccaaaaacatgttcttacataaaattattaaatttgatgaatacatattaaattttaaatataaaatttctctttttaagaaaataacgcatgtttcaaattatttaaatctaaaaaattaatgaaatataaaaaataatttttatttttgtaaaaaattaattttttgttttgtcaacaaaaaaaaactttattgaagcagttatttaacggttgttttaattttattttttaatatttatttaaaacaaatgaatttggccatattaagagaaagaaaaaataaaatggtaattctgaatttaaaaaatataattgtttaaaagaaaattttttaaattaaacttagttgaaggcagtatgtctttaatgagatttgcattaaaattatattttaataaataatctacatatcttcgaccatttttgttttagacacgagcatttttaaatttgaaaggagtatattatacagactactatttcaagaattttaaaagaaataaaagcagtcaaaattcttactttacttgttttttttgcggaacaactttttgtataataatatttaacggatttttttctttaacccttgcaaataaatatgtttttattagtttaattttgatttaattaattgaccgaattattaattnngaaaaaattaaaatcatntttgattatgaaaactgaaaagatttatttattttcaannnttgtctgaagtgcgtgtttttttt

SEQ ID NO: 32168 - DNA, 1182 bp, Heterodera glycines
catcaaattacagtattattagatagcttacataggatgaacccaaatttttttagacgatttttttaaagaattttaaaatcagtataacaatttcatgatgagctttggcaatcaatgattagcacaactttccgcgaatgcaccacaccgaatagacgggatcaaaccccggcctccttagatatgagaatttctcgaaaacctatcctattaggggggtggaccaatcccaagaacgtatgaatgctggcacatacatccagcccggtctcggaccgcggtgccgcctccaccgtgtcggtgtcctcggtgctgttgtcggaggcgaagtagtcaaagtcgtactggcgtgccaactcaaaatactcggcatactcgcgcaggtaaaggatggtgaactgtttacctgtgaatatagcaaataaaattccaaaatgctaaaatattcaaacatatcacccccccccctccccctaaaaaattgctaaacaattttagtgcggcaaacagaatgctaaaatatgtctttttcaatttatacaaaaaatccattaatttattaattcatttcaccatttatttttttaatcaaatgatttccttaattaaattttattcaacaaaattttcaatcctttcatttcgaaaaaaaatatccagggccagcggtatgacgaaaaacttgcagacttattttaactatgattggcacgtttgctttcttaagcaagttctagtccgggtcgcagttggaggggcatgattttttaaaattcgggaaaaaccccctaaaattttgcaattccattttccatttgccggtgcttctgctgcacaggggcccacctttgcactgccgaagcccctcgaactcgtccaacatggcgttgagccgggccactgtgccggatgtctaccggtttgttgaccaacacggtcaacgggcctggccaagttgcgagaatgagagtcagttatttatttttgtgccgacgttgcgcaatgaatgccgaaaaattgcgccaaaaggggggaattttttttttgcagtttttaaaatttatttttgccgttttttaaaatatttttatttgaaattttgaggaaatgttaaaaatgatttaattttgttttttgcttcccatttacccagtagaagagcacgccgacgagaagtag

SEQ ID NO: 32169 - DNA, 1225 bp, Heterodera glycines
cccaggtggaattatggccaccaatccactcccgccacccgccggcggtacactaccaacaccgcccatgcccatcatcatcatcgcttgctgatggctcaacaaaatgcaattgccggcaccaccggcagtgccaccggtggcaaaaacgggacgaaaagctccaccaacaatggcattttgaccaatgaatgtgggaccagcagcgccaacaccaccaccacttcctaattgtttacagcggtacaaatccggcagaataattgcctaatggtttttctatgcttttggcaatgttcgagaatggaaacagaaattgattggttacattgccgggaaacattttgaaaattttcgcgattttctcaaatttttcaaaataaattacacccgaattctataggtttgactttaaaacctcgacaattcccaaagcccggagaattgggaggcgaaatttcacaattaatggtctaaagcatcattgtgctaaaaagccaaattatcgaacattgccattgcactcagtcgatgagtttgtaccggcattaaaagttggcatttgttgctgttgctcagcagcaacaacaatgttttgtgccgtacgactaacaacgcaactcgttggggttacggtggctgtgttcaccaccacattttgctgattggtgctaattgagcctgtttgtccatcagttgtgccaacagtgacattcgtattgctattgttgttgttattgtccccgactgtcgccgttggtgttcccacgctgcaaatggtaatggcacatggcgatttggcaaaatgccatggtgaaagggggggggagcaatggatgtgcctatcccgtggaaatacaacagataggcaatgatcgatcaacagacacaaacagtgagaatgtcaaaaaaaatggagtcattctggacaaaactgattaaaaaaccactagcctatgtccaaaccatgaagtgaacggcaaatgtttatcattcactcaaatcaatcgcttattttattaaatttattctctcaagatttatgaataccctaagcattttcaaaataattttttatttggaattttttaatttaggaaattttctttttatattatatatttatatttttaattttgttttattaaggaaggtacataaataaacccacttcatcattggctcggaggagtcaacagtttctgttgcatttgaagctgttcat

SEQ ID NO: 32170 - DNA, 1372 bp, Heterodera glycines
ctcattttcattcattcattctttctttcactcatccgttttccttttggtcccccctccccctcggggcttttcatttttattcgcgctatttttgtgccaaactctttttttttatcataaattgatcgatgttgaaaacttattttccattcaaatgcattttattcaattatttagacatatttaacttttttaacactttttttctcaatttgaattttcttttctcttttctttggtagtcaaaataattatttattcccaatttttatgtaaaaagaacaaacaatggcattttttggcacgaaattcaggcaaaataattatttcagcggaatcagaaaaattccgccacacaaaaattgaaattgaaataaataaatctagtcaaaaattaaaatattagtattttaaacaattcgaaaaggcaattttatttctttaatggtccttttttaaatttttaaatgcgtttaaattttattttaatttattacatttttaaattaatttccgccaattgcctttttctttccgtctgtcactagcaaaaattaaaagttaaactaaacacccaacatgccaattatttttttccaccacaaattttcaattgttaccaaattccggaagagccaacagattgtactgcttcccctaatatttgcgtttctctgcttcttttcctctctcttcctcattgtctttttgttcctctcttttcttttcctgtccatttccggtttgtgtgcctaattgcttttggcacggtaattagtggaaagcgaacatcaatttgtgctgttttgtcaatggaaatcatacgccccttttgcttggttggttaatgcattcaattgttctgaattggcactaaaaaggcatttttattggtttcttagaatctaaaccattccatatattaattagtaactaattaattcggatataataaagagggaggagccaaatggagggcggaggacatcgaaatggggaaggccaactattcttatccgagactattcctggcatttttttttgctttttcttcgtaaatgtttcgtttcctattattattaattgacggacattcctttcaaattcataattattttacatcaataaaagtcaatttggacatgataatcttaagaatttgttcctcatttgccccccccccccttctgccgtaaaattgggttattttgagcattttttgagcatttggccaattcgtccatcggtcggtctttcgttcgttcgttttttgagttgacacaaaaataacattgaaaggatcaatgcttttttgctgctgctgttactaatttattttctcaataatttcctcccaaactttgcttaa

SEQ ID NO: 32171 - DNA, 1483 bp, Heterodera glycines
ataatcattcgctaaagcccaacagtcgtttcgctcacaaatcagtgattcgattgtccgccctttggtacttacgattgcccggcatatgccccaatttgtctctgatcagtcggcacgcgtcgtgcaccaaagtgcgcggttcgaattgcattgtctttttgacgcccttctcgcgacattcgatgttcaaagtgagcacgcccatctcgagaagagaagaggggaaaggagagggcggctgagaaagaaacaaattcggtggaataccctaaggcaaaattaaaccattggcaaaaaataatcacgcaaaagcgaatatgaatatgtaaaaacgaacagaatgccatggcagaatgccatgaatgaatttttcgtttaaaaattgtttaattgatttaataaatcgacagaaaaagaaaaatgttctaagaaatgcaaaatttaattgatggattaaggaggaaagaaagaaggggaaaagtgaacagaaagagagacggggagagagaggcaaaacgaatgtttattgtttgaagggtaagcgaggaaagtgacctctaacaataagcaacagagggaataattggatcaaatggggggggggggattttgatcagtgatcggaatgaaaaagcgcatggggtgacgaggaatgttcagccattccccgaacgaatgctaatctgaagaataattagcgatgggtgggcgaggaacgaaaagcgcagcagtggaagaggaaaagcaaaacaaactgagaatttgagaggaaaaaccacggaaataaatttggctaacgtctgatgaaggaaaaggaatcgattgctgctgatagacaattattcttcaattggacgatggctgagtataacacattttaatatttgcggttttgaattatgcaaagctcagataaagcaaagcggaaaacgggggaagagcggggaagggacggcacagagggagagggtaaaggacaggaaggacggcatagggggagtaaagttaagggaaggaagtacggcacaggagagggtaaagagagggtaaaggggatggagtacggcatagggttgaggaaagttatgggaagcgagtacggcacatttgggaaggggcaaacatcgtcccaaaaaatcttccatcagcaagcagcaacagaggcagaagaaggaaaggctgcttttccggctcattttcggccaattttagcggacgatgcgaggccaattggccggccacgacatttgcaacgcttttcccgcctctgttggagtccgtcccctgggggtatggcgacgggcgtctccccccccccccaagtccatcgtccctctcccttcccctccccctcccttcgccgccgcttcggccgtgtccattgactggccaatgtgtgtagtgcaagtgcattgaaagagaaggggaccaccgacaactttcgagatttgcttcttagcattcgccagaagaagaaaga

SEQ ID NO: 32172 - DNA, 1067 bp, Heterodera glycines
aatgcggtgtatagagaacagaaacagaaaatgccaaatttttcaatttataatatgattattatgactaattttcataattttaattaactttttctctattttttatatatatatcaggataaatggaaatcaaatgagaatttgtagtgactaattgcgtggatgtccattctgctgctggagtggtatcacttgattttgattggaaatttgtttgaaggcaaatgggaactgcgtttggaatgccagtcgatactccgtactaaatttaaaaatttaattaaaatttaattcgcctcgttaagtataaaattggtccgtttgatgccgcgccaatgttcaaagggattgcggagattacttgatcaaaccaagcagtgatcggagatgaaattgaggatttgatcagattcatataaaatgagttgatgaaatatccaccaatattcacagcgatgatacaaaaaagtgatcgtaaagtgcgacgattgatctgatcagcggaagacagtcctaaaataatttatccttcatgaatattttaaaatttattaccgaacgatttcatttttataacaagtccaacaaataaataaataaataacaattgtcatcattgttaagctaaaccatattgttttttgatgagaagggcccttaatttgaataattttttgtaaaactagcaatagattaggaagaactttgataaaatctgtcacacagccagtgatcatctgatcaccatacaaattcataaattggtataatgtaatgagtaaatcaaaaccgaaaacaaagcaaattaaggttaccgtagtcaaatagagccaaattttaaatttattgtgccttaaacgtaaatttaatgtataaataaagtttcattttttacatttcatcatgatatttttaccgattccaaaccaagaaatgaaagtgatctttacggccaaacaatactcaatgaaattttgtccagaaaaagccgtgtaaacaaaaagaaaatagccaggttgatgaattaattcgaaaagggagcaaagtgccaaaaggtaattaac

SEQ ID NO: 32173 - DNA, 1369 bp, Heterodera glycines
tttattcaatttttgttttaagtcttcatgtggtgtctactcgcgttggaggaattcccgaagttttgccgccggaattcatctctttggtcgacccaaatccgaaaggcatcgtccaattattttatgaaattacagtatcaaatactattgtagattggttcatgtctaccgtagccaaatttaaattaggttgattcccattgaatttaacaataatttggctgttcgatcattatttgactcatttataatcaaatactttatacagcaattgcaattggtcttttggatgccatccgtcggcgtgagaatggcgaattgccgtgcccggtgaagaagcatcgacagatggccgaaatgtacaattggtcggacattgcgcagcggacggaacgcgtttatggcaattcactgaaagagccggagggcagcattgaccacaaattgcgaaagtgaggcaaaaattgaaattttaatgctcgtggagttaaatttcaatgccttttatctttgatcaaaattcgaaaatcggagaaaaaatcctttaaaatttccccgttcattttttcagtcagttgaatgccggtttctggttcgggctgatctgggcatgggtaacagcagtgaacatccttttcgcctcggtgttggattgggtggacccccgggatggcattgagacggttgacaacaaggcgaagacgaacaactgatcgcggttgatcggactgggatttgtgggagggaatgcgcgcataccttttcatcgttttgccaaattcaaacgacggactcacaaaagtgttgggggaactgacggaagccaaactgatcagaatgatcaaaaatcaccactgattagagttgaggtgatcgataaatggcacatttccgttctttttttttttgctcattttttaattcttcaggtctttttgccaaaattcaaaattgagtcgactccaactttggaagagctgttgccatcgcttggttttaaatgtgagttttcgcaaaaattgttattttatgaaattagactcaaaagtcattagcataggtaacttacattggcactctctttccactcattggaacttattgcatcatgttttttcatctgctcaaattttttccggcacttattgtagattttgagtcaacaaaatattcgattagtgattacgtttgataatttaagtcgggacccttttgatttgcaaaattttttttgaaattagttaattaaacacatttttaagaatactgatcattaatatgctaattgctttggtcatttttgtttttttttaaattctttttccaaatctaaagttgttcccccgttaaattaccaacgaaaaac

SEQ ID NO: 32174 - DNA, 1407 bp, Heterodera glycines
aaaaaaaaaaaacccgaatttcgaacagcccctctattaaagcggccccctttgattttttaaagaaggaaaatttccattcctaagaaaatttctcgataatatagttaatttttcaaaacgattcaatttagctcgaagttttatcaagaatttttctaaaatttgccaccgaatgatccaaaatcgagaatccgaaaactatcagcggagatgagtcgtagacataccatccataagccatttttagcaatttttgtctctatttgtacatgctaatcatgttaattgggtgctgtttattaatatgttggacaattgcaattagcagacccaagtcccctgagtttatattagcatggatttcatcgaaaaaatttttcttctaccctttcttatgaggaggtaaaaattataactcaattggatattggtagaatgagaagcagtaaaaaaaatctgaacttaagtcatcgcaaaagggggcaataacattttttaaacaatatttttttttttactatttttcacatttaattacttgtcctacacaatactgacaaatgaatgtaataattggtttagctaattatcattttccaattaattagccaaattaaattcaattttatattctgagaataattttgacatgagcacatatttagtgatgaatttgtttcgttcatttaccatttcgcaggttttcttctgccttcccaatacgtcgattttattttggccaaattggcacacaaatcgggcactttttgggccgaatatttcgaggcgcgtattgcgagcgtttttctgttggaacaaatcaacaaaaaggagagatttttggatcgaattggaccagcgaaaatacgaaacgaattgaagagaaaaatcgttgaggcgaagacgcaattttatggccaactcaaagaacaaatgtcgccaatttggcgcaaaaatttgtgcattttggtcgaacttgaaatattttttacgaaaatatttgaaaagagaaatgaatttacaatggacaaaatcagaaaatgggagccaggaaagcatttagaaataatgaaaaaaaaattagaaaaacggagaaatttattaattaattatttaaatattaatttatatttacttttttagactgcaaaaatgaaaatgattataaaaaagccatggaaaaacagagagaatttgtccgtttgtttcattgcacatttctcatcaaattgttggaaccaaagcccgaaaatgaaagctttcggcgcaaaattacgtcctcccccggggcaaagacaaagctatggagaatgatgagcagtgttgaaaaaatggcagagaaagaaaaagcatcggtcgtagtggaaaaattggggggggggaacatggcgatggggggggggg

SEQ ID NO: 32175 - DNA, 1938 bp, Heterodera glycines
  misc_feature (39)..(39): n is a, c, g, or t
  misc_feature (56)..(56): n is a, c, g, or t
  misc_feature (81)..(81): n is a, c, g, or t
catgcactcgctgagtttgattagttttttctcatgttnttatcttttatttattnttgtaaaggttcgagatttcatatnttatttaaggtttgaagcatttattatttgcaaattttgaattttacaatcgagcccagttaccttttcttccatcataagtttcgtcaccaatactccggataataaatgccaaattcattataaattaatctttatgcctattaatttactttaaattttatttttcctttattcgacaggtttttgtatttttatgactttctttaatatattctttgccgtaaaaaatttaattattaggttgtaatttgtcatttattgtttaactgtatatatttgtttccttttcattttaaattaaatttactaatataaagtttaaaaaataattttttaattaaatttaaattttcttatcaaactcctttattagaattttaaatgacgatttacacttaaatctttaaatttatgtttcacaaattttttaaaataaaagaatttatttacagcaaatttgtatttttaataaaatttttactggaaattcttaaatttaattcttatctattatacttactattatgattatttttgagcataactaagtttggtttttatcaatttctatgcatttataatatttaagttatttcattcattcttgcggcgaccggtatcttaaatttcttaattaggagtggaaccttgagctttaaaaaatatttatcgcagacaataatatatcagtcataaattaattaaagttatattaattcttgattaaagtaaattaaaaaattaattgtctgtgtttattattattatttcttttcaatttttaagcatttaataaaattgctatcgttgttcagaaacttcctcgcactttctttcctctttacttaatcattttttaaaattttattgataatattatatttatatatatttttaaatgtattttaagagtgcttatttttttaaacaataaaaagagcctttttgaataaataaagttgtccatttgtaaaaacttatccatagttctttttcttttggtgattttgtattttattatggtcttaatattctcttatttataatatatcttatcttttttccattcgaaatatttttcatttatttaaagtaaatattttatttataaccattcgctcgaagttgatgttattcgtgtcgttcgttaaaagtatggatctcaacgtcgtgcttgaacatttttgcaaaaaatttaaatccaagacatttagcaatttcattcattataattagaacctaaaagtaaatattaaatccgatatttaaatttttattcgccagatttgagcaatatttatatttatgtaattttgataaatataatcgcataataaaattttcagctgtttgtagctcaatataataataataattttttttgttagaaatccataatttcctcactttgtatttatcttttattttgttcatgttttcctactttaaacttacaatccacttggtagctagatttctttacaatatacaaatatgtttttttattcttttcgattttatatgctgacagttcatgccaatttatcagctggaaaatttattatttaaatatttttttaattagcacattaaattcggtttgctaaatgattttatatattgttcaatttaataattacggatgggaaatttaggtaaatacctaaatttttgcacacttaatacgcatagagaagcacgaaaagagcattttccgcttggtttggggcttctacgatgacttgtataatacctattcttacctatttgggagtttttctacctattatacctattaaggattttcacaaaattccttaacaaaaatgcaataaaaccaaaaaaatacacccc

SEQ ID NO: 32176 - DNA, 1543 bp, Heterodera glycines
  misc_feature (72)..(72): n is a, c, g, or t
cgctgggcgactacgacacgggagcggaactgctggtgcgcatggcgagacgcggcggctgaagggcgagcncaatttgtaggcggcgctgcgcgaggcggccggcgaatttcacttgtccggtgggtattaatggcatttttcccagataggatttgtgccgactcctataaattttttatcccaaaggtgccgacgaagcaccgcgggtagtgattgtgtggaaaagtggcacctccagctcggcaccggacaaacttcggcacacggccgatctgttgcgacaacagtacggcgcgttggttttggtgataaccgccggcggtctcgcgacggcggaggaccgcgcaatgactgtggggcacagcgacccgctcgtgttcgacggatgggccgaagcggacgcggacgcactcggagtgatcgcggacacaatttgcagggtacaaaaaacaatttgttgatcagtggcgaggagacaatttgggcaccagaagattgagttccgcccccttcagccaatgaaaatcaacaacaaaaatgccgtctttcaggtcattcctcaagctcggggtgaacagccggagacggcgatcagttggccaacccgtgccaccagcgcgccaagcagtgcgacaacggtagaaaaaaaatatccagatttaatttggcattttataaaattgcgtttaaattgcgccatctttcaaaagagtgacggagcgtcgcgcgactgcactcgaattgaacacgcgttggacttggtccttgtggtggactcgtccaccttcagcgctgaacagttcgcaaaggttgttgaagggctggccacgttggttgacgagtcgttcgacttggcccctgacgttgttcgagttgggctcatcgtgtacaggtcgagtcgtcgatttgggaaggaaaatttaaacgaaaatcgacatttttcagtgaaatggtcgctgtgccggtggcacttggccattacgaggacaaaattgagctgttgtccaaaatggtgtctgccacacacaaaattaatggtcagtgtgtgctattttgcccgagggaattcgttcacctcattaggccaattaaggcacaatggcaattgccctgcgcgggttggaagcagcgcgtcaacagtttcagttgcacgggcggcaaggtgtgccaagagtggttctgctgctgaccaacggcaaacacaggtgggtggatggacattcgcattggcccacgtggtcttgttaattataattttaatctctcgaattcaaaaccatttcctaattgatagaggcaacgcggcccctgtcgccgccgaacttcgcgaacagctcggcgtccaaattgtcgccgtcgctgtcgccccatcgttggaccagctgaacacgctgacgcgaattgtcgccgacccgaccagcgttgcagcggcgacgacggtgcgcgagcgattgctgcgcttggacagcgttgatcagttggccgacgcggagcgaatcgcactgctgcgacgcgctctgtgcaccgcggccgcaaccgc

SEQ ID NO: 32177 - DNA, 1208 bp, Heterodera glycines
  misc_feature (10)..(10): n is a, c, g, or t
accgagttanaaggattggatttccatctaaggcttaacatttggcccatttctttatcaaacggaggaatagataaaataaaataacagttcttaggtttgggaccatttagttctgcgccgcaaatgtaattttgactgggcgccgcaactgtcggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgcatcacctcggcgacgacgttttggggtgcaccgccctgagagaccaaagcaaagggaaaggtttttggttttccttgacaatgaacatatgtaatattggtcatctgaataaaaaaaatgattgaattgaatggagatttaatttttcaatttacatatttttttaggaaattcatattttaacttttgacttttatgaagttgaccaatagaaaggattattcatttgaaaaataatttaaaaatttcaatttttggttttgatttttttttgaaaaattcccaattactcctcccggtcccgtgcaatactaatccaaaaaaaaaacagcgaaaaaatgaagtcaactttcttccaattaacattctctgttaaaaagggttttctcaattttcttcaacaaaattcttttgtatggcctgaaatcagcactctctcatttttgcgttgtgtaagtctcctgattttttagcgccaaaaatttttttaaaaatcactgcaattaattttttttcagggtcgcttctaggggggggggaagtttgggcaccaaattaaggatttaaaaataaaaatgtttttaattgaatctttaaattgcaaacatccaatttaaagcagataaatttaacaaggctcggtctgttcaagacttttaaattttatgagtttaacataattagacgggtcatttgatatttcgggcccaactaatccgggtattctaagttcaaacaataattagtacacgtttaattc

SEQ ID NO: 32178 - DNA, 1962 bp, Heterodera glycines
tatattaataaaatttaacatatactctcaaatatttttttattcttaaaaataatattatttaatgaattataaattataactcatcaagctatttttataagataaaaagcgataagctaaacagctggatacgctcgaatcgctgcaagagtttaatcgaattttaaaaaaaatccgtgaaaaaatataaacataaattaaaatttaaaaattatatttaaaaatttctttttttctcgcaaaaataaatttaatattttacaactttttatttctataagcatttatttctagattctagtattaaataaatttagttttcaaattgtgaaaattgttagtcagtgctgaagtgaattttgctcaaatttaagaaatttttttcataaacataaacataaagcatctttttaaaaggttaaaataaatattaaatgaaaaatattaatgaattaaaatttgtaaaataaagccttccataaatgattacttaacaattataattaaaatcaaataaattaaacaaaaattttatcagaaaaaaataaaattatcaaagcatggtgataaagagtaaattcacagttttttcacattgaacgaaatgaaatctaaaactttgtcattatgtctaaaaatattagctttaagaaaataattctaaatttcaactgaattaaggcaatataaaacaaatcatctaatatatcaatttaaatgctaataaaatcgagtaacaaagattttaacttttcagctcaatgttagcaggtatattatatatgggaaaaattggagattaaaatttacactagtaatgtttttaaatgccaaagcttcttttgaacaatgtcaagcataaaataattttaaaaaattactcgattaaatatttgtactgccatattaatagccctttatactaaaaataattatgtttatttgatttataatttaaatctctatttaaggaaaattttaaaaaatgtttaaatatattaactattacttagtgcaaaaaaatgccttattaataaaacaagatatattaaaaatatatattatattgaaacgattagaaaaagcaaacgtatataattctatttatccttaaatcataattttatgacaattaaaatgggaattttgagattgaaagttgttaaaaacaagcctaaaagaaaaaaatagagaaaaaaaataattaataataaaaatataacaagaggaaaagtttttagttgtggtggatcagaactttcactagaaaaatgctaacaccacgcattaaccattaggcaagaacactggtgcaaaaacaagacaacaaattttctttatattattatttaaagtttaatcttcaagcttgacacagatgctcatttagcagccctaaaaaattgcacatagaactttagtgtggtcaagccacaaacaatagtttcatttggaaactccaccatcacttgaaaacctacttaaaatttaagcattaaaacatgttattaaaacagaattaagtaaagaccacatttcctgtataagtttaaatataatataaatgaaaaatttaaaaaatacaaaaataaatttctaatagaatttaatacgagagagttttattaatgcatgtatcaatttacaaagaaaacgctcgctgtttcttgagactaaaagaattaatgacctgaaaatatgatgaaaaagtacaattaatatttgttcaaatgaaatttaaaattaacatttatactattttttatgaaaaagaacgaaaaaatttatatcactaaatacaaaaattattaaattgatcgatgtttaatttattcaaaaaaaatatttaaaaaaataaaacataaaacactaagcacgagaaaaagacaaataatattttagaaaattatctcagatacaaatggatttaaatataataaattgaaaaagttaaaaaaa

SEQ ID NO: 32179 - DNA, 1626 bp, Heterodera glycines
aaaaaattgggtgggggaataaatgaaaaaaaaacaatttaaaatgggcattttatttttgagtatttaggaaaaaatgtcgcccgtcgagaaaatccagcagaatttgttgcattcatccaaatatgattaaaaaaattccacaaaaaactaagtttttattgttttttacaaattgggaaagggaaccacatttttctggattggcattccgtccacttttgtccattttcaattttcagtcaattcgcggctgccgccatgttcatcacagtgcgcttcagaatggcacggtccggcacattcagtgccttccagtcggccaactcgcccagcagaacgccgtacgagcccagcaattggcccgtcgaatttgcgcggtcgctgaggcgacgccttcgccgcttcgactcgccggcggcgccgtcgaacttcagcagttggaccaccgcgttgcacaccttttcgcacagcggctgaatttgccgagttcgccgattctgtgggggaaattggggagtgaaaatgaatgaatggacggaatggaaaaagtgccaaaaagggcgaggaggtaataaaaagtgccgaaagggtgaaaaagtgtcaaacggtaaatggcaagggactggtttctagctaaaacatggccatgcacaaatgcagaacaacccaccctcgggagcagttcgattccccgccgtcgtatcaatgaattcgaaaaaatgccaggaataaaaaccaagaaaaataaaaaatacgaccatgaaaaaatttcagtaattttttgtaaattataatttttaatttctctaaagtttagaggaaaggaatagcaaaggtcccaagattttggattttaaaggcttgtagggcatcttttggaaaaaactctcagccaatttttcgaatttttccttaagaatttctgggacggaggtcaaaaaaataaatttaaaaaaattgaggataaaacatttttctcccggtgaagcggcggcacatcgcttccgcacacaaagtttaaactgcggctgtacttgttgcaaaagtcggagcaacgattggagcgcaatggtcgccgtttgaatgagcggcggcgatggcgttccgtcgttgtcccaatcggcttttccacgcgccgtgtcaccgccgtcgtcgtcgtcgtccgtgccgcccaaattgttacgcaatgccccggtgatcaaatcgagtgaggacagcagcagggcacagtggggcgaattcttcagctcacggccccccgccaaagtgtcgaccaattgctgcactttggcactcaacaggggcatatacctgtggaaaccgatggatttggggtcaaaaattggcagagaaatttaacttgcccaaaaagtggtatactttgctgtattacaaggcttaaaaaatttaaaaaaaaaattcaaattttttagtttttcctagaaattcagcaaatttagtttttattagcattagattttcaaaaaagcaaattttttattaatttttttcgacgatgttatgtcccggcggttgtccggcgacgttttcgggtgtacccattttgctacgcaaatcaaaaaaggtatttcggatttgcaattttttaaaatttgccaatca

SEQ ID NO: 32180 - DNA, 1388 bp, Heterodera glycines
  misc_feature (12)..(12): n is a, c, g, or t
tgataaaaattngaaagactcgaaacttttttcatatgagttaaattgcttagcattcgcttagaaaaagattctcttttcaaaacttttcgaatgatatcaatattcgatttagttggtgggaatgaagtgaattatggctgatctaaataaacaatacaaaaaatggcaatgatcagtgtaaattttgaaatagcgcacaaaattacgaaaattggcgttatgtatttattcattttgtctattttaattttctgttcctgacaaatgagccttgagcttttgaaatttttgagtttgggtaattttggcaaacaatgctaacccttctgttggccatttgtctttctttgggcccaattttggcctatttgtccattgcacttttctctcaccgttttttgatcgtcgatcgttctcgcaatcggccaatttgcacttcgcccggctgtgtccgatgtaatcggaatgcaaatgtgagttttttggctctattgcgctttaggcaaatcaatgattgtttttaggccatcttggaatattcgaaaaaaagagaatttaatgtttctcattgtaatttttttaaaggggtttttagtttacctaatttattttctaatttctaatttaactttatttttagtttctaatttaatttaaaagtttttccccaggaactcgcttccgccatggaccgctttcaaaaggctcgtttcgccgcccgcgcgcaattcgcacgcgttcggagtgcgctcgagcgcgcgcgttgcgcgtcggtcgacgacgcgcacgaacttttctttcgcatgaaatttgagggtgtgcaacgacccgtttggacgcgttcgcaactgccgccggcttttgtcgcaaaaatggaattatttgaacgccaacacgcggccattgcgaaggaatgcgaaagggtcggcatttggcaagccatttacaatggaaattaaaaatagacttgaaattggcgcctatcgaaaccaccagacgccctatgtttagggttttcaattattgaacaataaactcaaaaaaataactacaacataaatttatcacccaacttttatataattttttcctcatggcgcctctttgcaatgtcgaaccacatcactagctactccgattttttgaaatttttcggagcgttgttttgtttgacaatagttgttcccaagtttttgttttttttagttcaaacattgataaaattcagattttcacccaaattcaaaatttaaaaaaaatcatttttcttaatccattttccgcatttttcatttttgcccgttaaggcacttgaccaatgccccctatttgtgagccccggaacgagggaaagggcgccccgcactgcacacggacaatggcgc

SEQ ID NO: 32181 - DNA, 1570 bp, Heterodera glycines
  misc_feature (10)..(10): n is a, c, g, or t
  misc_feature (56)..(56): n is a, c, g, or t
  misc_feature (68)..(68): n is a, c, g, or t
  misc_feature (79)..(79): n is a, c, g, or t
atgttattcnttaaactgttttaaaaggagtgataatttcattgtaattatttttnaaaagaataatntctagcaaatntaaagcatatccgtgttaatcatttttgctcttctgcttgggccaatggcacaaaaagacaaaaaactaaaataaattaggaaaaagaaataatgcaattgcacttgagtagttagtgtaccggcgactaactactcacttgctttcgagtctcataataatacacaaaaaattaatatttatatttcaagttcatatttatgagtaaactttaaatattcttttttttcttaaaagtgaaattattaaaatatgtaaataacaaaaatatagcaaatttcatttttaatattaatatttattttaaaacaattataaaactataaaaacagaatatccaataaaaactttaaaaaaaatttaaaatatggactaaaaaactcaaaaatggccaaatatggaccaaaatatggatttattcccgaaaacccccaaaatatggatttcatggactaaaaactttcttcaaatcaaaaaattttaacgtagaaatgctatttttgagccccattattcatagcatatgcgcagaaaaaatatattaatccatatagtttataaccgtacttacaagttatgctaaaataataattttaaaaaaatagtaaaagtattaatgtttattcaacataaatcacagcttgcgctggttaataaaaaggaagggtctaaaatttgtgagaaaattgactcataaaagtaaattaattttttttgtaatataactggtagaaaataaaaaaataacgaaaaaactgaatcaatacaaaataaatttttttttaaaatagtaaataataagctttttaatttatgaaaaatttacaaatattttgttttcaattaaatgactactaatgtttattcaagttgcaataaatattatatggcttattcgctttcaagaaccaatattaaataaaaataaagattaataataaatacatcattgaaattttgttattatttgaaatgcagagtaaatattaagattaaaccattaaattattttttttaaaactttcaaatcaacaattatgcattaccttatgatttcggttccttatgcaagtaaaaaaattccgttattctataacaatatatttaagtgtataagaatcagaaaatgatttttaacaaaaaatttcaaaaattgattacgaagaataatgtaaaattttgtaaatattaaaatgatgtgaagtgcattatgtttaatgtgcttaaaagaataatcacataaaaatggtaaaaaataaaactataaaatgtatccctaataataagaccgaaaaatttattaaaaaagccgctatataaattgaatgaataaattacagatattgaagaaattttaattattaataaataattttaaagaatttaataaagtttatattattctgcattaggcctagcaaaacaaaaactatataaagtaataaaattatatagttctgtgtgcaaaaatcaacgttatgcgggcaaaaa

SEQ ID NO: 32182 - DNA, 1435 bp, Heterodera glycines
ctcaaactctaaatgggtatgaagccagggttgcttgactctgaacccaggcgttgaatgtttgagctccaagtgggccatttttggtaagcagaactcggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcaaagccacagccaagggaacgggcttggcaaatttagcgg

SEQ ID NO: 32183 - DNA, 1391 bp, Heterodera glycines
gttgttcaatttaaaattttgaagaaaattttttttccctctaggtttctagagaaaaaccaaaactgatttattgagagaaaaaaatttcatgattttaaaaattaaaaaatttttgctattgtacattttttccgggccgcgaccgtcggcaccgccggacccttcccgttcgttccccaaattacataaaagcgcgccataaaaaaatgctgtgaacaaaaaagtaaaagtaaaaaaaggtggtcgccgcccgggtgcggtacctcccctccctcaaagctaaaatcttgggaaagattctatgagaaaatcatttcatggcacttagtgtcaactttcaaaatgaaaccacgggaaaccccaccccccccccacaaaaaaaacaatgagaagtcaatgcacacacttggatgacaaagtacgagttctgggactggatgctgtacaggatggccttgaatgttttggtggcaaatgttgccggcgggtcccatttgtgatgcaagtcgaagtggtggaacaccggctccaacacggacctgtgattggaaacaggagaaagaagaaacaatttatgagtttttgcacggcataactctcatggggaacgagtgtttatgtcacactacttaaattagtaaaatatggcaaaatctattttttagaccatttttatattttaaagcaaaccggtgcaaaacagggatgggccaaattgaaaaataaaaagcgaaatgcgaaaattgcgaaactgaaaaatgcggaatgaaaaaaaagcgaaatgcgaaaagccaaaatatgcgaaaatgcgaaaagcgaaattttttctacaactttttaatagttaaaatcataaagcaaaaatcatttttttaaattttattccaaatttaaaaatcaataaaacgcttttttgaggcgcgctttttccaaaaaaactttttgggaagagggggcaggcggcgccggcattgaaaattttattaaaatttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaacgccaaaaaaatgcgaaaggcgaaatgcgaaaagcgaaacctaggcacatccctggt

SEQ ID NO: 32184 - DNA, 1179 bp, Heterodera glycines
cccgtctttttaatttgtgggagggatccggccgcttcgcggcctcaggacgggcgcttcgcgcccgttttttaaattttttgggagacgttcggccgcttcgcggcctcaggacgggcgcttcgcgcccgttttttaattttgtgggggacattcggccgcttcgcggcttcagactggcgcttcgcgcccgtttttaaattttgtggtggatattcggccgcttcgcggcctcaggacgggcgcttcgcgctctttttaaattttgtgggggacattcggccgcttcgcggcctcatacgggcgcttcgcgcccgttttttagcttgttaggccgcttcgcggcctcagtcgggcgcttagcaaatggtagaagaggtacaactgtgattagaagaggtacaacagtgattagaagaggtacaactacgggggaagaggtacaaaagtgattagaagaggtacatcagtgattagaagaggtagaagggtaattagaagaggtacatcagtttaaattttatttttttacaaattcaatgtaaattgaaacatgatattctttaattttttattcaaaatttaaaaattatttttaataaaattttcaccaaaaaataatttaattcaaatgaaaaatttttatttattattaataaaattaaaaatattttaaatgaaaaaaaaatgaaaaacagaaaataaatgtgtagaaaattaatgtacaccgtccggattcgaacctgccccccccccctcaaaatgatgcctcagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaatcatgtgctcccctttttggtcccgaaaccaaaaatcacttttatttttgtatctttttttaaaaatgtgataaaaatgtaaaataaaatttatattatagagaaaaaaattacggatttttgtagtatattacttttcccgaatagcttttcagaaggcagttacgaattttctgaaaaatcgaaaatttccagaaattctggaataacttttttcatattgatgctagaaatttcaaataaatcccataaaattctcctta

SEQ ID NO: 32185 - DNA, 709 bp, Heterodera glycines
ggtcttggacaatttttaatttaaattattctttttggatgggcactcgaaaattaatttaagtattttaattttatcaatttaagaaataaagctctttttcctattcggcttaatttaaattatccaaataaaatcgaattttatccgaaaaacttctcgcatatatttttatcgtgcaaattttattaaaaacccatcatttttttcgaattttcgcgtttccaagtttcattttatcctttcgtatcaaaactccaaatttaatccccctcccccaccctgactttgaaaagtatccgccgacaattgcttcccccccccccccaaaaaccgtccactaattttattttctcccaaaaagccaataaattttcaattttccccaattttcggggtcaatttttgtcgtaaagtggcggctttgggctgggctggggacctccttttaaatttttcgcctggtgccacccgcaaatttccataaatcacccctcgccagcccccctccccccccccaccctaacccccgccggcaatacaaaacgcagcaccgacgcggagaccgctcaacagcagaagagcaaaaatggaggaatttgttggctcggaggacagcaataattcacttggtggcccgatttttggggctgaaatgaaatgaatttaacaattttttaaagtgacggctcacccatttttactgttt

SEQ ID NO: 32186 - DNA, 1535 bp, Heterodera glycines
ttgatttattacgcaacatcgaaaagaagacaaattgtggcaaagaaaagttggaagacactttagacaaaaggaagaggcaaaacaaaaaacaaaaaggacaaaaaacgattctttcgttgacccgatacaccgacgagaaagtgagcccgtgccgcgttcatccgtcgaccgcctctaaagtcgcaattccgcccgtctgttgttgccgtgccattgtcgtcccattggatgtgccgcctttcgatccaatggaatttgccatagctgcgagtgctgccagctgcgactgttgctggtggacggtcgtggccggcggcgttgccggatgggcccctgccggcgactgccccaactgctgctgtgccagcatggcgaagtcaacgcccggcgggaaaaagccgccggttggcaatgcccccaaattggcgaacagtccctgaaaaaagctattgatcaacgaagagcaatgcaagtcaaaacaccgaccaaattgttgattgccatcgccatttgttgtaaatttggggtcactccctgctgatgagtctgtgaactctgcttgccaccattgggctgctgagcatacggatggaagcgatggctggcagaagcgccgccgccggcggattggcaaggcaatggggaggctgaaaaccaagcaactcattaatgctaattgatttgttgccaaggctcttcacccgcaccccttcacaaaactcacaatctttccattgttgtgccgtctgctgctgcaggcacagcggcggtcccatcggaagtattcctgggggcagcccaactgagggccaagcggttccgttgttgttgaacattgccccggggtttgagtgtggttttgcatttggcgtggcgccctttgcgctgttctgcgacactttgtttgtctgatgagtcggtgtggagcgagatgaacttggcgagccagccgggccctttttgccagccgaagtcgtcacagcagtcgatggcactgtcaccgttccagccgactgttccccttgggaagtcgtggaactgaccacgttgggggaactctgcttgccgatgtgtgcgtttttgtagtgagcaaataactgctcctcagttgggaaaatggagccgcacaattggccatccttcagacgataagtacaggccaaacagccttggggaagttggccagaagcacaggccatcagcagggccgggatggacagagcggaggtgggggacactctgaaaaggacgcatcagcagaaaggcaaggacggcaccgactgacccgccatcgcccccatttgacagcgaaggaccgttagggggaagaaaagtgccgctggcaaaggcatcgaacggatgcatttgcattgccaagtttaacgcagaggcatccaactgattggcctttttcaacgacacgcttggaggaagaggcacgccagcggatgaagtgaacagctgaacatccaataaaaaggaaaaattagtcgaccaatttggggtcacctgctgagggaacaattgaggct

SEQ ID NO: 32187 - DNA, 918 bp, Heterodera glycines
gatggttccatccccttaaacactcttatggggatggtcccatccccttaaacactcatatgaggacggatgtcatccccctagacactcttatgaggagggtaccatccccttaaacactcatatgaggacggattccatccgcatagacactcttatggggatggctaccatccccatagacactcttatggggacggtccaatccccttaaacactcatatatcccttccacctaaacactcttatgtcattgttgtacctcgtttaatcactgttgtacctcttctaatcacgttaatcccatccccctagacatttgcattgggatggatcccatccccatacacactcgcatggggattgattttcgaaaataaagtttgcagaatgccaatttttatcattgttttttatcctataaaaacacaaacaacaattttttatcctaacatatcttacatttttgcgcaaactaggcgatgaatttttattccttttatattgttaataatatagtttacaaaactgtttccaatattatttaatttgccaacaaatcataatatcctcatgaaacaataaaatttataagttaaattctgaattatttagttttttattcaaaaagttcttaacacagtattagactttttaagtgtatttacaaacttacaaaagcaattataaaatttatataattttttgcacttttatgtatgtctatattcttcgcttttggtccatattttaggactatattttgtttttttaattattttttaagattttgatattattattttgtaagttcctactggtggctggcggtgtccgattttcaaaggattggactttcggagaacagccaacaattgccctcatcctttaccaaatcgtcatggaatggatttttgg

SEQ ID NO: 32188 - DNA, 1383 bp, Heterodera glycines
aattcgtttacctaacggcgatgccgttgaattcagttacagcaatgccaaattagggaaccctttacttgataattcaaagccggtcttgaaactcatcctaaccttgatttaaattttatttttaagcggcttgaggttggaaatgagccaatttttcctgcagaatgtcgtcaacgcggcataacttatcgttccccattttgggtgaatatcagccttatggtaggcgaatggttatgttttagtgataaaaaatatttgagcgaataggtaaatggccgatgcattgacaatgtcgaagtactgcttgctgaaatcccaattcttttacgttcgaataagtgcaatttgcatgggctgtcaaaggagcaattgatccaaaagggcgaggaaggactcgaaaggtttatttgtttcatttacagccttacaattagtttggttgtgatttttttaaacaaaaattaataatttgctgttgattcaggggtggttactttgtggtcaatgggtcggagaaggttgtccgacttcttgtcgccaacaaacgcaattttccactggcacttcgtcgtcgggcctttcgcgataaaggcaaattgttttcggactgtgcggtgatgatgcgttcgattcgaggcaatcatttggcatcgatgatgacccttcattacgtggaaaattgttccatgatcttggctattcaagtcccgcaatttacaataataaattaaaatttattttttataatttttctaaatgcatttagttccgtcgtgaacttttctacgttccgttgatgtacattttgaagtgtttggtcgattggaacgatgcgatgattgctgctcagctcaccgctggcaggcctgacgacgttttctgggagggatgcgtgaggaatatgctaatgatggcacaggtcagtctctggaagctaaaatttatcagttcttcaattaccaggggcgtatgctagttgctttaaatttttaaggaggaaaacatcgttccgcatggaattgctctccgtgcacttggcaatcgcttcagagttgcgcttggtgatagaattgcgccatgggaagacgacgaacaggcaaagcatctgacaccaattaataaatcatttgctgaagttcccttctaattgtaaggcgtgtcactttttgctccatcagtgtttggccattcatttggagacaaacgaacaaaaatttttctgtctcactttaatggcccacaaactcgtgggacttgtcaagaatgaggtgcaggccgaatccttagacaacccccaatttcaggtactgaaaaggccatacaaacttcctaaacctgaagttcgttaaggaagcgtccgtcacaggacacatttta

SEQ ID NO: 32189 - DNA, 858 bp, Heterodera glycines
acttttgaaaaacttaataacatttttgcaagttggcaagctaatagaaaactcttagggctatcgtaagataccaagattgtgcaatatggttgagtctgagaaaagttatgagtgaatttactcaaaaaattagcaaattttgcactttttgtccttcgaccccacttttgcctttttgtccttcgaccacttttgcactttttgtccttcgaccacttttgcactttttgtcctgcgaccacttttgcactttttgtccttcgaccacttttgcactttttgtcctgcgacctagcaccgtacttggcatccaagtacgaatccgagccctgggcaaaacatattcgacacggttagcattggaacaaggggcataaaaaagcttgttttatttgaaaaaaaaatttgaaagaaattctccgtcagccaacgaaaagttggtggtttttatcctcttcatggataataaggagtagcaaataaacggtcatcattcggagaaggaatatttttttaaattttataaaaacttcaccggggaccgaaccatcggttagttaatcagaaataacagcataaaccactaaaccaaaagttgaattagtcttctgtctgtatgatttattttaaggcctaaaatgctattaaaaaacttcgccagcgtacaattaatttccttaatataagtgtatttttgcgtaattgaacattttcataaaaattcgcagttccgctagcatacccaaatgaattcaccaaagaactgaacaatgaaaaaaattattcagtataactatttcagaagaaaaaattgtaaaggactccagcaaaactagaaaaagatttctttaaaaa

SEQ ID NO: 32190 - DNA, 1389 bp, Heterodera glycines
  misc_feature (40)..(40): n is a, c, g, or t
  misc_feature (92)..(92): n is a, c, g, or t
ttttgagaattttctatgcaacaaacgctctcgaacatgnaacgaagtgcggtgcgccatggccattttatttttcaaataatttttatatntaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctatttttgagaaattttctatgcaacaaacgctctcgaacatgaaacgaagtgcggtgcgccatggccattttatttttcaaataatttttatatttaatagatattccagaaaaatggctatctctatttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctatttttgagaaattttctatgcaacaaacgctctcgaacatgaaacgaagtgcggtgcgccatggccattttatttttcaaaataatttttatatttaatagatattccagaaaaatggctatctctttttttggcaaatgttagggacagaaaattggacatgccaggttggcaaacacattttcaagcagaagttgccggtataaaaggagggcactaaccccccaccaatcagtacaccaacggtttcctgagaggccaatgcctcgtcctcctttccctcccttccctttccccccgtgccgacaactgctccgcctgcccgttcgtgccgccgactgttgtgccgaaccgtgcgccgcccgttcagttccaagccgacccgtgcgccgaccgttctgtgccatgtccattccgtgccgccgccccgcaccaccgatgccgtgccgtgtcgccgacgtgttgtgccggatgccccatctttccccgacttgtgccgtcccccattt

SEQ ID NO: 32191 - DNA, 1456 bp, Heterodera glycines
  misc_feature (1449)..(1450): n is a, c, g, or t
cagtgttcaggcatataccacaaaagatttgattaattaattaattgctgattatcatcgtctgtaactttctctaaatgttagaattctcttgttttgggtttgtgcgaacatgaacaaagttattgtataaaaacccggggattgtcaattgattggactcacataaaagtcagattggactcataaagtgcattagagccagtaatttttattaaaaatcaaaaaaatttgaaaatttagcatttttcaacattttataccaggccgtaacctagaaaaaaatttcttcggaccaaaaattccatttaagataaaattttgaacaaaatatatgcgaaaatcgaggtggatgccgttttcagccccccccccaccctggttacgggcctgttttataccgataaatttcaaaattttttttttgcaattttcgtcccatatttttcgttcttttcaatgccattgtcatttcattaaagcaaacttttcaaaagatcatccatatgtaccacaaaatttgtcaatcatcgtttagatgtaaatcccctattaaaaaaattttaaatgcaaaatttccaaaaatttttttacttatttaaaatgtcaaaaatttgttccgtcatcacctcattcattcgccatcatatattttctgtctcctcttctatgtgaatgcacattttgttcacactaattgcatctctctctctctctctcccaattgcccacaaaatggcgccgttttaatttgctccccgctaattatcaatgtaattaaccgtctttgtcaattaattaattaaccccccccccccaccgcccaccctctccgcctaattacgcccctccatttgcacaatgcaaaagtaaaaatttcgacaaaacggcggcgcatttgtgatgagagcagcagagaccgatcaaactgatcacaatgatgactttttcattcaaattccgttattttaacaaaaattatttaattgcccgggagaggctaaaattcccccccccctccagcctacgtcaaataatgctaataaattttttaagaattttggttagatttttatttttaaaaaaataatcatcaaattcaacaaaatttcgggtatcatttgaaaagctcttaacagcccctaataaattagtatcagtgtcaaaactgaaaaaatttagaaataaaaaatgtgaggggaaattttaaaggaaagtttttttcataaaatttctgacattaaaattttactaaaattttacaaatatttgggccctgtttaatttttttttatatatataatttttttgtgaattaatttagttttacttttatttcgcgtggctgccatttaaatttgaatttgaatttacagtcaggtgcaaaacaggggtaggctgacgtttcgcttttcgcccattattcgccattttttggcgacctgcagnngcatgc

SEQ ID NO: 32192 - DNA, 1516 bp, Heterodera glycines
aaaattccgcaacatttttattgcccttgtgactttaaagtggggcaggcaattaataaattgggaatatttgaaaaaatgatttttaggtttatctttctccactaaattgttatgctatttttttggaatttttcgtaaaaacaatataatttcattaatattaatttatttgtttttcttcataaaatgattttctgaatttcttacgatgaaataatcaatgcaaataattgcacattgattactggaaattgatttcttcttttatttataagcatttccaaagccgcccagcttctcatttttatgaatttttttgtttttctttaatttctttcacatttttatggctctaaattattttttgttcgtcattttaatgattctcataaataacggcaagtttataataatatttaataaatagtcttttgcttttttcttttaaaatgttttgtgctttttcacatattcgactgttgtttaagttctgtaataaaagagaatttttttttgtttgctgatttaaaaaagtttcaattaaattgagtgataatttgcaaatgccattcgaaagagaaagtttaagcatttttagaaagcgtttaaaatccgtttggttttttcattttttctgttttaaggctgcgcgcaagattttgagttgggccttcccttaaaagatttgctaacgtccaaattttcattgcaaaattcaaaaccattgaaagaatgttttatggcagcgattggagacgaaaaagagcgagctcatttcgaaaggcaaattttgaacaacagcgaatttaggggagaattgaaaacgatggaagaaaaagaaaaagccatttcaaagggccagcggaaaatggagccaaatgaaatagcagaattagtggaaaagcatttcaaagtgatgggcgaacacaaaatggagggcgaagaagaagaaaaagcggaaacaaaggtccaatcgagaggggtggccaaatgagaggcaatttggccaaaaagaaacatttaaattatgaaaaataaaaccacaaaagcattttaaaattaacataaaacagctagcgattgccaccaccaccacaatttttaggtaaggcttcttctgctgatgctattcggcattatgccaaagaataagcacatggaaggcaaaaaaatatgggaagagaaaatttggggaaaaaaatggcaaaaacatttaaaagatttaatcaaaaaaagacaagtcaaagtatcaaacaccaagcagttgggcacggacaacttggagaaggtgaagaacacaacggtacacctcagttgggctgtcacgtttgggccggcacggttgggcccagcatgtttttccagtataactttctttaacttttttcgttgtcatccatcctccaacattgttgatatcattcggaagcataacatgtttagaagcttttctaagctattgagtcgcgattagacaattaccaaaaaagttatacataaaaattgcaaaaag

SEQ ID NO: 32193 - DNA, 2023 bp, Heterodera glycines
  misc_feature (953)..(953): n is a, c, g, or t
  misc_feature (1866)..(1866): n is a, c, g, or t
tttgctttttttccatttattcaatcgaccacgttaatcattctctatacatttagtgccttatttcatgaaattatatataatttaattttaaataaagaggctaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgagtgtggtggttgggccgtttttgcgatattgtggctggaaaaaaaaatgcgatttcactgtggggagcgcggccgtctgggttcaagtgcttgcttgcgcttgtgctcggcattgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgaggcataagcgcccgaaggcctttggcctgaggaagtgtcctaaccggaaaatccggagtgctcgtgtgagtgcctgtgcactcgccctcggagctgtgtccagcggcgagatggttcttcccaagtccgggaagctcggatgcctggccagcgctgtgtcattaccacttgctcggtcgccttcgccgcccatcgcgcacgcttgcgctgaacggagttgtttctgctgaaactatccgtctttacaagacggctgtaatancggcgcttggcaacgctcgctagcagctattctggttgatcctgcctgaactgatgtgttcatttcaaagattaagccatgcatggtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggngccattcgtattgctacgtgagaggtgaaattcttggaccgtagcaagacggactacagcgaaagcatttggcaaagaatgtcttcattaatcaagaacgaaagtcagaggttcgaaggcgatcagataccgccctagttctgaccgtaaacgatgc

SEQ ID NO: 32194 - DNA, 1467 bp, Heterodera glycines
tttcggatgcccgcccctgggcaatgcctttgtcgccgtcttccgtttgctcttccgctgcttctccttttgctgtttcctccgcctctcattccgcacttgccaatttcttccgcttccgctgatcagtgccaagcgccgcccctccgcatcggtgtgctccttccggacgcataccggcgccgcgtggagccttggctggcattggcccaacggcacatccgccagttcagcgccgcaccgacgccaaagtgccgtaaatggggcagtgttttgcgtatcaattcgctaatcagtcagcttttcctcggcagttcgtctgcccattttcttcgtgcccattgcctccaaatgatccccaaaaacacggactgtcgcccgtcgttgggactgaaggcgcttttcgatctgatggccgtctctgaaaatgacaaagcattggtgggaatgggaagtgatcagtcggcacaaaaccatcagaattgaaatgaatcggtcaaaaagggactgatcaattgaattaactaattgggaaatggaaatttaatacagcaaaaaatgggtcaaatttattgaaaaaacaatgaatgcctttcctccctttcattaattaggaattgccctccggcgccgatcagtcggttctcgcgctatttggcgacatttgcacgtaggcatttccaacaattacctaatgaggtaattaaccatttattcattcgccgcccagcgatgtgaacgaaccggtggcaatggcatcgaagtgagacgaccaaagggcgaaataagcaattaaataattaggaattggaacgtcgtccatttgtcgttcaccgaatcgcacgcgaagtttggcactgccgacgcaaatgaggcaaattaattataatggaaaattaaataattaataatggaaaattttgatgccacagctttacccgaccttttttcgccttgtgccaggcgaacggagtttgaacagagcgcgatgcgaactgatcaaaggttggaagagggaggaattaagcaaaaaaaaaagaagaaattaattcaaaaattaaatatttttaaatttgcgcagcttttggttggcgtcgtgtgggcagcgtgaagcaaagtgaccatgtcagtgccaatggggcgggggtgatcaaatgccgattttgttcaattttggacatggtttactcctccttgtcgagactcagtctcgacaatggttcccttggcccccactgatttttaagtgctgatttgtgaactgaattcgacctttttgtccccattttccgtgctcagtcgtccctgtctctgtcccacgaacgattgaccaccaaattggagcaggacggagtgcaggtgatttacacggccagcttgagcagtgagcacgacgagggcacaatcggagccgaattggagcaaattgaagggtgacatgggacggcagggaaaaaaggccgaact

SEQ ID NO: 32195 - DNA, 1250 bp, Heterodera glycines
  misc_feature (46)..(46): n is a, c, g, or t
  misc_feature (181)..(181): n is a, c, g, or t
  misc_feature (1198)..(1198): n is a, c, g, or t
taccaaaaacagtggaatcaatttggagatggcagtcccaaacagnaacaaaaaatcgagggagaatccgaagacccttcttttgtgctttggttcaaatattaacaaaaacgcaactctgttggccgcgctgttcttctcgtcgcacatctgctgcaaatagttgcgcagcactctctcncggccgcgtcaaatccgcgtggccaaacggggcgcggacttggcgacggtcgaacacgcggaagacggacctttcaaatgggggagggaagccaaaatgagaagaaattacaggaacagagggcagaaaacatctgttgcactttttttgtacattttcttatcatatgacattaaaatttccaaaaagttttccaggcggcgcctatcgacaccgctggacaccattggagcattatactttgaaaatttgaccccaaaacggtaaaaaatcgttatttttagcgcaaaagccctacaaattcctgctttttcgccgcgataaaaattttgaaaaataatactgtagaaatttttttagcccgaataggcaaaaaaagctcttcgggtgctctccccgaattgtttactggatacgggcctgtggccagagaatgcaaaagagccaaacaaaaaatggggggaccaaccgattgaacaactgcatgaagaacagagcgcactcgtggttacggaaatggacgcgaatcagcacacagtcggtccactggtgctgctgtgggagttgaccaccaccaccaccattgccgccgcccaagtgaaaaacaccgccggcgaacggagcggcggcggccgccgaatgggggacggacgacaaaataacggagggattggagagggactgaaacggcggcggaggggttttggacgaaatgccgtaaatgtatccaaaagattttatgcaaatgaaaaacatcttttgggtatgaattataacttttataaattaggggtcgataaacaaaggaggacccttttgaagataatgagaattaacacatttttaaggttgctaatcataatgtcatttatttgttcatttttttctaaaaacaaaattttttgtttatcaaaagaggccccccccccctttggttttggaacaaaaaacttttaatttctcgaaacttaatctgatgagaacctataaaagtgcctttgtttcctttgggcctanaaaatgttctcgcttaaagtcccatcttggtaccctgcccataagccatgtt

SEQ ID NO: 32196 - DNA, 2179 bp, Heterodera glycines
taagaatgaaatattcgtgggataaaaagcaaaaatttatacaattttgaatttttaaccatctttgacaatttttatgaaataaagtaaattttgctttaatttataaaatatttgtggtttagtggttagtgcttcacaactaacagtattttttgttatgagttcgacaccagggatgggccgaggtttcgcttttcgcatttcgcctttcgcattattcgcattttttggcgtttcgcatttcgcatttcgctttttggcgcgaaaagcgacttttacacccctgagaattggattaaattcccataaaatttttcaaaattttacctataaattggctaattttcagtgaaaaactgtttataaatgatcaaaatttccaatttttttcccggcggcacctatcggcaccgccgcgcccccaaaactcctattttttcttagaaaattgcccaaaatcgcaaaatttggtaatttgatgaaaaactgttctcagcagcgcgccaaaactcttatttctcattagaaaaatgataaaaatcacaaaatttgatcattttttagtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaaattttaaaaaatgatttttgctttatgattttaactattaaaaagttgtagaaaaaatttcgcatttcgcttttcgcatttcgctttttatttttcaatttgtcccatccctgttagatctctattatcgcattaaatgtaaatttgtattgatcaataaaagtaaaattaaagaaaagaatattgaatttaaaaaatgccgttgcccattaatttctttataatttccttaacccaccaattaaagtgtgtttgttttgcccaagaaatgaattgatggcatggcacacgcaccacacgtaataacaatgccaattcgatgaatgtggtctatgggggaggagggcgtggaaatgaattggggaggcggcaccaaagagtgctatttttcgcgcggcacaaaattggccaaatttggccagaatttctcaccaataaaagtgctcccaactgtctctccatgccgataagcaaaggaaaagccgccggtctccaaacggcgacataagctttatacaacaaaaaaataaaacaacggcgacgacgaggacgacatgagagaatgtgccaagtttcgggcattttgtacacaatctcatcaaattaatagattaaatgtcatattctgcattaattgttatgccctaccacacaaattcgttggccaatgtgccacaatttaaaatggcacagtgtaaaatgccaaaacaaaagcccaatttgattcccgaatttatggacgagagggaaagccatcaattgttgtctgaattgatccattaatcattctcctggggaagcttcttctctgtctcaattgcttatcaatgaaaaattctcgataattttgcaatttttaccattttttaattaaaaattttccttttcctttttcaatttctttttttttgtaaaaaaatcaatattttttgaaaatattttcaaggcatgcttcattctccttgtacaaattttttttcataaattaggaaatgcatctgccatttttaggcacaaaaatcgcgaaattggcattaaataggcaaattaattttttttaattaacactttttatgtaaccaaacacataaaaatataatcaataaaacttaatttttacatatattccaattataaatgaagttattaaaattttaaaggttttttcgaataaaaaaaaaatttaaaccaaaaatttttatcaagaaaaaattatattttagggaatcaatctttttctgaaaattttttttgggtcatttattaggggtgtacttttcattttttttaaatttttattaaggatttttccgaaaatccagaaaataggcacaaaaatatgcattataaaagtcatccctagacaatccaaatcaagctgaaattgtgtttttcgtgcttatctgagcgtatcaagttaaaaaaaattcacagggggggctttttcagaatagcttaatctttttaacgtcatatt

SEQ ID NO: 32197 - DNA, 921 bp, Heterodera glycines
accattgaatttgaaccaaattttgcagttgagcttctcgtttgccgtgcgcattcttctcatttgtcagtgtgatgtgggtgaacatagaaaaataaaacaacaaataaattttaaaaaagtggtgtttattttaggaaaattgtattggattggccctgaggtaaaaaaaactttactagaaaaactcgctaatttcgaaaattcaaattcattcaaatgttccaaagtttctctggcagcacattaggcatccccagaccccaaattcataggatttattatttttatttttaattaatcattttggttaaaactctaaaaatttaatttagtttaattaaatgagtaaattaaaagtggcaagttcaaaaaacgagcgaatcaacaaaattatgccaaatcagtaatgagaaaaaattgttgtcaagaaagtaaataaataaattttggagatgaatttttgagaattcatttcttcgggatgtattttttgaattttaggtcgattcttaggggtgtatttttgtttttattgcattttgttaataattttgggaaaaacgccaaaatagttgaaaatattttttttcaaaatttttttaggtttttagatgctaaaaataaaaaacaagaaaatatttgccaataaatcgaaaagtagcttaacaacaaccgaaaaaaaacacgtttttcgtgcatttcagaccatagggagctcaagaaaaaatagctgaaaaactataaattggagccttattaattactatgaaaattatggctaaataaataaatcattttaacaatgagtaatttttttgcccttaattcgcgcattttttgtagttatgaagaatttttcacaatgtaccatggcatcggaaggtggcaattgacacccttttgcgtgctataaaattt

SEQ ID NO: 32198 - DNA, 1109 bp, Heterodera glycines
aagcattgtacagcataattaaaaccgaaaataattttcgtatattttccccaatttatttcaaaaagccaaaaaaaaatgattaaatttgaaaacgaaatagtgcacaaaagggagggatggttagacgaaaagaggaatttttagaaaagagcgcaccccatctgatattcccatttttccgttccacaactggccaaaggcgactgtgctaattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaatgattcaattttgaaacgaaatagtgcacaaaaggggagccgccgcacggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtgctacaaaattttggaactgtcccgcctcacggcggggcttaaaagcattttactgcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaaatttggaactgtcccgcctcacggcggggcttaaaagcattgtactgcataattaacagctatgataattttcgtatattttt

SEQ ID NO: 32199 - DNA, 899 bp, Heterodera glycines
gaattgtatcgatgcgagcgttgattttgtctatgtttgtcatggcattgtgttgaacttttgttattttcgcaccgtaaattgatttttttaaaattttaattttcgactttttgttcgaattcgggtccggagttcgaaattggtcgcaatggatgtcagattcgtgatcagcgaccccgaaaaccccctagaaatgtgttaaaaaaaaattttttttatggtctgtaaaccacataaataccaatttttctattgaaatgcaaaagttgaagcggacgacttctttaatccagatatctggcagcccttttcatttatttttttattcagacataggtataaactaaaatgagtaatcgagtttacattggccatcttgcttcgcgcgccaccgaccgagatgttgaacattttttccgtgggttcggtcgaattcgcgacgtagttcttaaaaatggctttggatttgtggtctgtttgttattgcttttattttttacagtctgttttaggagtttgaagattcgcgcgatgctgatgatgctgtttacgagctcaatggacgtgaactgctcggggagcgtgtagtagtcgaactttctcgtcgtggtggtaacaaatagtgattttataattaattatttttcgtttaggaccctatggcgggggtggcggatacagcggaggaggtggcggtggtggtgggtatagcggcggtgggggaggatttggcggatatcgcggcggtggggcgtaagttttcagtttttattaaatttaaatatatatatacataacgtatctttcatgaattactatttggtgaatcctttcctctgaaacttattattctcatccgatttgttcgtttcataaacttcaagtgtaaaaatgaa

SEQ ID NO: 32200 - DNA, 959 bp, Heterodera glycines
tttcgttttcgtttcgtcgtacattttcggcactttttgagtttcgttttcgtctaccaaagttttttcgtttcgttttcggttttcagaatttttttttcgttttcggttctaaatgtcatcgcggcaaaaaaaattaatttttttattgcatttttattaaataatttctgaattttacatgaaatatttgaaaaatatgcactaaaatatgccttaaaaactgccaaaaaatggcttttaactttcaaataaatgccaaatttactttgaaaacaccaaaacaaagaactaaggagcattttttagataattgcaaaaattttgaatttccaagttttaaatttttgttatatgctaaaacaaaattatattttttatataaataaatttttttccaaaattttcttacaaaaaattaaaaaaattttttggtatcattcgaaagtacaaagtctaaataatgtaataatacgagaaaacaagaaaattctaacatttcaagaaagttacatacgaaaataataagtaattacttaattaatcaatcttttatttttcaattttctagccagcgaaacttaggtaagctaatttttgggaattcataacttagattggatatgttagtggtattaagcttaaaataaaaaaaaatcatgagatttttatgtatttaatttggtttttgaaaaaatttttggaaactcaggaaattttcgaatttcataaaaaactgagaactcggttctgaatgagagttcacccaaattaaaatagtaggaaaatccgcaatttttgctttataaaatttttcgaaaaattaaaaattctagttgtcccccggggggataaatggagacggtgggattatttttcaacctcctcagaaaggggggcataattggggacagcgggattaatggagacagggccataattagagaatatacggtatg

SEQ ID NO: 32201 - DNA, 1627 bp, Heterodera glycines
  misc_feature (69)..(69): n is a, c, g, or t
aaatgttattgtacaatattgggtcggggtgggttaagtgtgccacaacgaattgacaaatatgagggnatgagggtaaagagtaaaaagagaaattgcattttcattacttaatctccccatttctgtgttattttttcgggttgactgatcttcattttgaattattttgcaaataaatccctattttttcttcttctttttgttttttttcatctttgattgaaatttacatcaaaatccgcacaaaaaattgtttataaaaattcaataattattaaaagcagtgggctcccagtaaggctttagcctaatttttaatgttttttgaggagcaaatgagtcagtctaaattttcaaaatgggggggggctttgaggctttttgtcgttttttgttttttttgaggaaaagccttacaaaatttggttaacaaattccataaaattcttaaattttcgcgcagcctccaaaacttctattttgtttttgtttgtttttaagtgattcgaaaatcgccaaatttgtctattttggacaaactttcttattaaaatccgcttaattttctaaaacaaaaaaaattttcggcgtggtggggtttttcggcacccgttacatcaatattttctatgtttgaaatttaaaaaaaaatttcaggacggggcgggaaaattttagtacatccttttgaaaaattttatctgggacccctttgattaaaaaaatattgcaaaaaaaaaacattttaaatagaataattttatttttaattgcatatttttcctctattccatcaataaagcttcctaatgttgtcgtcgtcgttctcgtccagtaccgaaattattgaaaaatctttcaatgattttgaacaaaaaatgattgaaattttgggttcgctttctgatcagcatcaaaatgaagtgtctgctcttcaagcagagatttcagcactgaaacgaaaatatgaggaggcaaatgggaccaattcttccgacataatcccaccaaaaattgtacgtaaaaacgggggggggggttggggggggagtcacgttgggaaagtttaccgcatttttttacggcatttttttgagccaaaaatttaaaatttttctttgttttttttttcattcctctaatctaaaactgtgagcatttttggtcaaaaaataaaattttctgcgccagatttattcttattactagggcgtgtaattatatgcaccaaaatttgcaaaatacgcacataaaaagtgaaaaatatgcacataaatttttccaaattgagggcaaatttttaaatttcttcaagtttgttaaatttaagcataaaaatcccgaaaatagctaaaaatagtatgaatgattattttagaaccaaaaaagtaatatttatttattttgaagaaaattgagcaaaaaatggagaattttctattttctgactatttttggcataaagttccaattttttaaaaagttaactttttttttatcagaaaatatacccaaaaatctgatatttttgaaaatttttcggtcattagagcccaaatggccgctttaatagagggggccgttttaatagaggatttattgaaaaaatgccgaaatatgcaca

SEQ ID NO: 32202 - DNA, 1604 bp, Heterodera glycines
  misc_feature (1528)..(1528): n is a, c, g, or t
gggcaatttatttatttatttttgaaaaataattgaaaatatttttgtatttttgtatttttttttttaacaaattgcccttacataaaactgcttgaacaccctatccccagactctcttccgccgtctcttccttcttcgttttctgtccgtcgtaggggtacagcaaatctgccaattctgacaggcggtcggcggcctccaacagcagttttcgaattttgtagatcgtctcttcaggcttttccagggccaatgctcgcttcaagtaggagttgttttttcggattgggctcctctccaactgtctttggcctgggactggtgttggccttcttcccctcggggcttcctccatggcactttctcttcgtttgagccccagcccttctgggggtatgcatggtttctcattcaccgtctgcgtcgccgacttcagtgtgttttcgaacagccgttttccgctcgttccgaggctcatcctttcccggttacttctttcttctctttctctcggtttgggtgccgagtccaattcgctttggcattcaaagcgtgccacgctgctggaatagaaaggcattcgatcctttggcggcgccggggggttttcgaatgcctcgcgctccctttccaattccgctgtgtccttttcgtcccttttgccattttgttccccacttaattttgccgtcaatttttcgatttttttccttatttctctcttctttgcatcttcttctgcctgcttcacaatttcccttatttctctgtgtgcttcctcaactttttccatgctctgttttttctccttttcctcttcggttaggcgtctttttttgattcccctggcgattattgtttcttctgctttttcttccgctcttttttccacattttgttgttgcttctctgacttctttttttcttcttcgtccttttttgccttctcttctgcttccttctgtgctttttcgtccgcttccttcgccgccttctctttcgcttccttccgcacctcttcttccaactccttccttgctttttcgtccgcttccttcctcgccttctcttctgtttcctttcgcgcctcttcttccaattccttccttactgcctcttccgcttctttcctcgcctcattttccgcttctttcctcgccttttcttccggtttggctgccggtcgtcggagtgcccgtttccattcttctttttctgctttggctttttctttggccttctcttccgcttcctttcgcttggcctcggacttcgcttccatttgctctttttcctttctcttccgctcgcgtttgatcttctccgaatatgctcttcgctcctttatttgttcttcttcttcctcttcttcctggattttggccttcgcatcgatcatcaattgaatttggcgatcgatttccgccaatcggtactccttcttgtacatttcaacttggtccgggtgaatcacttggacttgatccactgacaatggcgtgaggatcggtgcataggggcggngttggaatttgtcgtcatgtttttgtttttgttgttgttgttgctgttcagattctccttcggagtccgagtcgga

SEQ ID NO: 32203 - DNA, 1462 bp, Heterodera glycines
cattccttccgaatattcgcattctcaaatgggaaaaacgacgactccgtgtgctcatttacaccaatgccctccttacgcgccatcggtcggcactcctttggctgtgccgtgttcttcaggttggttgcccacttctttttttgtttgctttgcttttgaatggttcccctgggcctccttttcacaatttgatccttgttacaaaaaaggcgttttttgaaatccgttttcggtataatgactatcctctgtctgtctgtatggttttttggggcagtttaaattttccaaagattggaattggattggcctctcctccattcgtttttcctttcccacccccccccattcgttttccttgcccccgtcccattcattgccttcctttgtccccagcgtttctcttcgcttcgtcccctcctgcccatcctcccacttcgtctttaataaacggccctttcccttccgttcgacaaatgtacgactctgtccccccgtcccatcaacaacaaatgctcttccatcagcaacacttccatccgctcgccgttttgccctctccccaatgtcgccacagtttcgcgcgtcctcccccttcctccgtctctcatccattttcggtgtgtcggggcggtccctttgcgggcattgcgtcgccccactcggagtcccttttccttccgccctcttacgctttccaacagtgccaacagcagcaaatccctcagcgctttttgcggggccatcagcagcaacggcacaaccgcgtggtcacttacgacaatgatgagatggacctcgaaatttgtggtagcgttgaactcgctttattcccttttgctcatttggtggtggtcatttagcgatcgaacctccgccggtgttggaggcggagggtaacatttctgcgtctgatgaggggccaatgcgatttgaggggggcggagggaccacgcggtcggactctgacgcgtcggacatggacttgcgcgagattttgccgcagcagcaatgaccgatgccgtgccaaattgcatccacgccagacaaaggcttatcgagatttttccgcagcgcaatgaatgaatgccgtgccgaattgcactcttttcacacgctttcgtttgcctttgactcaatggctcactttttcattgtcatttcgttctttgttttcttctttacaccttttcttgtttttaacatttttattgataggtttaagcgggaattcttcataaatgcgggtattattttcattaatttccaaatgttattgtaatttctgattctgtaattctaactcgtattgaagaatatttattctgtgaataaaattaaaaatggaatgaagcgaatgaatgccgcaattggtccgcccgattggttattgcctttctgtccgctcaatctgctgaggatgctgtgttttcagtacggagccatccgaagaggacag

SEQ ID NO: 32204 - DNA, 1180 bp, Heterodera glycines
  misc_feature (72)..(72): n is a, c, g, or t
tcagcattgagaaaaaggctggaatttacttgtgacccaattcgcggggcattttgagttagaacaacgtcncaacaattcttctgattacagaagcaatgtcccttttattttggaatagggtaaaaccttccaggagttttatgcgcacatgtcaataataggaattgcactttagttaaaattttaagataccccaaactctcaaaaatctttcttttaaaccacctgaacatatctacctgagacaaatgataatatcggaagttgtcttaacaaatgtagactatgcttttgtcaaatttttctagtggatatcaccgttcatttatgctttattttgataatgctaaaccatattccctgactttatttatccttttcattgagattaactcttcgcttcctcagcattgagaaaaaggcttgaatttatttgtgacccaattcgcggggcattttgagttagaacaacgtcccaacaattcttctgattacagaagcaatgtcccttttattttggaatagggtaaaaccttccaggagttttatgcgcacatatcaataataggaattgcactttagttaaaattttaagataccccaaactctcaaaaatctttcttttaaaccacctgaacatatctacctgagacaaacgataatatcggaagttgtcttaacaaatgtagactatgcttttgtcaaatttttctagtggatatcaccgttcatttatgctttattttgataatgctaaaccatattccctgactttatttatccttttcattgagattaactcttcgcttccacagcattgagaaaaaggcttgaatttatttgtgacccaattcggggggcattttgagttagaacaacgtcccaacaattcttctgattacaaaagcaatgtcccttttattttggaatagggtaaaaccttccaggagttttatgcgcacatatcaataataggaattgcactttagttaaaattttaagataccccaaactctcaaaaatctttcttttaaaccacctgaacatatctacctgagacaaacgataatatcggaagttgtcttaacaatgtagactatgcttttgtcaaatttttctagtggatatcaccgttcatttatgctttattttgataatgctaaaccatattccctga

SEQ ID NO: 32205 - DNA, 1635 bp, Heterodera glycines
ggctggcaggtcatggccacgcggcgccgaaaaagtcaagaaaaagttaatttttgaggtttttcggccataacttttttgtaaaccgacgaaattttttgaaattttacaggctaatagagaatctgaagagctatcgaatgataacaaaaatttttagtttggttgatcaggaaaaaagttgttagcaacggcgccgaaaaggccggcgccgaagtgggcggttccccaaacgaatcattaatatttgtaagtttgagtgcaccggagcgggccaacgccttcttattgttagccaatttgagcatcctaattagggtgttgatttattttatgacaaagcatttttatgcgggttttttaattgcatttcattttttagaaaaattttttagaattttgtaccaaactcattgtcagcattttttggtttcaaagtttgaaatgtgttatatattaaattttatatgcaatcgcttattgttaacatctaaacatgtaaagccgtaaaatggagccaaatttgttggattttatcaggaaataaaaaatactgacaccaaacacttggctgggacggaatgagacaaaaaaaatttttttttcaatggagagaaaaacatgcattttttaacacaccaagcaaatggttcactcggataatggcccaaatttgctattaattgttattaaaattttaaaatgggttttcataatcacacagaatcgaatcaatggtgaccagtgggcaattacatcccggtggacttgacgagtctcaacgtgaccattgtgtccaaatttcaggttagaaaaagtgcgctttttttgcaaaacatatatttatgttttttctcgcaaaaaaatcagtatattatttttttggaaaacgcgccgaaaaagtggattgaaaagaaaaaaaatatccagaccccatttttttacaaaaatttatgatgtccaggttcagattaatgaaaaattgaaaattccgaatcatggattggttcatttttctgctgttccctttttattttcaaattccaacttctattttcttttattattttcaaaattcctgcgattttttttcaatttttaattccccgaaaactaaacatagaaatttttgagaaataaagaaattctgtgagggacatcggcaagatgttcctctaattgttttgctcatttgcttaaatacattaattgatttgctctctcccttttcccccctaaagccgtggtccacagaaattgttggccatggtaagaatgtgacgctttccgacatggtgccgctggtgttgtaccgcacaacgcgcgaggtgtccttccacaacaatgtgacactgaaggacgtggtcgcgtaagtcggcatgggcaaattgggctaacccgaagcaaaaacattaattagcgagcaaatttgagcgattttgaaattgaactagttgattttttgtgccgttgaaaaaataggcggaaatgtttgcgcagcgggtgggcgtcgaactcgcgccttcttttgaaaacaaaagtgtttgtgccatgcccgctcacttcattccccgaaaggcattgccgcatgtgtttccccctcaacaatataatacttagaaattcttgaataat

SEQ ID NO: 32206 - DNA, 1372 bp, Heterodera glycines
  misc_feature (18)..(19): n is a, c, g, or t
  misc_feature (44)..(44): n is a, c, g, or t
  misc_feature (51)..(51): n is a, c, g, or t
  misc_feature (122)..(123): n is a, c, g, or t
  misc_feature (133)..(133): n is a, c, g, or t
tttggtggggtgctgganncagtggaatcatgcgcacccgtcgnatctgcnaagttaagcaacgattgctgactagccaaaaggttcggtgccgtgatgaaacgaaccagccactgcttacnncgcggcaccnggcacggtcccccgaaggaatggatttaattaaattctctccttcggggattttttattaaggaagagagttcattatttatttgtcttttgcataattaattcataagtatttttacagaaactgctctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcaaattttttttacagcttaactaggccctattaagcttatttccagaaaatctcgcatgaattctcatttttaaattttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttacaaaacttcatcgaacctggttctttctattctctttcaaatcgccccaaattttttttacagcttaacttggccctattaagcttatttccaaaaaaatctcgcatgaaatctccatttttaaattttttatagatttttaaatggtt

SEQ ID NO: 32207 - DNA, 1042 bp, Heterodera glycines
tgcgtcggcgagttgaactgttcccggtgtagcgctagtgcgctagttagccccaggttcggatcctcaacattcaaactattttatttatttttgtattttataccaagtcaattctcaaaaactattttataaaagaaaactttatttttaattttttaaaaattatttaatgcataaaatactcaagaaaaatattaacaaaaatatatatttttttaaatcaacaagatatttattgtatctttatgttaaatggaattttttgatttttatggaataaaattaaaataaagattttgataattgggacccaaaaaaaattttgactaacgcactacttctacacaattagaaaattgtaaacaattgaaacaattattcttttctttaattataaaaaagtaaaaactttggcaagtcataactcggcactcgtgctcatttggcagaaaataaaaccatttttcttaagaacccatgggtgctctatccatccaaccaagtttcattcggaaatcccacggacaattggccacctccctttgtcagtccatttttactgtaacagaatgccagattcaaaacattgccaaaaatggctaatttaaaattgatttaaacaaaaaaaatattattttttattcatacaaaaggcaactaaaactaaaaaaaatgttctcattaatttttggcttttctcttttaatttttcgagtattggttataacgaatttagaagcaacaatttatcctccaaattttcttctacaaattgtttcttccatcgtagaatgctacagtttgttttattattaattctgtattagctttttctttttattttcattaagcaataatttatgcattgttgtactcaattagtttcaacgtaataatgtttgagttgttatttgagataatgaaattaaactgatagaattgaataatatacacatttattttgggtggcaatatgtaaaaacaaaaatttttaataaattattttttgaattattattctttttttttaactttataa

SEQ ID NO: 32208 - DNA, 1082 bp, Heterodera glycines
tttcgtttttttagccaatgtaagcccaaaatgcgcccccacccggcttcgtcctcccaatgcctggctctgtgcctccttttccgatttgtctccctaacagtctctccccgtcctctctctcctccgatttatctgtccaatgtctcttcaaagttcgttctttctttctttcgttcgttttgtccgccctccccgcattcgttcttcttcaggcaaaatgtcaagactaggcgctgtttatgtattgctgtgaaagaaatttcggaagcggagaagcacaccgaaactttgaatttatgggccgaattgagcaggcgaaaagcgactgcgatttgtcagttgcggtacggggggaggggcacgggccgacccatcccgggggccgtaacaaataaataattttaaaatgaaaaacactcatgtcaacatttgaaaattgtgatccttaaaaatatttaacgtttaaattaatgaaaatattaagtgtaaattggtagccaagatttttctattttaacccgggcccgtccaccaaatccaggcccggtgcacaagcccattattcatccttgccatcgggtaatcatctaattgatttgcgttgcttttcagtcccgtccatcgcctggcgccgcccccctttctccggcgatggaccctccgccgccaaacttttttcctcaattcgtcctcctctttctcttttcctcctctcctcgcttcttcttcctgctgtccactctttttccatgtttccccttccgtcatttcctcttcctcccccatttcgtcgcgtcctttcattggcacgagtcgtctcagcaaatgggataatattggcagaaaaatcgactttgttggcggcgttctgctgctgtttgtgttgaatcttctgttgctcagcttcaccctctgatcactcaatgccttttcagtctttcattgttttatgctttattttttaatttgccaaaattagggcctagcgaaaaattagtgacggaaattggggggaggttggggggggggggagtcgtgtctttttggcgccactctgacttatggactcactttttcct

SEQ ID NO: 32209 - DNA, 1551 bp, Heterodera glycines
  misc_feature (1462)..(1462): n is a, c, g, or t
  misc_feature (1496)..(1496): n is a, c, g, or t
  misc_feature (1498)..(1498): n is a, c, g, or t
  misc_feature (1504)..(1504): n is a, c, g, or t
aaaaaataaatgtaaaaaatataaaaccctacgggtattaaatggaggatcatcaagcggatacattaaataaaaatcatatttggtcgaattttaattttgtaaagtaaagaattaatgacgttaaaaaatataaaagcctacgggtattattggagttgacatttcaaaaaataatataattgtatatttggtatgaaaattagataatattaccaacaataaacattttatttgctatagtttaatgtgatccttttttgttccaaaaatagcatattcataaacaagcaaatcagacatattattgttgttagcgaaataattatgaaagcaaaaaaatcattagcgacatttggttttatgccattgcaaaatactaaaaattcgagaataatttaagtcacaatttcccagttggcactctttacttgctttcgccaattaactcaatcggacattcgcaaatgttcaaaaacgtacgtttcgccaaaaaccataaatcagatatttcaccatcaactaacttaaaaataattgaaaaaattagaaaataaaatttttttttaatttttccgaaatggcccaaaattaggcgtttcaaatagaaccgtctggcattttcaagattataaccttaaaaatccgaattagggtcattaaaagttattcaccaatttataaatattaggcaaaattcgttgcccaatcgtccgattgaagcttaattgaagaaatgccagttgtaagagtccaattagcaaaatgtcatattttatttagttggcgacaaattcattttgagttggttggctcgttgttgtaccatttattatgttcctctcgctgagaaagtgcaattatacgaatttgtgacaattcgatacaaagtttagaagcacaaggcattgattatttaatattttggctctattgcattaaacgcatccaatcactttttacgcgtccaatcaaaagcgcacgctccaaaccccaaaccatatatttttttagtagcaatcaaaagcttagtctcgagaaattgtataaacgagccaatactgatatcagaaaataattataatgaaaaatcaagatttcatcttttttggagtatatcaacaacactattgcatacaattagcttgatcattcattgtacgcctaaaatgtgattggacgcgtagtttaaactgaaataaagccaaattttttgatgcgaattctctcaacgggaggaatcgaatgatggtcacaattcattatacaaatttcaaattgtatgttatggtatttcaagaaaatatagttacagaccaagcagaatcccccaaattcctttttcacgcccccccccccctcccccgccacacccttgcccaccgactaccaacattgacaagatccatttcaatcggcgggaattgtgtaaaactgatgcggcaacgaacaaaattgagcncttctccaaaagcaactcacggaacaatttgatncncttaancacttagaagaaaagaagattaaaaaacaataagaacgaaataaaag

SEQ ID NO: 32210 - DNA, 1060 bp, Heterodera glycines
atctcctgcaggaatgtcgtcagtgcgcgttcgtcctcgttgagcttcgccgagatgttgagagcataactaaatgggggaggggatgattatttagacacacaatctcaaacaaaaaacccaccgcaaaatcacgaagtatatgtagaggtattggtccggcgtctgcacactttgggcccgatgctgacggaggttgcgcgccaacgagaggatgttgagtcgatgtccacgctgcagagtatcgtaggcaatgtgcagcgccaccagtgttccagtccgtccgattcctaaaaatgggaaatttattgaatttttactttccaacatgacacaaactcacccgctgaacagtggaccaccgagcgccgaagctgttgcacttggaaaagcaaacgaagaggcgccaagtcgctctggggtacaccgcggtcgggccaccggcgccagtggaagtggtggacgtacatggagccgttgcgcgagagcaccgacagctttgtcctgtagaggtccggctccagcgcagtctcttcgatgaagtgcacggtgatcgtcttgttggcgaagtgcaattgctgaaaggggaaaagaggggggagggaaatgattataaaattgagcaaaaaaaaaacccccacctttttgtccggtgtcggccagtactggtggcacttggtcttgttttgttcgacggtgtcgcagagcatcacaatgccttcgatgttctcctgcacgatcattgtccagaagtcagcgcaggtcgtctcgagcgggccttgtgtgcagatgaagcgctgttcgccaagggccgtgatccagttggcgtggatgtatcgtccgttgtcgagtcgcacgcggccctgctcggcgcagatgacgtcccggtagcggttgcagtccatgtggctgtaaagaaattaactattttatttatgtttgagaatcgaaacagccaaactgaccgtgtgaattccggcgaagtcgccggccgtggcatgccgttcagctccgtgaattcgttgaccagctcctgcacgttgcgtcgcgtgtctcgttg

SEQ ID NO: 32211 - DNA, 1093 bp, Heterodera glycines
tccttttcctcatcatcttcctcctcttctccgtcttcccgttgctgttcaccaccttcaaaagagtgggaaaaaagaaatgggttaaaactttcatcaaaacaattttcgttagttgaaatcgaaaataattttgaaaaaatggctacaaaatttttgaatttaattagaaattccagttaaacgaattgggcgtccgatgatgctaataaaaaagaggccgagagctaaaaatggctaaaataattgcataatgattaatgctttgccaaatttccttttaaagtttaattttcaggcaccatcggtcgccctgttctccacgggagccaatcatttaacgcagaaattttcccagaaagttttgaaacaaatcaatagaaaaatgaatcctacgcaaaaaaaaaaattgccggaattctgcaggcatttcggcaactgaaattgccagaatacggaattccggcacaaaaagttgccgaaatgcggtcccaatcggccatttttttaaatgtcaaaatattttaccgctagtttccagtgttgttgttgttgatcccattgtccgtggtggttgcggtggtggtggcagttccactatttgctgttcttcaattgttgctgctgatacggcttcaacttctccactttccaacaattggtggtgccgtcgcttgcggcgtgtcgtcacagccgcttcgtccccctccggcaccgcttcagcaagctccaccgccacctccgtcgtcgttcgaatccgttgctcaacatcaccgaccatgggcccacgatccttgcgccgttgttgttggtcggcattggcactggcaccattaccttttggacggtctttgtccttgcgctgatggtgatcatcactgctaccgctgctgacagtttctgttttttgggtctttcttttttttaatttttgaaatgaagacttagtactgttcgataacattaaatgttctagaaactaaatgtataagtaattaactacatttccacaccaccaacccaaaatcttttttcaaatttacaattaaatattttttagaaaatgaaaaattttttataattttcaagaaaa

SEQ ID NO: 32212 - DNA, 1054 bp, Heterodera glycines
  misc_feature (37)..(37): n is a, c, g, or t
  misc_feature (61)..(61): n is a, c, g, or t
aaagagatagacgtttttcaaattttcagagccaacntcgcccagaaagacatccagaaanattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatgtgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatc

SEQ ID NO: 32213 - DNA, 1459 bp, Heterodera glycines
taaacaaatgggggtaattatttaatctgcctttataagataaaggggaatttaagcgaaggattcaggcaaaaataataatctatagaaattctctaaaaagtagttcctcgcagattcgtggaccgtttctataaagctagagacatatgcgctaaccataaaaaagatgaatcatgtttagaaaaattgatatagttcgactaaatttccaaatcgctttatggtgtacaggatgttagtagaatcataacttgtcagcccttttagatagtcctgccattgctattcctgcaaatattgagtctagtcagctcattggaattgaagaaatattgggtggggatcgtctgccgctaacaccataagatattttttgggcatagaattttaaaaaatgaaaaaaaaccagatgcaaactcatagtcatgaaataaaatcatagacttaatgatgtcatatgataaatctgatgtcatatccgtgatcagcgccctcgattgccatttgttatcattttaatatttcgtgcatttgaattggttttgttgcgtaaatgttgaactttgttgaaaattgaattttcgattttttgtcggaatccgggttcggggttcgaatagggtcgaaatggatgtcagaatcggattcaccgacccagaaaaccccagaaacgcctttttcgcgccaaaaaaaaatgaatttttttttcaaaaaggtgcgataccatctaaactattacccctaattctgtttataaaggccgcttttcccttttagcctcctcggcgatggtgccaagccccgtggtggtgcccgatgttgaggcggaggcattcaggacgatgttggtctttatttacacggacgatttgagtgggattgacggagacaatttgttcgacgtgctttacgcgtgtaaaattttaaaatttgcctattttccccgttcattttaacccccaattttagctaaaaagtacaacattgtcggcctggtcagtgcctgcttggacttccccatcccttcgctgcccaacgttttcttcgcctttgcacaggcgcgttttctcgaagaaaaggttggcgtttatttgttgatttcgcatcaaaattggtggccaacatagccagggattggacaataaataacatagctatttatgatcagcgaccctaaaaaatttgtataggattaatttcagaaaaatggaaatccccaacccccccccccccccccaaaaaatcccggggttcgttccaggatattagatattttaaaactccatttttgatgtgtcaattagagggttcttttaataaatactaattttattttttgacccttcgaattcaataacttttgatgggtaagaaagcaactcaaggcatttttggacaaaatatattttattgtgagtaaattttacagaaattccaagtcttttccatactccat

SEQ ID NO: 32214 - DNA, 1093 bp, Heterodera glycines
gtatacaattacacatgcatgatccctgtaatttcgacccatgcaaatgattttctgcgtaaattcgtgtgaatttattcagctttaccattgcagacataacgaaaagaaattatattacctacctaacatataagtgtgggtctagctaggcgtttggagcaaaaaattgaaaaaaaagaaaactttttaaataagatttttttaataaagtttggcattatatatttttttaaaggaaaaagaaatggattgtttggtgtttgagcttgaggctataagctataggcaaagaaatagacaaataatggtgtaacgtaccaagtgcttatcttcttatacttaatttctacatagtcggcaaatgtgggactgggacaacgcgacagtgccacaacgcagtcgcgtcccaccctgataggcgtagtatatacaggctttcttcattaattagttatgccttcgcattttagtgctcgtaatgacgtaatgactattttttagcattaaacaacgagagtgatgtttagattccgcgagtttaaatagagacaggcaaaacgaaaatatagatatagatatagagtttcaaaataatgatgtcttataattagtgcaaaagaaacatcatgtgtaaacattagtgatcggaatttgaaatgaatggaccgatcctgcaaaatcccggcatgactccggtccctccgaattctaatcatttatacccacaatacatttgctataatataatgaccttttggctcaagtccagtttatgcgtccaatcgacttttgtgcgtcccatcaatttttaagcatccgatcaaactttatgcgtccaatcaattattatcagctaagtgaagccggttttttttctccgttcattgacaaaaggaaagtctgtaattaaaaaaccagtacatgaatagaaagttgttactaaggctagattatctcgtatatttagaaatactgtcatgcaatgcaactaatttggtggttaaaattgattggacgcataaactggacttgagccaaaaattttggtggttgttaagctatgcaggtatttttgattattagtacatag

SEQ ID NO: 32215 - DNA, 1206 bp, Heterodera glycines
attattgcaagtattatctcgcaataagggatgaaacccccggagttgcaataccaccacatcctttcacgtggtggaggacttggtcagcgctggatccttgaccaggctgcaaaaattgattggcaaattgcaacatttttgcgtagacctgacatggacctgcggatcagcactccaaaaaatctgctgcagtatttggtcaaccagtacaacaggcagcaggcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcat

SEQ ID NO: 32216 - DNA, 1505 bp, Heterodera glycines
  misc_feature (116)..(116): n is a, c, g, or t
  misc_feature (1453)..(1453): n is a, c, g, or t
ttaaaattaaggaccaaaatgcgctttccgtactccccccaccattcggtaatgcttctgttgctgatgccatgcccacttccgtccacaaaatgccatcgcccacttccgtcccncaatgataatttcaaaatgtcatcaatgccacccccaaacattgccaatcattgccctcgtcccgtttcacttccctatgccattttcgtccccaattcctcgtctttcaccacgccccaactcttttccgctgccgatgccaacaataatttgatgcgctttggccctgccgaatcgcttccgagtgccattggagaaagtgaaacaaaatgattttctgacagttaaatggcatttcaaatgctagggcgcgtcgtcgaactctccgccggcaattcccttcctcaaaattccgtccccaatgcttcttcctccgcttcgctctcttccgctgctgcgccccctttcgccgccggcacttttcgcccggttggcttaacccttcagctttttgtccatcagcagcagcgttcgtctttttccgcctgctctgacccgttcagtcatcgccattcagcagctgttcaaatggatgttcaggtgggataaagcatttggacttccgtagctcagtcattagaacaccccacggagtggaagggtcgtgggttcgaatcccaccggcgggcgagtggggaccggaaaattggataccaaacggaaaataacccatacagtacaccacaggatcttagacagggacagtaaattgttggacgtcacattctgcttttttaatactaattatatcaaataaaatatttgcttagctaaaatgaatataatttaaatgctccaaaagcctaggcatattattgcactgggttttaaatattatctgggcctcggaataattcttttaattttatggtatattttttattttttagtcttaaactttccgatcgatgttaactgttcgggcgtctccaattaatttttcgtgtccaatttctcgggagccacgggcaaattacaccttttattgttctattttgtccattgtccatattgtgagccctaataggattgtgattttcgttcattttctttccccaggtggagcggacgaattccgcagcggacgaacgctttaacgacgcatttggcggtgtccggcgatggttgggcgccgtcgggcggtgggagcggctgacgcagcgagcggagaggcggcagcgacggaggcgcaaaagtcgcgcgggcagcgcacggccaaaggcacagcagcggaaagtgtccaaagtgaggccaaaacaaccaacgaacaaacaaacaaacaaacgatcagagcaatggcttactcagctgcttttgctgctgatttttgtttcccttagcatacggtattatgataaagcatacggtaagcgtttctgtttaacagcaccacagntatgcgtttggactcacatttggtaccgggagggtcgctgctctcttttcgt

SEQ ID NO: 32217 - DNA, 983 bp, Heterodera glycines
cagttaattattgaaatagttacctaattataattcctttaaatttccattttataaatacattcatttaaaaagcagttaattattgattattcaatatattatatttcaaaagaaaataattaaaattttccctttgctttgtccaaatattattttgcatttaaatgatcaataaaataaagatattatcaataagtaactgaaaaaatctacaacagattccattccaaaaagaaataggaggttaatatattgggatttgcttctttgctttatatctaacaaacgcaaaagaattacaaatttctaagcaattttataaatttttcgattaatggagaaagtggcccagcagaattattatttaggattcaaaatcatcgtctttggcaagtgctgcccaaaaggagttggacttcatccatcgtgttttgttgggcccacaacggggcaatttgacgggaacgcccaccattttggcgcgcgtattttgccacatctactgcgtggggcatattttggtgccaattttgtatgagattgtctagttgggtcttcgccggtccacacgtactcggaaattggctgctcaaatccaagattggctgaataagataaataataacgaaattcaaattgaatttaatttagcaacttttttgatcccctccaaatagtcggccaataatcgatgtgccaaagtggtcgcactgatcggcaaaagcggcgaatcggcaaaaagacgtgccaattccgcccaatattcgcccacggctttatgcacctgaattttaaagaattgagttcgaaatttgcaaaaaaaaatgtttgtgaaacggaccgccaattgattgttgtcgaaaatgtgttcgttgacaaatggcaattcgtaacgcgtgtgatagagcgggtattgaccacgtttggggtcaatgtaagtgatcatcatcacgggaatgcccagaaagtcgagaaaagat

SEQ ID NO: 32218 - DNA, 1458 bp, Heterodera glycines
gggtgggcaaaaagtctaattttggctattttgcgccttccttttcaaaaaataatggttcaatggggtcacggcggcgcggtgccgattggcgcagccgggaaaaatttttggaaattttaatgaactatataagaaaatgtgaaaaattttcaaaaaaatttgttcatttccaccactaaccatcatttggttgttgcttcttatctcggcattgctcaacagccaaaaagtctccattacgcctttgccctataaaaagagtaagattgtgcacactaattaatttttaattgtcttttttagggctttctaattgtttcgttttaatttgatttttggttaataagtggtgcttattttttccccagcattctcatattattcgcatattttgttaataatcctgtgatgtgactctcaaattgacagttttgtgggtgccttatcttatagatcacggcatttagtcaattattcgtgctgattaatgatgtatttatcgcccctcccccctcaccttaattatcacttcgcctcgactttccactgcgtaaccatcaaaattattgtgcagcagcatatacgtttctttggagatgtgaattttgttagctgaatgagaaaaaaagattcattaatgtttttaaacgaacggcttgaagagctttccatgcgcgaggcggtgtttaccgtgtcgccaaacagacagtagcggggcatggctaaccctaaattacaaccaataaaatttttgataggaaaatgaatcaaattctaaaatttacccattttaatttaattacacgaaatgtgtttaaagaaatttttaccgacaacgcccgcgacacatgggccactgtgcagtccgatgcggagacgaatgcgctcaaaggaatggtccgaaattcggaaggtttccaacgctttcaaaaattccaatgccctaatttaaaaaataaaatttttgaatttatttatgccatttcttacatgtcagcacactgtttggcatgtaaattgccatttcgattgggaaggccggacacgcacaaatagccatcgcctaaaggcatttagtaaaattaatacataattatgaataataaaaaaatgttaaaaaatatatatttttaaatcctaaaagacatttaaaaactcaaataataaaagtgaatcgattctttattaaaattatgacaattttttaatcgtaaattagctgaagcatatatccaccatttccatccccgttccccctgtggttacgagtagagaccgaaaatttcaaatttgcggatcccgctgcgggactggaactcaaaatttcgggacgggatcccgcgggattaataccgcaaatcccgaaatcccgcaaatcccgcatttaaaatttgcgggatcccgtgcgggattgcgggattttggaaaatcgaaaaaatttcaattaaattcaaa

SEQ ID NO: 32219 - DNA, 1468 bp, Heterodera glycines
cagtccgatgacaacaccaccgatcacaattatgatgcatgataaaatgctgacaaaataatgcaagaaatgcaagtttcttgatccgatcagtgaaaatttgataaacatttgatagagtgtctaaaaaaatttttgcttcttcatttttaataattattttaaggaattatatttaaaattcgaaatatgtttatttaaaaaataattattataatctaaaattattttagtttaaatgaaaactttaatgaaaaattgggtcagtttctcaagaaatcatgaaactagctttttaaacacttaacttcgattgagcaaatctcataattatcttccaaatttagaaatttcgatttatttttttaatattctatcaaaaaaaaatttttttttctttattttgattatcatggaattaaattcgtgacttctttattatttaataaattcataaataaattattttaaattaatgatttttattcttgccactgccgccgcatcgttaaacaatgcttcaccgaacacgttgatgaacaaaaatttgttcacattaatttgctcaaaaacgccaatcaccgccaccgggtccaccgaactgatactggcggcaaaagtcaatgcttggcatattgaaaatggcattgaaaaaatgccaaaagtgcccagccaatacagagtgaaacctaaaaaaaaagaagaaatttctataagaaaacaatttttatagtaccaattgcaaccgtattccaaatggtgccaacaaatgcgaacaataaaattgagtcataattttcccacaataaatttgtcggcatgtaaaatcctgtaaatacaataaaagaactttataattaaaaaagaaaagagtttaaaaaaacggaccgaaatttctgagaaaaaatcggatttattattcagaaaagaacgattttctgaacatttcgactaattttgaaaatttcggatccaaatctaaacaaaaaaataaaaataaaaaacaaacaaacaaacattttcctagatttttttccatccaactgatttgaatagtttttcttttgcataaatatgaattttatcgaaaattcttatggtcaagctttggcgacaatctcaaatcggagattccctagaacaagaaaattaaaaaatagacgaatttttaggaaattaaaaaaaaatgacttaatccgaattgtaattacgaatttacccgcttcaaaaatgattggtgggagaaggtaaaggaagaaagtgttcgcctcaaacatataaatgtgacgttcaacacggaacaggcgcagcagttggccaagtgcaaagccaagcacaataagcagggccgagtcgggcacagtttccgccacttttttgtacgcatggaatactgtaaattgttttaaattaaaataaatagaaagcatatatttttttacacatttttggaaatgctagcaagcat

SEQ ID NO: 32220 - DNA, 974 bp, Heterodera glycines
aatcttatttttggtgtccgaaccttagtttttcacccattttgtcttattttgaaaaaaaaaacttgggagccctgttaatactacttcaataccagtcagctgaaaaatcagcttatgaacaattaaatatatttaaaaataattttaaaaataatgaattaattgagacaaaaagacaaatcgagaatgaaatagtaaaatttaagaaaatttatttatttttttcttaaaaaattattgtgtatttttgatattaaaatgacaaataattttttaaactaatattgaaaaaagatttaagatgctttaattgagatttaaatttgcaaatttttttgcttgctttacatttttgcaaacttttcaaattcaagcataatatctagggctgctaattttatgtaaatacattttttttcctagattctccatgctctaattagtaggaaaaacactttcttttttgtgtttgcgaacaaaagttgggacttttatttacatattttttacatattttgggatttttctacatattacatatgtacatatttttatacatatgttggaatttttcgtacatatttcgcaatttttcgtacatattttcattttttttacatattttgaggatttttgagaatttttctagaaattttttgtgaaaaatttaaaaaaaatttcgaaaatgtatccctaaaaaatcgaatgtttttcaaaaaatgaaatatcaaaaattaatttaaaatactaaaaagtgattctaagcctattttggtcatttttatggcattttgtgcctatttcactttttacgaagaattttttttccaaaaataaccattaaaaaaatttttatttacatattttagtacatattttggggatttttgtatatatttcatacatattttagcattttttatacatattttatttacataattcgcaaattttcttacataaaattagca

SEQ ID NO: 32221 - DNA, 982 bp, Heterodera glycines
aaaaaatcgatttttttggttttcgggccagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggtgagaccgaatcctcgggaatagcttccctatagcctgtactttattctgcgttggattttgctccccataattgtttgagtaccccaaacggacact

SEQ ID NO: 32222 - DNA, 1662 bp, Heterodera glycines
  misc_feature (19)..(19): n is a, c, g, or t
  misc_feature (1487)..(1487): n is a, c, g, or t
  misc_feature (1536)..(1536): n is a, c, g, or t
  misc_feature (1555)..(1555): n is a, c, g, or t
  misc_feature (1596)..(1596): n is a, c, g, or t
ttgttggcaaatagaactncgggtggcataatctattttttaaccctcaaaaattattttaatcattttgatttggcaaaatataaaaaaaacattgaaaaacaatttagataatcgggagaaggtaattaagccaaagtgtttggcatggatttaagttaaactgtgcttgagtgctgaataagccgcagttaatcggcacagatgtatcacattttttgcacatgtgaccaattctgatgcatttggcaaaatttgtttttttaatttaatttattttttgaaattttaaaaataacaaaaaattttaaataaaatttagtctttttaaaaaaatgttttctacaaaaacaaaacaaacaaataaataggcaataaattttgatcatgagtgaagtttttaattaattaatccgattttatctacgggagaattaccgaattaatgtgttattttattcaaaaaaaacaattagatattattagttagttaagaaactaaaattcacttttatctgatttttttgcgtaattataaaggcaatttaaaaaaaaagtgataataaaactaattttttaaaaattattttaataatgatcatatctcgttctgtgaatgataaagaattgtgctcggttcaaccgaaaaagaaaacaaaaaataataattttagtcatgggaccaatgaaatggagaggaatttaggcccaaaaatgaaaaatggaaaaatatactttaattttaattagaatggccaaatcggtaaatttacctttcataaaaagagattttatggccaattggtgggaaagaaatgtgcacttgacgtcagaagggaataaaaacattattaaaggttgttaaaacgcgaaagtgacattaattaattgtttttttcaaatatggcattacgaaatttctttttttttaaaattactatgataaatttaataatttaattttatctctattacgtcataatttggaaatgataaatataaaatgttttttttttaattttaaaaattgtcatcggttgacccccgcaaaattaatgcttttataaaattattttctgtaattgagaatttcgtaaatttagcaaaaaatttcaaactgaaggtcagcccatcacacaaaatgcgatgacattggatcaaccaacgcaaacaaatatttccccatttatttttaatgatgttttgatcggctgtcacaatttgattaatttggcgcgtctgtcaattctatgcggagcacattaattatcattagttaattaatttctttttgtcaggctgagaattttccgttctcggtcagaaggaataaagtaaatcttgggtgatttatatttttaaaaattatctcagtaaatgtacagaattaattgtggaaaaatattagaaagatgtttccagccatttactttgtttttaattataaaaaatgattttaattaacggattggaatattcccaataanaatttatgggaattaatttccaaaaaataagaagcatttaagggtttanatttggtatttaattttanaaattacatttttgttcattcaggtacattcattcattaantaatttcattcattttattatttcattttcggggtgttgttgtgtaagaaaaataatttatatggc

SEQ ID NO: 32223 - DNA, 1675 bp, Heterodera glycines
gctatatattaggtaacaaaaatgccgaaataggtatttcaatcagacatcgcttgtccttaatttaaatacacttttgtctttttagcacttacgccgaggcgggaaaaatcacgaaaagcgctatttgtgccgattggtccccctcgggttggttaaagcattttattcctaacggaaagtgattcattttcaggtgaattgcttttttgtgctatcagccgttccaacccaatttgtttcaatgtacaaaatcacatttatagtatttgccaaattccgaatttcattgtttagttgcaaaattccgagcatttgcggctatcagacccaaaatactcaaacatttgcacaataaaatcgtgctcttttgctggcgatcagtatttggtcacaggaagtgacgattggaatatttacgtgtggaaagtgccgagcaattggggttagtggggcatttcgaataaaaatatatctgcaatgcttttcagacgatttcgccaatggcactgtcaatgttcactccgttttggagggccatcgctctattgtgaaccatgtgaagtacggaccacgcagcaatttgcttttgtcttgcggtgtcgagaaaatcattaaagtgaaaatccaaaaaagaatttatttataatttttgctcattgtcagtgttggagtgggctgcctttgcgtgactcgtaccaaaatccgaaaaaacgcgagcgcatttcgacgattcttcccgactttctcgatgatcccgaccacgggtcgatggattcggacacggaggaagacctcgacacattgcaacgattcgacttttattatgaggttggacaggtccgtcctgtccttttaagcacaaatattgcaccaattcagcagacgctgaggtcaaacagagccttcgtttccgacctctcttccgaagaagacgacgaattggccaattttgtagtacattcagttgtgcgtttttaaaactgatgattgaatggacttttgaatgaatccgtcttcaggaatccgaagaggacgccaacgatcacgagtctttcttctcagaaatcaccagcggtctctactcaccgtcgccaatgcattcgcccgactcgcaatctgacgacaactgaaagaacaaaacaattgtcccactgaattatttgaccacgagtaccacaaaaacccagtgatcggaagggaatgtgcaaaaagaaatgattaaattttatttttttattatttatcatcctattcgagaataggcttttccgtcaaacaatttgtactacgattcattaaagaatttacccaaagtgtttactcggggatgaatccatttgtttattttatcggttgcattggcagtttctccttttcaatgttgccttattttatttcctttttatttgcatgcatttctttcatttgttcagttttgcccgctccctttcacccttcccattattctctccgttggaattaattgatttacctatcatccatcatctcctcagtttatcttttctcttttgaacttataacaacaacaaacagttttgtgggccctcccggcggcgtttccttttaatttgaaaagggacttccccttttaatccaaatttaattttaaaccgcttttttttggctttttttttccccccccccccccccc

SEQ ID NO: 32224 - DNA, 1549 bp, Heterodera glycines
  misc_feature (1391)..(1391): n is a, c, g, or t
  misc_feature (1465)..(1465): n is a, c, g, or t
  misc_feature (1509)..(1509): n is a, c, g, or t
gaatgggcatgcgtgtgcacccgtgagcagttggaacccgagggcttggcgaataagcatgcgtggcatccgtgagcagttggaacccgagggcttggcgaatgggcatgcgtggcacccgtgagcagttggaactcgagggcttggcgaatgggcatgcgtggcacccgtgagcagttggaacccgagggctttgcgaataggcatgcgtggcaaccgtgaacagttggaacccgagggcttggcgaataagcatgcgtggcacccgtgaacagttggaacccgagggcttggcgaatgggcatgcgtggcacccgagagcagttggaacccgagggctttgcaaattggcatgcgtggcacccgtgaacagttggaacccgagggcttggcgaatgggcatgcgtgacacccgtgagcagtttgccaagaaaagaaaattgtctaatgttcagcggatgccaagaaaagaaaatggccaatggatgacaataaaagaaacattataaaatggccagtggatgccaagaaaagaaaattgtctaaatggccagtggaagccaataaaagaaatattatacaaaggacagtggatgacattgcgtcgaccctctgtcccggggtatacactttgtcactgtggtgaccaaatggtctaaaacagacagtcatgcacttgccactgccctacacgcacaaaaaacacggtgtcgacactttgtcccagcaagtgtgtagacactttgtccgttttgagtgtcgacactttgtctgttttgaccaaatttgcgaaaaatgtgctttttacgtctgcgcccatcctttacactaaaaaaacaccgcttcccgcgaaaatagcgactttgcattttgcaccccccaggggctaaagggggttcgacccttcagacttgtcgaatcgggtcgaacttttttttaaaatgctccccatggcgcggcgcaactttcgccaagcgacggcaagacagctactctgcagcgccaggcgctaggcgccattcgcgaaaagttagcaaaaacaggttagcacaactcagcgcaaagcgcccggcgccagacggcaatttgttttcccagcctttcagggtgcgggacgcgcggggaaaaaaattctgactctctagcagcgctggcccaaaagttggctctctatggcgcaaagtgggcaacaaaagttagcatatctcagcgcaaagtagtcgaatggcgccaaaattttttccattatgctccccttgggatggcacgcatttcgtcaagcggcgccaaacttcagcgccgggcgccacgcaaagttagcaaaaacaggttagcacatctcggcgcaaagcgcccggcgccagaacggcaatttgttttcccagcctttncagggtgcgggacgcgcggggaaaaaaattctgactatccagcattgacggttcaaaagattgctgtctatggncgcaaagctggtccacaaaaagacagcaatctcggccgccaagntggggtcgatcgggccaaaatttttttttaaaatgctccc

SEQ ID NO: 32225 - DNA, 1566 bp, Heterodera glycines
  misc_feature (47)..(47): n is a, c, g, or t
cgcgacaagcacgtgtacaagccaatgacggtggagtataggtggcncgctccagcgccatccattttcagggctagtgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcagcccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccgagttcactcgccgttactacgggaatcctcgttagtttcttttcctccgcttactgatatgcttaagttcagcgggtgttcaagtgtgagttcaggtcgaaaaatcaaagcaggaatg

SEQ ID NO: 32226 - DNA, 647 bp, Heterodera glycines
tggtcttgaccaaatttttggccttgactatgagggtgaaggttttcgaaaaaatcagctcataactaaatttgcactattggttttattcactgcgggcgatgaacaacgaatgaaaaagttcgcgagggtagaattaggaacccaacccttgcgcatctttgtcatttccttccttgatcggtcagcggcgcacattttgctttcggcttcttaaccatatgttcataatgaaaattagaaataaaatttattaagctttaaaaagttgggtttactgtgttcatttctttgttgtcagtagagcccagaaatttcaaatttgcggatctcgcatagggattgaagctcaaaattttttgcgggacggtatcccgcgggattaatcccacaactccagtaatcccgcatttaacttcatgacatgaaaaagccaaacaccaaaaagggcaggaaaatgcaatgaataaaacacctgctagtaatatcgcgtttcgtgaccattgttaacagtgcgatcccaacacatgaaacggtagtgatccccatggccaccaaaacggacacggacgaacagaaagcggttatgacctaaattattccaaataaaattagtttgtgaacaaaaatcatcgcacttaccatgg

SEQ ID NO: 32227 - DNA, 899 bp, Heterodera glycines
  misc_feature (13)..(13): n is a, c, g, or t
aagaggtacaacnggtgattaaaagaggtacaacagtaaatagaagaggtacaacagtgattagaagaggttcacagtgattagaagaggttcacagtgattaaaagaggtgcaaaagtgattagaagaggtacaacagtgattagaagaggtacaacggtgattaaaagaggtacaacagtaaatagaagaggtacaacagtgattagaagaggttcacagtgattagaagaggtacaatagaagaggtacaacagagattagaagagttacaacagagattagaagaggttcacagtgattaaaagaggtgcaaaagtgattagaagaggtacaacagtgattataggaggtacaaaagtgattaaaagaggtacaaaagtgattagaagaggtacaacagtgattagaagaggtacaacagtgattaaaagaggtacaacagtgatcagaagaggtacaccagagattagaagaggtacaaatttgatgaagaggtacaaatttgataagaggtacaaaagtgataaaagaggtacaaaagtgattagaagaggtgcaacagcgattaaaataaaagtcataaaatgcgccgtatttttcctcattttttaattatttgattgtgaaaattcaccctccctaacccgagttacgaatttttgaaaattacaccaaatataatttttttgacaatttctaatttaaaaaacattaaattctttaatttaaaaaaataattatttttaaataaaattttcaccaaaaaataatttaattcaaatgaaaattttttatttattattaataaaataaaaatattttaaataaataaaaattaaaaataacgtaaaaatgcacaaaaaaataatgttacaccgcccagattctaacttccc

SEQ ID NO: 32228 - DNA, 1234 bp, Heterodera glycines
  misc_feature (74)..(74): n is a, c, g, or t
aaacgaatgaatgaacgaatgttttcccttcggctgtttctgttgtgaaagaatccaaatttgcatcgatttcncctcgggtgccgttggaattgctcaaatagtgccgagggagagacagagttaagccgaaaggggggagggcgtgtacacttatgctaggccacttggcattattcactcgcacggcgccgtgagggagggggggggatgcatttggaaaaacaaaaaaggaaaaaaacggtggcaatgggacataaaaaatatttgggaatggaaatgttttttttaatgagagtaatttggtcccttttaattacccccgtcgtttttctccttccaattttccaccgcttcttcgtcacggttctcaaagctttgccattctctgcttgaccttcggtgttccacaggcttcggcggtgccttccccgcatattttgggttcgattcgattatgtccgccccgtgagtccacgcggcggttgagtcgcaacggtttctggtcttaaatgcggtgagtgacaacgcaccactcgacagatgggccttggtttgctaaacctgcgcggctgttcctccccccggggcattccaattgcaaatgtccctttggccggtcgaataacgccgttgtgcttccttcaattctgaattaatattaattaattgcctttaattgtgcaggtttttctgttctgccgtccttactcgcccctcttccgcgtcccattggaatgaccacgtgcattttcggcatgaatgagtcggatggcattcggcaggacccggcaacagatgatgaagtcctttccggtgacgaaaaagactcaatgcgcagaaaggagagaccggtcggagttgtgggccgaggccgaggcgcaaaatggacagtggaagacgaagaaggggagggcatggggacggagaaggagcaggacggggcatggccatcgacgggaagcgcatcggcagcagaaggacgaggacggtgcatctgctgaagggacgaattcgatttctgatttccgaatgactcgatcagcacataaaattgagttattccttttaatggcacgaaaaataaaattaaattacaaatttcggttaaacaacaaaaatggggtgtttttaccattaaaatttccattctaaacatgactagcgacggcattttgccgattgactaagtgcaacccgtgggggaaaagtcacaaaattacaaatcccgcgt

SEQ ID NO: 32229 - DNA, 1226 bp, Heterodera glycines
  misc_feature (1172)..(1172): n is a, c, g, or t
tcaaagcttaactattgcctttttgtatgataactggtagatattgggagtaaaaaaaagttttttttgtgactatgtacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaataaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttatgcaactttcccgacaaattgttgagataattattctagacgatttttttatatctcaaagcttaactattgcctttttgtatgataactggtagatattgggagtaaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccangaatttatacagctatcccgacaaattgtttagataattattctagacgatttt

SEQ ID NO: 32230 - DNA, 1012 bp, Heterodera glycines
taaaaaattttaaacattttttaacccacacatctattacaatttcagataaaaaaataccatacgaatttttaaaaacgaagtttctaattttggagatttttagcgtttttcgagtgcctctttttgcttttttaagctcttctcttgaaaaatatgaaaacgaaaattcaacaattatctattttgcaccagttttaattccatggaaacttttttgaaaattaaaagaaattaaaattatgagtaaatctccgtccatttgaggatatggcaactcgacgtcaggtccgtgtgttcacccgagttgatgacgcaattcggcacattcgtgacacaacgccacgcccacaggaacacgatgggcatcaaaatgccaacaacagcgccaatttgaattgtggcactaatactgatcagtcattggctgatcagcttaagcaacatgaaaagccgctgacaaatcaaaagcggaccgcattacggcaaattttggagaagcaacatttggtcaaggagcggaccagcatcaatttgttggcccatctgcgcgaggcggctgcccgtggccaacgcttggagttggacttggccgaaattcggcctgacggatgcatcagcatgagcattgatctgaaccagcttcgaccgcttgccaattgatctttttcattcaaatcaattacactaattgatcatttaaggcttatttaatattagtctattaattcatcataataattattaagcctgactattactaatactaatcctttcgttgtttcttctaattaatcataaattgatatttaaaaattttttcattttgtattcacaactttattaattagtttgtatcagttcattttcaaaaatagcaataattttagttttctaattttttgtcttatttattatattttcatttatatgtatttatttttataaaattatacattacaaattagcaatgtttcaattcgatttcatactcaatgaaaagaattctgct

SEQ ID NO: 32231 - DNA, 1573 bp, Heterodera glycines
  misc_feature (340)..(340): n is a, c, g, or t
aaaacgaaatttcaggaaaaggaaaatatttattttcataccctgtggtcgcttttgatagcccggtggtgcccgttttggttgagttgatgatccgtgaataaccagtcttggtcataggtgcccgaaccactgccgttaccacccaccaatactcacaatggaacttaaacataattttgctgtttgaagatttctcattaaaataagcaccccccccccccatcggagcagctcgtccccccccccctttcctgcctcctccccgtatcgttgctccagaaaaattttcctattttttgactaaatttgaaatttaaaaaaaaattccgggggttgnagggggggggggctagttttagattcgtttcgtttaaaaagtcgcactttttttcattttgtatgctccttcaagaacccgtcccctctctctctcgccatgtcacaccaacctgtacgggtcttcgctgccgcccaacgagtaaatttgtgaagacgcagtcgcatagagcggttcatctgctgacgcagcagcacgtcgcagcgccggtggcggcacagcgacgcgttgttgcggcgctgctcgctgctgttgtcgtcgcaactgatgctgctgcggttggtccggtttgccagcaaagtccaggtagtcgtagcgcgactggggcgacgatgatgacgacatttgtgcatgatgggacgaggaagggcgggtcgagttcgagttacgctgaagctaccaaatttcaggggtatgtaatcagcagaatgcacataaaaaaacacccaaaattcgattaaaactttgaccctagggtgtgtagtaaggggatcatttaccctccttctcgaaccccaatgaattcaattttttttaattcacaaactgacaatgagagtttttctcccgagtacaatacgtctcccgctcattttcgctttttttatttcttcgtattttttttttagttaaacacccaaaaaatttttgtcaaaaggaatttctttaattcttcttttacaattattaaggaaggttttttaaccccaagttaaaaaatcaaaaatacgattgttccctttctcccatattacaataattcgaaattttgctgacaaattctatttaaaaatttccaaattttcccaactcccacccgtcaaaaacaaatcacaaacaatggagtaaaatggagtcgaagaatgatgagtcacgacatcatggcattcgtccgcatcgatgtagtcatacgagcctttggagtttttgcgctgcggttggtcatcagtgtcggtgcacgaggcggtggccatgtcccaggagacttttttgccggacaatattggcacccgaaatgcaaatttattcaatttcccataaaaaatagaatagttatgttacttttgcccgtctttgatgtccaacaccattggcacgtccgtcaacatggtcatcaccatggcttttgttggcaccaccatcctttttctaggtctttttgaattggtcaatcaatgagaaggcgccgcgggaggagacgaccctttttcccgtctgttttgttgtcaattt

SEQ ID NO: 32232 - DNA, 1357 bp, Heterodera glycines
  misc_feature (30)..(30): n is a, c, g, or t
gcccttggcctttgacttcacgatgggccncagcgcccttggccattgacttcacgatgggccccagcgcccatggcctttgacttcatgatgggccccagcgcccttggcctttgacttcatgatgggccccagcgcccttggccattgacttcatgatgggccccagcgcccttggccattgacttcacgatgggccccagcgcccatggcctttgacttcatgatgggccccagcgcccttggccattgacttcacgatgggccccagcgcccatggcccttgactcacgatgggccccagcgcccatggccattgacttcacgatgggccccagctcccatggcctttgacttcacagatggcctcagccaggctcgtagtgtagaacataaagatttcgcccggtgggactcgaacccccgacctctccaaagcatgaagtgctctgtccaactgagctacgggcgccacttagtggttctccagtattgcgcctgtggtcgtctcagtttgcgccatcgttctgtttgcgcttgtgttcaatctcagtctgcgccctcgctcagactcagtttgcgcctgcaattgatttgcgttcccatttgcgttcctcaatgtgcgttccaatttcgcctcaatttgcgcgctgtctttttgttcctgctcagacagtttgctcttccctttcgcctcgttttgagcttcctcaatttgctcttcctctgataattttccattccgcctcggtctgcgcttcctcaatttgcgcttctcatttgcgcttctccaatttgcgcatctccaattgcgcttcaacaatttgcgctgctccaatgcgcttctccaatgcgctttctccaatttgcgcttcaacatgcgctgctccaatgcgcttcaacaatttgcgcagattaggctcactgccctctttgtgagctcggcacaatgccgccaatgagtgcgagataggctcgctgcctaagcgcatgaccattctttcctgaggggctgtggtgcggaaggcgaggcgccacgggccaaaaagagacccgaggggccgtatggcgcggaatggaaggcgccccgggtcacaaaagacccaagggacaatatggtgcggaatggttgcgccccgggttacaaaaaacccgggaggccaaacggtgcggaatgcaaggcgctacgggtcacaaaagacccgaggggccctatggcgcggaatgcaggcgccttgggttacaaaaaacccaaggggccagaaacgcggaacgcaaaatggaatagcgctaatgccagacgccacaggttacgaaaaacctgtggggccggcatgctccccctacccctgctcac

SEQ ID NO: 32233 - DNA, 1280 bp, Heterodera glycines
  misc_feature (15)..(15): n is a, c, g, or t
aatttatcaaatacntgaaaaaatttacattgtgaatgatttgaaaaatgataattaattatttatattttaataaattggctatgaaaaaacaactcattatttattattttttgaaattaataattaaaaactaccaaaacaaataataaaataaaacgatttaaaataaagcacaaatttatgaaaaatatgtatggattgtactgtacatcaaatgattaaaatatattaaaaaaatttgtaataaaaatccaaagttttccatttttgattaatcccccgggatttttggggtgtgccaaggacgtagcaacaaaatcttgcggaataggcgaaataggcaccgtcaggaaaatttttcaaattttttttttaaatttgcaatgattcaatacgctattaaatgccaaatttgagcctatttagaagagaaagtaaaaagccaatgaagaatttttggttttaaaaatatgtaatggcttaatttcgttaattttttgaatgtttttttaatcattttatacctctaaatttgagactttttagtgcctattttctatttttttagtgtctatttttgtggtttttatgacctaaaaccctatttattttggcggttgatagagcctaaaaattgcatccctaattaccactcttttaacggatttcccttaaagggctacgtccccttgttgcgggggaaaatcgtactattagtaccccattgcgaacagcccttgtccctttttcgatcacatttcacacaatgaatttcttcaacgcgcatcggctcaatgtctttttgtttccagtaataccagaagctttccgcgctgccttctcgtttctgttgagaaaatgataaaaaaactgcaaaaaaaaagaatcccaaaattgataataaacttgaaaataaaaaccatataacaatttttgggtataaaatttgaaataattccagtgtacagtatatttaacaaaaaaatggcacccttacaaattacagtataaactcacgtgacacgacacattcaatcggccactcgcattttgctgcactttgtcattgagctatatatagataaatagggatgaattgttgaaataaaattgtaattttttcaaactttagacgcgctaatgagaaccatgaaacgtgtgaaactgtttttgcttaaacaaaattatgcttaatttggccattttttgtgaaaattgcttgacaaatgcacaaacaaaagaaaaatgattattgcaccctaagggccgatctagaa

SEQ ID NO: 32234 - DNA, 1954 bp, Heterodera glycines
  misc_feature (99)..(99): n is a, c, g, or t
tcaataaatatatcgaataaatttttaacaaataaacttccattattctgttcaagaatgtctttatttactcaaaagttcataaaataaaaagaaaangcaaaaataatctaacaggaaaataaatatcataatcaggcaattggtaatatcgtaattatctaacaattattgttttcggtatttttaacaagaaaaagaatgattttaatatacaaatagtataacatctcatgaaatacaaaatatataaccctaagagaacatattcatacttttgtatattaaattaagaagcaaaacgaatttaattaaaaaaaagaaaacataaaaatagtaaaataaaagtttatattcttttttatatatttaacacaattatcaatttcacaattgaattataaattttacaaaacaaaaaatttttttataatataaataaaatcttttccatcttaaggcgaatattcgaactctgcatgaatattttttatgagaagaaggaaaaataataaatatgacaattgtccaagtattatcaagcgaaatatgatattatgtaaatgaaaattaagtttaaaagatcaaaaaacaattttatgttgcttgcaataatcaattattaaagaaaatcttataatattatcaataaaattgaatgattaataaaacaattgctttaaaaatgaaattaatgaattatttaaatagataaaaattaatattaatatttatcataatttccataaaagtaatttagattaaaaagaaaagtgagggcatagataaacagacaaaaactcgaatgttttatcataataaatctgaggtaaaaaagatacaaatcaattctaattatcaccttaaaagaaacagcataatatatcatcatttaaataataaaaattaaaacaaaattatttaagctaaatacaaaacacattacaataaaacagcaaaaataatttaaagaaaaaatatataaacaaattttaaatttgcgaaatggagtaaatattttgattataattttagacataccgtattttcaaaaatttttcactaatacttagtcgaaaattaatccccccgtctacatttattccccatatctaataatcccccccccccccatctttctgaggaggttctacaataattctgccgggggggggggggggggtgggataattagagatatacgttattataaaattttaaaaaaaagttaatcgattatttttttgatttttaacaaaattttaataactacaatgaattaaataaaatcttataaaaacaaaatagtgatgcgattcattacaaataaatagtactctccttgaattacttagggtgaaacataagtaacattttctctggctctgtatctattttgggtttcagtcaaaaataccaaacaatatcaaacacaataaatatttgttttaaaattaaaaaaagagcttgtgatgcgagaacaaataaatttcattaaatataataattaactaaaaaatatttacaaactaaaaaatatttataacaaatattttttttaatttaataaataaaaacaaaacataaaatataattttagcaaaaaaatcacgcgatatttttatggttatatatttaatatcattaaaattactttatttaattattgaaaaagcctttttattataatttttaatatccttataatttatatattttttattaaaaattatataaaaaataataatataatcattttatggcttccttttaattttgacattttcttttttttcatgacgaagccaatatatcaacatttggtaatattttagtttttatttattttcataacattttttagcaagttaattttttcgtttttttaatctaaaatgaatttctagttttcaacatattttatttgaaaaaatgaaatatatttatattagga

SEQ ID NO: 32235 - DNA, 874 bp, Heterodera glycines
accgttggcgaaaagtaagcgaatgaaaaaagggcaaattggggatggatgagaaggaattggcaaatcaattggcaaatcgatggttaaatgatttgtaaatggaggggggagaaggcaaattcaacgaatgttgacgaaaaagcgatgagtgaataaatgggggaaattgggccgagagagacggtcattaactcattactcacctgccatggcatggcatgggaatggacgaaatccatccatcattcacagaaaggggaccgaaattcaattagcgtcaattgtttaagactttttttgtgttccgtcgatgagagttcctttgatcagtcccttctttcccttctcatcgtccaaatcaccgtttgtcctgccccagcaatccctgccaatcactcactaattagccaaaagttctctcgggaattaccgcaaattgaaaagcccaaatccgagagacggtccaaaactttacgaggcggccattctgtgaggaattcctatggaagagaggtaagaaaacgaagtcgaagaactgcgaacaaacggggaaagtgttgccgaaacggtgcacctgttgagcttcaagcagtgccatcagtttttggtcggagttcgcgtcaccaacaacagtgggccccgtctcacagcgaatttgggtggagacaagcaaatgttcgaatggcatttggaaggggaaggcgcaaattggccaataaattggcaaaccaaagcgaatggagggaaaaggcgcaccgacagattgattgattgatgattgattgattcgttaatgaagtgttttagtaattatttaattggttaattgatcgcgggaagaaaatgacgattcaaaggggaaaaacgcgtt

SEQ ID NO: 32236 - DNA, 1763 bp, Heterodera glycines
aacaaacccaataagtatgcattaaagtttaataatgggtttctttcattatttttgttggcgaatttaataagtgaatacattaaaaattgtaatgttttaatttcattttgtgccgaatgcttttagtttttttcaattggcatttgcacctcaaaatgtatcaattcgccaaataatctgttcgcattggctcgaatttgtcagctcaaaattgtgcgtttccactgctttcgcattggcacaactcttcagcgggcaaatcgatttccgtcagaatgttgtcctccagcagattcgggtacagcttgagccggtgcctcacacagttcacggccttggaccaccaaattgacgaatttttgccaacataaactttgtgctgtttctttgcggttttgtgtggcaattttggcctttttgtagtcacaataattgcactagcaaagccgggcagaaagagtgaagaaattccaggccaaagacatttagacggaacaaaaagcaattaatatcagcaaattattaaataataactaataataattcaaatttaacacacaaattaaaattgcattaagttaatagggcaaaatgaacgaaaatgtaaaattttatttcgcttttgcttcacttttttttgttctgctgctaattttgtgtacattctctctcatggaaatgtggtagagaaaagaacattgagaaaagaacgcacagtctctgtttctttttctcccctcttctgcgtctatgcctaaaggcccacaggcgtttttgttttcattagggttcgagccccgtggggcgggggtggcttttcacgggggcgggggatgcgggggtcagagtcacgggggcgggggcgggggcacgataattccgcccccgcggggacgggggcgggggtttgctttgaattagctccaaaaatctcacaaaaaaatattttttaagaatgatttctttggctccacattcctttatttgttgatcgcctcgatactatttcttttgacataaattgcacagatttcgactaaaaagtaaccaaaatttagggatttttgggtaattttttttaagaaaaaaaattttttttttggggggggcgtgccgataggggcgaattttaaatttatttctaacagatattcaccaaaaaaattaagactttttcgataaattttcgtttttaactatattaaattatcgtgatttactcaaaattggaactcaaattttttaaattttttttcttgcggcacatttttcaaaaaaaaacgtgatgagtgtgcgaggggagagttccagcggtgccgataggcgccgccgggaaaattttttgaaatttgaatgcaatttgttaacaaattttgtacaaaaaatgagcaaaattcgcgagcttgggataatttttaagaaaaaatataggaattttgggggccggcggtgccgataggcgccaccggggaaaattttaaaaatttatatgaattttgttagaacttagccaaatttttcagaaattttcttcttttagatgaaaataaggggctcgaaccctaaaataaatactgaagccgttaattatctatacaaaaaaatgaattagtaaataaaagatggcaataacaaaatttatcattcaacgcatcactctgtagattgaattgttgattacacagcatcatctatgatggaatttactctattatcaagaattctttgtttgaaaatttgtgtgcaaatttagtctttaa

SEQ ID NO: 32237 - DNA, 1409 bp, Heterodera glycines
ctgatgacaagctaatgtgataaaacaggttaattcctttcctttcagtatccctgcaaagtttggtgcgcttctgatcagtttctgaaaaaaaagttaaacctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaacaaataaataatgaactctcttccttaataattttcctgcaccgaaggtactcactcggcctcttcgcggcctcgaggtgggccttcgcgtgttgtcaaactttctaaacagctaattgtaagtcgagaatctgatttattaaaaatttaattctgagtgagtgaaaggcatcgtctgtgttcaaaacatggacaaaagcgtgaaagagacaaatgctgggagatattggaaatgatcaaatattacaaatgaaacttgcaaaaatggaacatttgtccataaggccaaaagcaagaaatactcttttcataaatggcacagaattgctcaagcaaacacaccataacaaattgacagaaataatttctgatgtcccccacgaaaatttttccaaatgtttgaaagcttaaccattttgaaaatgatgtgcgaaaagcgggcatttctgctgaaaaagtcggacgctcttttgagtaggggagggatgaaaaatggtggaaagtggtgagagtgaaaatgatcataataaatggtatctgattttctgtgtttgtcccgtgtctttcttctctctgttcgttatggtagttccatcggccatcactagcgatggtgatgacgttgttgttccatacgactgcgatgatggccacggttggatgcccgagctgaagaagcggcggcggcaccatggccagtggaagtgccctggaaaatgagtgactgatgacccatcatcaatgacaagtataaaaaaacaaagggacaaagatagaaattaaacattggtgcatgccatgaatgcttaaattggttgcatttgttttttcaattttaatacaaataattgatttgttttgatgttacacacaccgtttcaaaaaacgagacatgaaccaataaatagagagtgcagagaaaaatacatttctctcattttggcgtactatttctttacagagaaagaaaaaactttaaaaatgacgatatttaagaatcttttttgagggtttttgccaaccaaactggacaatcttgttatcattcgaaagcccttgattaggagaagccttttctaagcaaatgctaaacgatttgatgaactggaaaaaagatatgaacgtttgaaaattttttt

SEQ ID NO: 32238 - DNA, 1418 bp, Heterodera glycines
gccgccgccaccaccatcacaaattgaagatcgtgttgccgttgccaatgccaccatcaaatgccaaagtcgccgcccgacagaaggccaagacttcatcgacaacaacagtagcaaaagtcgtcgccacccaaaatgcctgcgtgctcatcatcatcatcaacagcagcaaatgttcctcagccgtcgtcgtcgtcactttccgccgccgaagaattcgctaaacaaaaaaagcggaataagaacaacaaaaacaagttcaacaaaaagcaggtagccttgattaatattgaaaaaaaacttaaaatttcataacacttaaataactaaaaaatattaacctttcatagtcttttaaaattattataaaaatggttttaataattatttttaaaaatatcttccaaatttcttttctttttagccgccgcccccatcaatccgcattcctaagggcaaaacgccgaagaaggtccgtccacgccacccggaacccgaccagccggacgaccaatatgagctccgggcggtgttggcgaccgccgaagtggtgtccgggggcacgacacatctgtgtctgtatgtggatttccttggtataaaatttttttttgaatttttacactaaaatttctatttaatttcgatttaatttttaaatttcagattatcaagggcaagaggactggtgtttgtcaacgaaaagcgacgccctagaactgacgcacttccacgacattgactcgacaatggactctacgctccatgcaattgtgggccgaccggtggcgccatttctgcaacaacggcttaatgctcgcccactttttcatcaacgtaagaaaaattttttcaaaatttaaaatttttgaaatttttattaattagtgcgtcagcagcagcaaaatggtccgcaagtggtcgagcaacaattgccatttgtgttttcatcttctgtcgatgtcacgccagcgcaaagggcaaaggtggattggtctttctcatttctctctctctctctctttctctctcacatttcataaagtctgggtgttgatgtgcaggccttccctcgtgttggtccccccttcaatgcttatctcggagctgtgaaaggcggtaggcaggccttcctccgtgttggtccccctattgttttttgcttctcatttctctctttctctctcacatttcctaatatctgggtgttgatgggcaggccttccctcgtgttggtccccccttcaatgcttatttcggagctgtgaaaagcggtaggcaggccttcctccgtgttggtccccctattgttttttgcatctcatttctctatctcacacatttcctcgtttctgtgttttgataagactgaccaaaaatatttaaaaattcaggcaaatgcattgttgaagcgttca

SEQ ID NO: 32239 - DNA, 1751 bp, Heterodera glycines
  misc_feature (816)..(816): n is a, c, g, or t
  misc_feature (828)..(828): n is a, c, g, or t
ttcattttcaataattttgttttaatttaatttaaaaaattattttaatgcagtaatcaaatattttaaaaatttataaaaattattattatttttttaataaaatatagaaatttaatatcattgaaactttttaggttcgacctagagccaaataaaatttaaaatgttaaaaaaaaacaccagcgtcggcaccaaattcagttgcaaagatgcatgagcatttaaagccttgaagaccgtccatttcaaaaaagttcggtttctggccagcagcagacgattgcaaaacttttttttaatttttcgattaaatttaaaataataataaaaaattattatttttaattttcctaaaccggcctgcccgttaccgcattttttcgcaatctcctccaaattggaagtgaaatctgaagcgcatccccattcttttcgcgtttgatgtcctataaaaattgaaaaaggttaaataaattatagcaaaaatttgttttttggcttaattacaatttatacgacttttatattaaaaataattaataacaattattattattattattttacaaatttgatagctcaaaactttcactactataacaattatatgtttagtttagttgatttaagcttataggatttattactttcttcctttcaaaatattattactaacattaaaataatatttaaaatttaaatatttattatcattgagtttggagggtggtagcctaattgggcaactataaaaagaaaatttctggaaaactaaaatatatttattaattagtttatttattatctcaaganagactcaattanaatatataccatccgagcagttaagcatataacactcatgcttaaccagtttttcatcatgtagcactgaacattcttgctctccgaaatcggtttccgtgtttccgtctcggatttgaggccgtgtggacaggtcaatccgtgaacctaaatttttctctaatagtgaaaaattaaaagggttaaatttcaaacactttattttaaaaaatttttgaagtttctgactaataaagaattttatttaaagaaattttcgaacgctacccttggtaaaggacataagaacggttttttttcaaaatttgtcccttacctcataaattttcacaaagcccaaacacaaaaatacaccgaaaatgatggccatataaaatgatgggaattgttcagacatatttggaagatacaccaaataataataataatatttcgaaatgaagaaaaatattagattcagaaaatataattaataaacaaatataaatgaaaaatgatttgactgaataaatctgtttttgtccacataaaacatgaatcatcaaaaacagtgcctctctttacggagaaaaatattttgctgatcacaaaatttataatataaaattttgtgattcacagattagccagccaaatcagcaaaaactgacgatatgctaacaagccaaaaaacaaaaacggacgatcgcactattcagctgaaaactggattttaataaagtcacgtttatcggtaaaatatgtgtaaaaatcgaaaattgtaaaaatgtggaaaaacttcgaaatataatataaagttccaaaattgtgcataattttccgaggatgataaatttctcaaaacttactcaatttggttaattaaaaaaccctttttgctaaatattgtattaaagtattttttgcagaaaaaattcaaaaag

SEQ ID NO: 32240 - DNA, 1509 bp, Heterodera glycines
tgagaaaaaaatatttttttgaaacatcgccggcattcttttattttaatttaaataacgcgtttatgcaaaaacataatttaatgcaatcaattcaatttaaaaaaaacacgaaaatacacccctaaaaatagaggtttacaaaaacgaaaaaatacacccctaagaatcgactttttgagttggcccccccccccccgaaacgaaggtcctggctacgcccttggctaaaattatacaaaaacaaaagatgcgatagaatcaaatgacaaaaaaaaaattcccaaaaaatttaaaaggaatgaaactttttaaaatatttttgacttttttacagtaggatttaggtattcataggaactgtaaaatatataaaaatgtggaatccgccgttagaaaatccgccagccatcccagtttaggtcatatttaaacatttccttttctccaaacccctaagattctgctctttcactccgcctttgctaacccatttttaaataaactctttctacaaaaaacatctgtttaagaaaaagaataaaaccggggtcagtcggatttgggaaacaattaaaaataaatttaaaaaatattcgcctgaatttggtcaaatgagcccagcagttccaacgcgtccgtctcgcttgtcagtcgaatgtgctccaacggttggccaacaagtgtgggccagcgtgcgaactgttgacccgcttgcccatatgcggtggtccggaaagcaggacaagccaattggccgacacacaagcggcaacacgctcaagtaggccaagctgggtggccaacagtcgaatgggcggcgctgatgaaatgacagttgacgaatcggtgccaatgcctatgtgataatgagtggaaaaaaacaattatggcgaaacgacacttgttatttgatacacaattttacatctttccaattaaatttattaccatatcgaattcggagttaattgtctaaaacaaaatgggaatggtatttttttctcatgaacagcagtcattgctaatattcacttaatgacatagtgggaccgtaccttcaataagacaaaaattatttggtatttttttttttttgctttcgataaaataagaatcagagaccggaccagcgggcatggcaaaaaccggcccggtgatttttggaaaaatccggtttgaccggtacttggagaggccaagctcaggaaacgaacgtttttgaaaatgccaaactggcgcggcccggttaacttgaaatttccgatattttataaaaaaaataacatttttctaagaaaaattctattttttcttaaaaaacttcatgatacaattattttgcactatttccttttctcactatttattgccgatgaaatgccgcggcaaaggtgcaatggcacacagccaatgttgagttgaaattcgcttccgtccccatcaacagcggccgcgtcagacaaatgcaacatgggcaagttgggcaaccacttgccctcgttgtga

SEQ ID NO: 32241 - DNA, 970 bp, Heterodera glycines
aaaacccatgacctcgaattagatgtcagattcgtgatcagcaacctctaaaacccggataacataaaaatttgatgaattttcctacagattttaataccaagggcggctaacagaaaatgaaaattgctttggccaatgaacaaaaaaagatcgccagggggtgcctctcgtcaaaaatttttcttatcaatgttagaaaatgacttcgccgtccgcgctgtgttggcgtgccatggccgtctccacgtcctccatctccaagtcctcctccgtctcgtcgtcgtccaccgtactttccaattcgcttccgtttccctcatcgcgttcatcatttgtgttcggctgaaaatgaacaaaacaagaagttgttttttacgaggaaaggaaaagatgctattgtaaaaaccaaactttaatatatccgaaattctttctgcctttaaacacggatttgggtttttttaagttgtccagtcacaatcaaaatttcgtccaacccaaccccattttctagattcttccaaatttacaggtgcaattgcggaaagctctgctggcgatgtcacattgtgcgcagaacaaagcgaagagaccaaaaaatggagttggaaaagaatgttgggcatctcttgttggccggtgagctgcgcgagcagtggcaaaacggtgggctcttccgactcacagaaccaaattggcgcctcgcgaggataattctcctaaaaagtggcatttactgttagtaaagggcattgattgagaaaagaaaacaattttaaaatggaaaatttgaaatttaatcatcttttaattgccaaatgcaaattgtatttgaaattagcaaaccataatattggcgctaatgcaaattgatcttccgcttggcatgatgaatttcaccgtgacttcgtcaacggaagcggaaacgatctattttttgaatttatattaaaagtcaaaaggaaat

SEQ ID NO: 32242 - DNA, 1234 bp, Heterodera glycines
tcaaaccgcccctctctctctcctaaaataaatttgccattaattttgcacccgaatttcccccccccccctcctaacctcaatttcctccgcctcttccttttgcgctccgttttggtttctgtccgcgttttctcctccgttccgtcgttcttcgccaccgtcgttcatcgcattgttcccaatgccctccaactttttgcccaatttctccaataattttcggttttccaccacttcgcttttaagcgtttcgatgcgtctccgaatggcattttggcgttcctttgtttcgacattagtaaatgagtttactgagtcccttttccacctcaaatttgcccccctcgtcgtccccgtaaagtgccgtcctccgccgcgcgttcgattccaccgacagataaagcatcatactaatcaacatgaacgtaccgagcgccaacgccacggcccaaatattgccccgggaaaacagtggcatgcctcctcaaaaccaagtcaatgtgttaaaattactacaaaaatttcgaaaattgacgcattaatataatcggtttttgtcttttataacaaatcgaagcaataatcacacaccatgagatggtatttatggtacaatgagaaaaatgccttcaagcgaattacaaatgccggaaaaataagaagcaaccaaatcagaacagtgaataacatcaatttaacaccaattttaggaatcatttcctgctaattgtaaaatgtttaataataaactaataataaatggaatttaacacgtcaccacaattttcaacggtaaaatgggtttgttcatgacagtccgaaaagaaagcgcttcaaaacaaatcggtcacttcaacagaatgttcacgacagcgttcgcgttcagagtgcgcaagtcgtggtaagtttgaccggtgccaacaaaaacgatgggctgtcccgtgatgtaagtcatcgaaatggcggcgccaacctttggtttttacatttgattcctcaattgaatattcttgcccactttgtcgtcaatggtgtcgaatttggtcagcacaatgccgtcgatcagccgtgcctgctccccgacggcggaattgtcggccaacgcctggttgaacttgaccagctggtcaaccgcctcgtttccgacccaagcttcgccaacaaacaacaccaagtcgggcttgttcatgtggatcaactacacaaataacacatggcattgtgcactgac

SEQ ID NO: 32243 - DNA, 961 bp, Heterodera glycines
tacaatatttttcaagctgttcaaaatgttcctcatcaaatatttgatgagaatgaaatgaaaattgagtccattttggacataaattctgagaaagataatgaaaaaggggggggggggaatggacagcgaatggcattttacgagttaaaacattaacagaagaaaggcaggctcacattggtgtgccaatgggccactgaatgaatgaattccccggcacatccaccgccaaactccaattaatataaaatggcattgcgcgcgccattccccggccattgcccgatttgtcgccgttaaagttattagccgggagagtcggggaaagcaaaaacaacagaagcaggtgagaaaatggagcaggagaagaacattgtggatggagggggggggggcaaaaagggggcgaagggatggacggagggaggtaaaaggcatcagaggcaataattaattaattagagtagctattaataagagcaaaaatacaaattggggatttcgaaaatggcaaaaacaaaaacagattttgaaaaaaacacctgttgaaatgaattaagcccagcagggaaaggaaaagtttcatctttggcagccaaaaaccaaaagtaattcccgagtaaaagtgacaaatgaaaatgaagggataaaaggaataaatggcaattggagtgaaatatggaggagaaaatgtgtcaatggctaaatgagaaagaaaggagggaaaccctgggataatggcggaatttgccctgaagtgaatggttttttctgatcgcgaattatcggagagaattgatcggctgactgaaaagagctcttggggaggggcgggtctgattggatccggatcgtgtggaagtgaagtggctgatcaatggggcgagggggcgggggacgtcgggaagactttgccgggggggcaatggtcaatgcaatttggggaatggaggaaaac

SEQ ID NO: 32244 - DNA, 849 bp, Heterodera glycines
cccctccccccccccctctccatttaatttccattattttttcctccgtccgcttttccctttcgtgcccatccttattgatccttttgcacctcaaacagcacacgaaacccaatttggatggactaataaaaggcagcagaagaagaagaagcacatgtttatggaaatggaaggaaattgggagggaaaaggaaagggagagaaatgaccgaaaggggggagagggggaggaaaagccaaagttggacagaaaaggaagaaaagtgcaaacatagggagagagagagagagagggagagaaaatgagacaataagagaggggagaggggagggagagaaagttttaattagcgcatgggagagaaagtttatttgccaagcagcggcaagtggcaccaatctgcggacggtctctaattaccactaaatgggttcagtatcagttcaattgcctgtgacttttcaatgtatgaaaaggaaaaggaaaagataaagtcagacaatcggagcgaaaagcgtgaaaagaacggcgaaaacaaaggaaaattgtagggagagagacaacaatttataatttaaaaaataaggccaaacgcacgaaaagtgagaaagtggaaaaaggaggaggacaaaaggaggaggagagaaaagagaaaaagggggagagagaaaagaaagagggagaggaggaaaagagggaaaaaataaagtgggaaaaagagagggagggggggggagggaaaagggaaaagggacatggtataggtaaaagagtgagtgggggaaaaggagtgagggaatgggaaagggaaatgtgaagaatgggggagggtaatgcgagggata

SEQ ID NO: 32245 - DNA, 889 bp, Heterodera glycines
  misc_feature (14)..(14): n is a, c, g, or t
cgagacaaagactntcggaggcaacaagaagcattgaatctacaggcactgattgacgaggaagagcgagaaaattttgaaaaccgaccgattaacaccgctaacaatggggtttttgagaattctttgattgagggagaaatttcagcatcacaccgaaacttggactcggaacaaattcgcgatgcacttttaaatgtggaaccagcgggtgtacgaaatgagcagcagaggcagaatgaggcagtggtcgatgaaaatttggaaccacaacgcggaggtttgagattgcgttttcaaaatttgggattcaacgttggtagagaggaatggttggtgagaaacgaaaattttgatggccatcgcataactcacactctttcaccacgtattgtaccaagaacctcaacccccattgaaaaccgcattatcaccgctgagaggaaatgaaggggctaggcctaaagggtaaaagtattaacatttgccccaaatcacggaatgtggtggacgtaaatggaaaactcgtcgaatgttatggaactgtctcacttcctgtcctcagaaaaggttgcgaagaaatggaaatcgatttccacatcacggatgccccttataggcctacccattttattcggaaccaatgctttagggcctcttggtttcaaatttttcgatgccccaaatggtgaattgattgaatttgaatgttcaaacaataaatcggattcggttcgtgtcgtttacaacacagtggttgaaccgttttcaaccaagtttgttgaactttctgttccacccatttttaatgatacaaatgtgctcatcattgcaaatgacgaagacaacagcgtaagagtcgaacctgcactgagtacgggcagaaacg

SEQ ID NO: 32246 - DNA, 1201 bp, Heterodera glycines
tcaattttcccctaggaacaaaaactttaacatgatacaaacttttttgggggaaaaatatttggtggatttttggagacaattctcagacgacaaatttaaaggatggttggtgttgaaccttcctcaaatatttgtcattcataattatgattggctcctgcttctgctgatcattgttattttgttgtttttgttgtcaatgttttttgagaattgcccaattttcagagccaacgttaccgtttctttgcggataaacacttggaactgttgcgacgatatcacgaatggatgaaggattcgttgcttctactggagaaagaattgaatttgggtggtggggtgggcgatgaattggacaatcggcggagaaatggccaaacggagagacaaatcagcaaatttggcagaaaggatgggggagagtcggaaaagagccaaagagacaaatggcaacagaaagagacgcaaagagagcaaaacggagaggaaacggacaaaaggggacgaaaggtgagaataatcagaccaaatgagaaagtgatcaaaagggaggagggaagtgagaatgatcagaccaaatgagaaagtgatcaaaagggaggagggaagtgagaatgatcagaccaaatgagaaagtgatcaaaagggaggaggagaaggcgtcagagcggacgtaacgcgtcgcgagaggggcaaaagtgcggcgggggaggacgcgcaaagagaggcggaagtgagaaaaacagtggttaccgagctggcggcgaagttcgccacgcaaggcgcatggcctgcgggaagaaagcgcgaattccctgccaaaattttccgacccacgccaattgtgccgacatcgaaataccgacacagtgtggcggacggaatgctgacaagagatttgagggacagtcaagtgtggaaaacggtggtgacggtggacggaattagtggcggacaagcggaacggcgggggcagcggagcaccgcgaaagacgaaaagcggcacggggacacagaggcggttgcactgcgccgccacttttacgccgaaaagccaacaaacgaacaatggcagcagaacggacgagtggcattggacgaggacgggcacaacgccaaccaacaaaagttggaccgaggcgagaactgtttgccattaacgcacaaattcaatcctttagcgccgaatggtgga

SEQ ID NO: 32247 - DNA, 1660 bp, Heterodera glycines
aattcctaaattcaatggtcacaggttccttctatttggtcgactgtttaccatcttatgttccagacgaattgttcccattttttgctgaaacatggtgacgaaatcgaggcgaactttgggcccaatttcaagtttaatttggctactctttgaagaaagcagaaaaaacggaagaaaggcgataatttcatttttgatcaatttttattctttgtttattttaatttaattattaattttggatttttttattacgttaattactattcttattaatgataattgatttaaaaattgaccgtttgatttatttgctatagtaaaaatttgtttaaaaaaacagttagcgaatgatacatatcgtcaattgcgccctcaaatgaggaaatgcttggaacatgaattttatctgaataattaagtattacaaataaaaaagaaacgaaatttttaaaatacttttaaagttaacccatcaatgtagtcaaaaaaaaaaattaaaatgtatttaatactttttttaaattgaagcgaatgatacataatctaaaacttgggtaattaaaccagggtttctatatgttttttttttctaagaaatgttctgattgggggtagtgccttatttgcatccaaaagagggaaatttctgaaaaatttgctcgtgaagaatgacactgctctacagagattttgtccctgcaagcaaatctgttttcatttgttaagtcaaatcttttctcagattcctgagccgtcttaatggtcaatttgagatgcttcacaatcggcacgattgtgactcgtaagatcactcatctcttacgaatgttggacaagctttagaacgctaagaatttgaaagaaattttcttatattttggagatgtaattcttgagggttttaattttacttttgcgttttttcatttgcacctatcaattaagccaaaattacttcagcaaatctcttaaaaaataaaagatataatttataacaaatttttaaattaaaaaaatataaaatattgtgaagaattgattaattgttcgtatttacgtggcaaaattaatctttctaacgataaataaaatgaatattaatattaaaaatcgaaaaaacattaagtagattcattggaagcaataaattcataatactatatgtatttttttaataaatattctatgattttgtggcatttaataatattttttataattttctttgcttttggaattgaatccggcaaaatccgaacaaattttgttgaaatatttggtgaagaatggtacaaaaatgaaagtgaagaaaaattgaaaaaaactgaacgaaatgagcgaaatgataactcacaatcagcatcagttgatcaattgggtgaagaaatggggacagacccaaatgatcaacagaaaagagaaatcattcgaaaatttgaagcaattaaagaaaaattgaagcaaaagggaaaatttcaatggaaaagtcaaacaaaaattgagaggaaaattggaagaattttaggcatatatcgcgaaaaaatatacaaatggaaaaaagaattaaatttaaataaaattaaattcaaaataatgaaagatagtttttatgaagagaaaaagaaagaattcattgaacgatctaatgaattta

SEQ ID NO: 32248 - DNA, 1440 bp, Heterodera glycines
ccaccgtgaggcgggacagttccaaaatttgtaccacattttactgtggaaagtccaagtaccttaaggactacagaagagccaattacagcagtcacctttggacagttatgtaaaagaaataaggaaatattcgatggggtgcgatcctttcaaaaaattactctcgtcttctaccctccctctctttttgtgcactgtttcgtttaaaaaattggttccgaaattttttgactctaagaaattaaattgtaaaaattcaaaacttaaattctcctctgaagttttgaacttggctctatcctgcttttaagtcccaccgtgaggcgggacagttccaaaatttgtaccacattttactgtggaaagtacaagtaccttaattggacaattacttgtcaacgaacacagtcgcctttggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaagaaattaaactgcaatttttagaacaaataattctctgaagttgtgagcttggcttttcaatgtttttaagcccaccgtgaggcgggacagttccaaaatttgtaccacattttactgtggaaagtccaagtaccttatttggacaattaattgtcaacgaacacagtcgcctttggcctcttatggagcagaaaaggggaaatatcagaaggggtgcgcgtcccttcctaaaaatttctcttttcgtctaaccatcccccctttttgtgcactatttcgttttaaaaattgggaacattttttttttgtttttttgaaactaaaatgtaaaaaattttaaaaaattatttctgattttaaataatgcttctgtttcgaatcttttgactctaagaaattaaactgtaatttttagaacaaataattctctgaagtttttaacttgacttaaccatgtttttaagtcccaccgtgatgcgggacagttccaaaatttgtaccacattttactgtggaaagtccaagtaccttatttggacaattaattgccaacgaatacagtcgcctttggcctcttatggtgcagaaaaggggaaatatcagatggggtgcgtcccttcctaaaaatttctcttttcgtctaaccatcccccctttttgtgcactatttcgttttaaaaattgggaacatttttttgtttgttttttgaaactaaaatgtaaaaatttactagaattattttgattttatataatgctaaaagttcgaatcttttgactctaaggaattaaactgtaaa

SEQ ID NO: 32249 - DNA, 1540 bp, Heterodera glycines
tttttactttagtttttgaaaaatttattcgtctatctttttaacttccagtggatttttttaattttacgatttgtcattcgggtctcaaaaagccaatttttgtatctcgggctaacccaacagactcataaattaaaattggtttcagtttccccagacataccgggtcggccattttcggcagcacaaaattgttcacaatgtcggggatcagtggttccatttggcgcttgcatccctcgccaatcgtggaaagagcgcaaagccccgcatgacgacacttccaattttcgttgttcaacagttcgttgatgcattgcaacgcgtggttcatcaccgcctttccgccgagtgcacaagcgattcggtcgagtgaagtctccccaattgttgccgtttcctcctccaattcgtcctcggcgtcgtccatttgcaaccactcgtccaattcgtcgtccaactcggtcatcaactgcagacattgctggactgaaatggactggataagaatgggccaaatgaaagttttcactcactcagcggtggcaaatacagcgctcccttttttcgcattatgttggaactttcgcagatggaaaccatcacttccaggccacctaaacattttttattctttatccaaaatgggaaaattgtccactatgtctgtacgattcgtccttttctttattggccacagtccctaaaacacttttgtaaatccgagtgccgttctgcttgaaatttgtttgcaaaacctgcacaaagcgaaaaaatgtcgctcatgtgaggggcgagaattttgggaagagtggaggccaaatcgcccaaacattgcaaaggcacatctttaaaagttgattaatgagatgaaatcggaggcactgggcaccgtcgtcgtcctcagtgtccacgacatgttggcacactttgatgacggcagggaccaagtcggacagttggcggatcacagcgtcgttctcctcattgtcgcacacaaacgcaacataggcacggacagcggcagtccgcacggaactgtcggcaccgtaaagcagcgaagaatggaacattgtctgaacaacaaacagttttgaataaaacgcggaatcggggctgtgttgccttaatcccggcaatgtatttgaacgagtcggagccgaacacatttggcacactttcaatgagcgacatgccagcctcgcgaaaggtgggattgtccgaagttgcgcacatgtccaggaactgcatgatgccagtccacgtctgtttgccagttttgtcgtctatggaacccaaaattagaatgggttaaattcagataaacaccaatggaattccgcgcaagttccgccaacaaatcggtgagtcttttgcgcaaaacgggctccgtttcaccattgatacacacaatgaattcgttgtgaaattggtccttttgaatttgagtttctgtgaagaattcttcgtaggaattcgacagcaaacggcgcagaagaaccaaagccaaagagcgagactaaacggaaggaacaaa

SEQ ID NO: 32250 - DNA, 1429 bp, Heterodera glycines
  misc_feature (1263)..(1263): n is a, c, g, or t
  misc_feature (1361)..(1361): n is a, c, g, or t
  misc_feature (1386)..(1386): n is a, c, g, or t
atttgaagaaaggagctcaaaaaacgcatttccgcacattttttttcgattctgatgtcattatcggtcactagaaatctctattttgggattttgtcactaaaatagtgaaaattcactattttggagttttgtcactattttttcactatttcgacatttttttggaaaattctttaacaaaaatgcaataaacccaaaaaatacacccctaagaatcgacaaaaaaaatttcaaaaaaatacacccctaagaatcgagctaaaatttttcaaaatatactcctatgaaatgaaaaaaaatttctcaaaaaggtattttcgtggcaagaattttaattttaaaaattatttttttatgtacctattttgtttttttgcccttaaaaatcccagtcctactcatttgcaatgcaatcagtgaataaaaattatttttgcttaatttttggctgaaaattatgtcactattcgtcactatttcggactttttgtcactatttcttcactattttggcatttttactcactattttagttaactatttcgggatttttcttcactaaaattcacgtccctaataatgagctttagaagtgggcctgccacaaatcaattgggctaaaatcatatttatggatacgtaatattctatccatattctggcgttttcccaaaaattctattagaacagagctctattaaagcggccctctgaccattaaggaattgaaaaaaattatggaaagtttcttaagaacctgtttgataattgaattcaaaaaataattttgaaaaacatttttaggacaaatcactttcggatttgttaatttgtatatgccaggaatgtgacggcttgccaatttctgaatttttaggctcgattttcgattgcagaatttaacaaagcaaaacgaaggcttatttctaaaaaattcatttttggcgattattttcttcactgatttgtgagaaactttttttctgaggggcgcccacttctaaaagagcatgcgaaatatatttttttaaattattttggtgatttttttagattttggttgaacgtagcaacgcagaattgttggcaatacaaaatgcttttgtggcattgtatggggaaacattgaagaaatgtataagaaaaaaactgcatataaatggggatttttacatgttgctgctcgatttaattgacgcaaaccgtgacgaagtcttttgcaatgatgaggaaatggcaactgaggcaaaatttattanaatttaaaaaaatattaaaaaaggaaaattggtttatttttattagtgaaatttggtttatttatttattagtacttattaacattttaagactgctngtacgctgtacgaggctggtggtanaaggggcggaacgcacgaaggaaaatttatacgcatttttgca

SEQ ID NO: 32251 - DNA, 1070 bp, Heterodera glycines
ggggaaaaaaaaattttcaaaattaaatcccccgggagaagggagggggaaaccaaattttcaaaattttcaattttttctagttttaatctactcaaaccggttcagaaattcaataaaaaataacattcacggggcgaaaaaatgggggttgaaaagtttatttgaaaaaaaagactttacaaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaagactttacaaaataatacccctgggagaagggagtgggaaacatgatttcaaaatagaagatgttttctagtctaatctactcaaaacggttcagaa

SEQ ID NO: 32252 - DNA, 1197 bp, Heterodera glycines
  misc_feature (148)..(148): n is a, c, g, or t
  misc_feature (188)..(188): n is a, c, g, or t
tgccgaacagactgttcatgtccagctggtcgtggaaatggcctagggcaaaacagaaattggcgtaaataattaggcaattagcgattgaaccgtatgacattgaaaaaccccttttgctttttttacttacagaataaaatatttntaattaattctaattaaaattaatttatcatcacaaaacncaccggcataattggccaattgattcgcggcaaaatcgatgccctgcagcaacgccccgttgagaccagccgccgaatgctgcgcaatttggtgtccgatcactgaacaacgaacgattgaaaatcccattaaaatcggtcctttttaaaatattttattttaaatgatttcccttcgatagaccgtattttgcgttgatcactttcagctcactcactctctcttctctcaagtgaccgtatgaattaatgaatgaatgggtcgcaacaactgacaccttttaatgtcacacttttgcgcccctttgcccccgggggagcgcccgatttttgtttggtttttcattttgttttgttttattgtttcgtttttttgccaccattggtgcctcggccgcccattgtcagctgctcactttgctgctgttgtgcgctgtttccgttgttgcggccgagcaaattgttaatctgaaaattgttgagttattttttaaaaaatatttttaatttttacattttcgatggatttatttaatttattttaaattaatccaatgccaattctttcgccataatttccctccccatctccaatttcgtctgttttcccccaaatggcttttaagcgtcgcaccaatgccgcgggggatgcgcgtgccaattccgtctccgagtgtcctcctctgcaaatgctcgactggccccctgggtgggggggggagatactgccgctcatactgactaccccacaagttgcctccctaaaatgtgaatgttgtaaatccaaatgttgtatatttagtgatgcttgaggccagtgaggcaatctgggcggcagtccaactgagcggaatgggacacatattaagacccgctacaattaactaccgaaataatactgagcgcgcacaaaaaaaacatataataagttctgataactggctgatttttgagagaccacaattgcttataaaaaaggaaatccttgttacgatgaagaaaacttgga

SEQ ID NO: 32253 - DNA, 673 bp, Heterodera glycines
gttcgaggtgcgaataggatcgaaatggatatcagaatcggattcatcgacccagaaaaccctagaaacgcctttttcgcaccaaaaaaaatgaatttttttttttcaaaaaggtgtgataccatctaaactattacccaaaatttgtttaaccaattgacgagtgatcactgtttgacttttccagtttttatacaaatttagtgaataaatctcattgtcagaacatgaacagatcattatacatagctattagttgcaatcgcatttttatatttgcatttttattgcatttcgctaatttataacgttcttttttattgcactaatgtctaacaaaacgaaggaaccgcttgctttcgtcactggtgtcgatgataaatgtgtgtttatttggtcttcagaatatccgttggaagaattacgctttccagtgaaattgggtgcacaaagggtgggtgtgatcccgtctgtctttttcaacttaatctgtttcagcccgaattgggtcaaagggttcaatatgtttgcacaaaacctccacatgaggttcaatatagcgggatactcaaaagaatcgcgaatccgtcacccataataattctgcgtgatggtgaatttgtggtaatattagggttttagtctagtacagacccataaagaccttttcctt

SEQ ID NO: 32254 - DNA, 1064 bp, Heterodera glycines
cagtcgtccttccccccgtattgtttcttgctctcaacaattaaaaaaaaacaaattttttttttgtttttctaatttttatgattttcagaaaggtttttcttgaatttattataaaaaattttaatgtttttttgattccaagttttataactttaaaaaaatcggcgcgtgaggcgggggggggggggtagtgaatttacatgtcggcgaatcattggggttttggatagcaattagaaggattggcccgtttcgatattgggaaggggatggatggcaacttttaaaagaatttaaaatatgccattttatagttggaggatggtgaaattgttatgccggttgatgaaaatgacgacgacgactacggtgtcttttattctgctgagggtgtcggcgatggcgcattggcggaccgcttcgaagacggtgagctcgtcgatgacgggccgtctgtcatcccggcggaacggcaccgcgcggagggcaacaaacgacgctgtgccagtgccatcggcgcttttcggcagcgctcagcgacgacgacggattgcggcggggatgatgcgcaaacgcaacaacggcacgtctttttccgatcaccgccgccctcgcaggcagcacaaattggtgagagaaagtgatggagagacagagggagagaagagagaaacaaggagggagagagtgagaagtgaagcgggagtcaacgaaaaagaaagagtacataaaagagagtgaaggaaatggagagagagagagagaagtggtgagaagcgggaatcaatgagaaaaggaatagtataaaaagagagagagaaagagatggaggcagagagggaccaagagttgcggtgggggtcggtttagtctggccggtttagtctggccggtttagtctggccgttttagtcagggggtcgttttagtctgacaagctgtttttgtcccacacggattctgttgtgattttttcgaaaaatggaaatttaatatcaaaacatatttatcaatgaattccaacgaaaaagtaacaaaatattgaaaaatggttaagggcg

SEQ ID NO: 32255 - DNA, 661 bp, Heterodera glycines
ggtgctgggtcattacttaaaaaccatcattatgaaaatttttgtcgaaaaattatttataactttgctcgaaagtaaccaaatttttaattgatagccctaagtgttctctatcagtctgcaaaatttcaaaaaatttcgttaagtttcaaaaaagttatagctcgaggaactcaaaaaacctttgattttcgaacatttttggccataactttttttaaacttaataaaattttttgaaattttacaggctcataaagaacatttagatctatcgaatgatagcaaggattaaaaatttgggctttttagagcaaagttataagcaaaaattttcattatgatggttttttaagtaacgcccattatgatggtttttaagtaatgacatagcaccaaccaaaggggggggggggaccattcgtgaagagagagagagagagtgcagcagagaaaaagaggccaagttggagcggaggaagagaaaaatggtggaaaagagtgtaggaaataacgtgaaaataaatgatagaattttggtttaattgaattctttttaaatcaaattacgataaaaaaaatttgttaaagatgaatttcattcattgtttaacaaatccatctaaaaacaagtcaatataaaagcctattttataaaata

SEQ ID NO: 32256 - DNA, 1527 bp, Heterodera glycines
  misc_feature (1403)..(1403): n is a, c, g, or t
  misc_feature (1430)..(1430): n is a, c, g, or t
  misc_feature (1444)..(1444): n is a, c, g, or t
  misc_feature (1450)..(1450): n is a, c, g, or t
  misc_feature (1456)..(1456): n is a, c, g, or t
  misc_feature (1520)..(1520): n is a, c, g, or t
tcgttacttaaaacaccatcattatgaataatttttgtggaaaaattatttataactttgctcgaaagcaaccaaatttttaattcttgatatcatttgatagccctaagtgttctctatcagtatgcaaaatttcaaaaaatttcgttaagtttcaaaaaagttatatctcgaggaactcaaaaagccttgattttcgaacatttttggccataactttttttaaacttaataaaattttttgaaattttacaggctcatagaacatttagatctatcgaatgatatcaagaattaaaaatttggtctttttagagcaaagttataagcaaaaattttcattatgatggttttttaagtaacgcccattatgatggtttttaagtaatgacatagcaccattccaacatcttaatgaaagcttatttattcgaaaaatttagataaaaagttctatatttaaacaaactacaatatctttttcaataaattttaaaataaaaataaattataaatttaaaattaatatacagaatggaataacaatctatacatttaattttaaataaaataattttatatattggattttatgttaataaaataaatttatcagatgatcatattcacaatgctaactatccgcaaataattcgctagctgaagataaatccatattcacaatgatagggatagggtatctacagatgaaaatccttagcctcctcccgaggaggttaatttctaaagattcgagtattattttgatgtccaaataaattttggagtatgtttaaaatttaaaattttttattgaaacttcaaaacctttaatgataatatttttattttttatttttaaataactgatttagagagcacttaatattgtataattttttgtagtcaaactatttatttaaaccaagtctttgcccttttagttttctttataaaaaacactttaatttccttatttttgatgctaaataaaagacaattattaacaattattattatggttgggaattttaggcataaaaccacgaaataggcacctaaaaaggcagacaaaatcgaaaataaattggttgttttggtttttaaatgtcaaaatgacgagtagttatcaaacctaaatttttttaatgtgatttgttttttgtttggcccaaatcaacgctattgaaaatatctggtacgattttttaaaattaatttccctgttgataatatatgaaaaggtttaatttttccaaccttttccgggctcggcaaattcaaaatccggtttgaccggcttgggagaggacgagcccggaaatcggttgatttgaaaatgtcggtggtctctcgtaaaacaataaaaccacactttagactaattgctttaacgataagcnaatcatttgggtttaaccctttaactnttttagataatgcncaattnatttgntgatcagtcaaaatcaaacataaacaatttgtatcctttgcgtaaagtttgggtttgtcctggntgacaaa

SEQ ID NO: 32257 - DNA, 1153 bp, Heterodera glycines
gttgacaaatttgtgcaatttctcggtcaatttcattgtttttctcaaaaatcgcgtgccttgtaatagtccaaccaccggtgcgcagaaaaatgggatgatttgcaatgctccgacacgacatttctttcctggcaaatgaaaatttacaattcacaaataaaccaccaaattcaaacacactgaccttgtgaaggcattggtaaagtgaccttaaatcatttgaaaaaacattttcaaaatgttcattttctgctgctctctgctcaccacatggactggatggagacgggcttgaacaacaatttgaacgagttcggctgtttgtcctcctcaattttgatgccaccgtcgccgtcaaggcaaatagtggaggaagtgctgatgggcacggcaattccaatgctgtaaagagaaaactcgtcaaattttgtcatggaaaatttgtcaaactttgaattttagtatgtttttaagcaaaaggggagaacaaaacccgtcagataattttgccaaaaattgcaattcgtacgcgctgcgaggggcggtggaagtggacggcccaatgaaatggaagccgagcagcgcagcctcgcgcgactcggtggcgtcgaattgggtggagaggacggccaaatagcgcacgtggggcgacgagggggagacgagggaaggcgactgcaaacggacgaccctaacaaagagcgaagggatggttgggaagtaaacaaattttaagatttgctgagtgtttttcatccaaaaaatgtaaaattcccgcgactttaagcattccttatttatccgacggtggcttttgtccatagatcacaaatggcatacattgtcagtgagtcctccggacgcaaagcattgagcattacgtgcagatgagcctggatactgtctgaaaaaggactattgcatttcacacgaccacaaaacaaattggcaaatttaatacacaatcattttttctagaagcatccaaaataatcattcaatagctctaagaattctctattagattgcaaaatttccaaaaatttcgttgctttttaaaaaagttgtggccgaaaatttggggaaccttcgccgccctctgcgtttgttcggtttgagcagcagcggacagccaacgacgcggacgact

SEQ ID NO: 32258 - DNA, 1127 bp, Heterodera glycines
acatgttttagcttggtttgaagcttctaggatggacttttatatccatatttttccatatttcgcgatttatgtccatattttggcatttttctacaaaacccctattagaacggccctcgtcagctaaattggccgttttgaccccaaagactggaaaattttccgaaaaagacattttttaacaaaattttgtcgaaaaaattgattaaatttaaattttcttagaaattggttatttatgtcaaaaataagcaaaaaggaaaatttcggtttttttttgttggttttcattaaaaatagctttttttcttttaaaacgagttcttataccgtatttagccattttagatgtattctaatagaatttaatgaatttgaagaatatttttgaaaatttacccctcaattcggagaatttatgtccatatttttgctattttatgtccataaaattgcggagaccacggcggttaagctacagcagaagaaagatgaaaattggaacaacaattgtaacaatgtgttcatttggctttttagtggcactaattgcattgggtgagcaattaaaaaaaacatttgatttttatccaatttgaattttgcgcttaattaaggcctttgtctcctccaccggcagaagaaacgggacaaagcatcacaaaagggcgaaatgagtgagggacaaacgaacaaaaacagtgatcagctgaagaagaaatgaattaattaagaaatgaccgaccgatcataattaaatcagtgatcaaatgccttttaaaaaaattttctgaaaatttttggggtctattcttagggggtctaaaaattttagctctatttgtaataaattgtttgaaatttgcccgaaattccctgagaaattcatgattttttttaaatcgttaatgggatttggggaacaaactgtgctcctgcaaacccacgccacaacacaaaattttttgcctatgtaatcgaatgaatgcatttttctttcgaaaattgtgtattttttaggattttgacgtggatttacgacatccattagcaatattagcaccgccaaattttaaaaagtgtaaattgctgccgtcctctctctttcagcttcatctctcttc

SEQ ID NO: 32259 - DNA, 1364 bp, Heterodera glycines
aaaataaaaaagttattccagaatttctgccatattcggattttcagaaaaaaattcagaactcccttctgaaaagtcattctgtaaaagtaataaactacaaaaatccgcaatttttttctctataatataaattttattttacatttttatctcttttttgcgaattgttataaaaataaaagtgatttttggtttcgggaccataggggggtgaccaggatttttgggtggaaaaattttttcaccgaaaatattccaaaaacatgtctttaggggtattttatgacgctgatcacgaatacgtgatcagattttacttttgacatcgttcagacctcagaatccctgtgtgattggggattctggggcatcatttttttgggggggggaggaagttcaaatccgggcggtgtacattatttttctgtgcattttttgttacttttacatgtttttattaataaaaaatagatttcttttattaataataaataaaaatgtttaatttgaagtaaataattttggtaaataaatgtattaatttaaaattaattattttttatttttaaattaaagaatttatttgttttttttaattagaatttgtcaaaaatttattttcaataaaataatactcaatcattgtaaattcaaagtttatttttaattaataaaagaaagcattttttaataattttttaaaaattattaatacatttttttaattatattttttcataaaccatttccttatttgtttaattttaaaatcatgattttacactgttaaccattgttgtaccatttcacaatttttgtacacctctcctaatcactgttgtaccacttctaatcactgttgaacctcttctaatcactcttctaatcactgttgtacctcttctaagcccaacaaaattaaaaacgggcgcgaagcgcccgtccaaggccaacaaaaattgaaaaacgggcgcgaagcgcccgactgaggccgcgaagcggcctaacaagctaaaaaacgggtgcgaagcgcccgtataagcccaacaaaattaaaaacgggcgcgaagcgcccgtccaaggccaacaaaaattgaaaaacgggcgcgaagcgcccgactgaggccacgaagcggcctaacaagctaaaaaacgggtgcgaagcgcccgtcttgagcctcgatgtggactaaaaacccctaataattttttaaaaattcaaaaaatctctccaaccaattaaaacgggcgcgaagcgcccgttcgaggccatgaagcggcctcaaagccccagataattttttaaaaattccaattctccacaaagctgcctaaaaatcccagtgtacctcttctaataa

SEQ ID NO: 32260 - DNA, 994 bp, Heterodera glycines
  misc_feature (70)..(70): n is a, c, g, or t
tcatcggaccatcagagcagcacggacaatgaataatgatgaacaatggcacttttggatcaggaccacncattaaagggaatttggcaataaaaaagtacaaaatctatacaaattgtccaaaattgaccatttgtcagcgatgggacacaatttttggaattttgcaattggcaaggcgcaaaagaaaggtgaacatcctttttggtggatgaacatataaaataattaatcattgggacatatgttcttctcgaattgcccttcccattttatgtccccgggggacaaaagcgtttattctccgccccaaatccgccaaatccgcacccattcattattttgtttccattgttattgtgcctcggcactttcaaacactcggaatggccgtgccgatatcgggcacctgtccattcgtggcaaagcaaattacggcccatccatcgattggaagtctcgaatctctcccgccctccgttttttaatctcgcatattaattttttataaattttgccaatatgcttctcaaaatagtgattaattgatgaataaatccctaaatcccatccccttggtcctttccccttccccccccccctcccattggtcccctgttttgttttgttttgcttgtccatttgttccttcccagctctctctcatttgctcatttgtctgtccccaccgtttaagcatcattaaacttgcgcgggtcgatccgtcctttttcaacgcctcaccccacaaattccctcactcgcattgatttcattttttgtgaacaaacacgcgcaatttttaatccacaactttctgctgctttcgatcgctgtcccatcatttgctggttgtggtcccatttgtttccaatattcaatttcattacgatatcccccctcccctccaaatccctcgaaatcccgcggattttcttattctccccgccccagtccgccgccgtcattccccttacaattcaccccctccccc

SEQ ID NO: 32261 - DNA, 1083 bp, Heterodera glycines
gaggaacagaaaggggaagagagagtggaagagggacagaaagcggaagagagagatagagagggagagagagtgggagagagagtggatgagggacagagagcggaagagagagtggaagaggaacagaaagtggaagaggaacagagagtggaagagaaagtggaagatgaacagaaagcggaagaggggaagaggaacagaaagtggatgagaaagtggacgacgaacagaaagtggaagcggaacagaaagcggaagagaagaagaggaacagaaagtggaggagaaagtggaagacgagcagaaagtggaagagaaagataaagaggaagaggaagtggaagaggaacagaaagcggaagagaagaagaggaacagaaagtggaagaggaacagaaagtggaagagaaagtggaagaggaacagaaagcggaagagaagaagaggaacagaaagtggaagagaaagtggaagaggaacagaaagcggaagagaaagtggaagaggaacagaaagtggaagaagaacagaaagtgtaagaggaacagaaagtggaagataaagtggaagaggaacagaaagtggaagagaaagtggaagaggaacagaaagtggaagagaaagtggaagaggaacagaaagtggaagagaaagtggaagaggaacagaaagtggaagagaaagtggaagaggaacataaagtggaagagaaagcgtaagaggaacagaaagtggaagataaagtggaagaagacagaaagtgaagaagacagaaagtgaaagaggaacagaaagtggaagataaagtggaagaggaacagaaagtggaatcgaaagtgtaagaagaacataaattgaaacagaaagtgtaagaggaacagaaagtggaagcgagagtgtaataagaacagatagtggaagcgaaagtgtatcaagaacagaaattgaaacataaagtggaagaggaacagaaagtgtaacataaagaggaataggaacagaaaatggtagcgaaagtgtaagaagaactgaattgaaacatatagtgtaagaagaacagaaattgaaacagaaagtgta

SEQ ID NO: 32262 - DNA, 1581 bp, Heterodera glycines
gagcaaacacatgttttttggctgcctttttaaatcattctcacaacctatagtacaccattcaatagagtttcaatagctctacaattttactcagaggaatttttgctttttctattaatagaatagtttattgcttttttgaaaaaaaaacattcaaaaaaaaaccgaaaaattttcttcggttttttcgatttcggttttttaaccgaaaccgttcgaccgaccctcttgtccggtctctatgcctcccttctaattgggtaattagaaatttatccatttcgcttaatttgttaatttgtctttcttctgctctccctcccgccccaactgacaacattcgctgccgtctccggcacattgcatcggtcgatagtatttgccgtcctcgtcgcactgggcaatgccttcgtccgtcgcccttcggtcggcccccgcggcgttcgcttcgcgcaacgaacgaatgcgcttttgtccacacgctgaaaccgcttcaaatggtccgctccttcttaggggtcactgactcgcgcagcattttccctccgcgcacatttcgcccccgagggaacagtcgccgtcactccggcaaattctctcccacgccccgccgtccgcacatttttcagctgccgaattttgtgaaaaacaaatgaaaagcgaaggaagtgcaaattgccatttgaatttgcacttcgatttcggcgagtttaattacccccgcgagacaaaggacagcaaaaaccacgcgaaggcacgcaaaattcaccagaggaaacagtcgaagtcggaacggcaaaaaaaggacgaaaaacggccggaatcacagcggaagcaaacgccacgcaattcgcagagccctaatttgtaagcgaaaaaacaaaacgacaaatgatcgaaagcaatcacaaaaagagataaaatgtcaatgccaggggcatttcggcacattaactcactttgagacattcccaaaacgacagacaccccccccccccaaatcttcggctcaacttctcaaatccaacctcaatccccccccgccctcccattcattcgactcataaatgcataagccgcacgtgaaacattggccttgaaccaaagaacagtccgtccctcggctgtccatttgactgtacagaaaaaggatccctttcttcctgagagttcgctttgaagaaatataattaaataattgactaacaattaattattccgtgcttctcctaattatcaatgcgtctttggctatctgtccgttcgttctctcaataattcttcggctccctccccatttttctcaacacttccgccgtgctcacaaatggctgtgtgacggttgcgtcggcagtcgtcccgcgcaccgcaagcggcggagtgttggcatacaaatcggagaagagcgcttccggaggtaaaactgaaaaaacaacaaaataaggtggaaacaatgaagcgccatgccttcgtctgaaagtgcgactttgaccgcctcgtccacctcctgacgcactttcttgtcaatgtcctgcggggatggaatgaccattgatttgtgtattcattggcttgcaa

SEQ ID NO: 32263 - DNA, 1109 bp, Heterodera glycines
cgatctttaaatattaatggattttatttttcaatttctaaaataaacttctttttttttgccagacaatcgctttgtgcagcaggacagcacacggcaaatgatgcgcaaccggcgcgaatgggctgtccaacggttgttcaggcattatgccaatgtcggtgtgccggacccaactgtacggttgggcgaaattctgctgttgctgcctgagttggaggtgttacaatatggggactcaatttgggaattacgatcaaatatcgacctaaaaaagcctgagattgggccaaatcaataccaattaatggatttttttgatcagatccccatatgcatgccaaataactatgatcagtccaaaagagtaccggttgggctcaactttactgtttcgatcagcaccgattgatctagctcgtttattagggcaatgatttatgatcaggataagttgccattaggagagggataattagaatattttcattttttcgatttttattttggacccattacctcttaagcttcttatacgaaaattatggaatcaatttatttgaatttttaatcaaaaaagtttttttgcgctcaggtcatctgcgatttgcactgcagggatttccaggtggcacaactgttcgagtttggcaacatgtctgactattggtatgaaaattatgcatactgtgccatgaatatggtcggatgatcagcagcaagcagaattgtctgtaattcagcaatatattttgaatccggttaattgatcagagatttgccattgttttttttaaatttttttattttaggttcagttttatttaaaaaaaaattttcctaggctttagggtttacgtcaattacattaataataaaactgttccattgtttcgttgtttcgaaatgaaatagaaaaattctaaacatccattgacttccttttttaatttagtctctggtgtttatttatttaagaactttcatttctggcctgaaaagaatttaaattaaaatcattttaaaaaataaaaagaaaaaataacctaaaaatagaattgatttttgaagattatatattcttttttaaattttttgatttaatttta

SEQ ID NO: 32264 - DNA, 1148 bp, Heterodera glycines
gcggatgggaggggtagagtgggtaacgcgtgcggttgtcacgcagaaatgaatgcgtgcgtctttgtgtgagtgttatgggtgtatagagtgggtgggaattaaaagttagagaagaggaaaactacagagagagatgaaaaaggaagcgagagaggggagagaatgaagagatttaaggaaggggtgagagagagacagagaaagagaagattctgcctttttggacggaaattgttggacattttctccgtttccgcttgttttctacccagtaaaatttacttttttttcctgcttcgttgatctcaagattataaggactttttgaatggagcatttgtcttatcctgaaaatttttttaagaaaattgatcttttatgtttttcaaatttttcctaagtctatccatccctcccaaattgtttgtttaaattgtttccgtcatttcagcaaatgggttcgccagtcctccttttattacatgattgtgggcaacttgatcgttattgcggttttcgcggacagggccttaacgagacggtactttggcaagaagatggagccgatggcactgccctcgtggaatgcttttgtgaaaacggagttgaaagaaggcagggaactgacgatgccaattagcgacgacgaaaaattaattaattaacggacgattggttttgttcctgcacattttacaacttattatttcttttttgctggtttgttctgcacatttattcaagctgttctattgaatttaggctttcaacaaaaatttatggaaaaataaaatgaaatataaaaatcgaagattttttctgggactgtgaaggtcgcccgatggcgaatatacccgtagctggaaactagacggggtcgggatttcggcgctagtctaaaagttaccacttttgaaattttcacttttttggtcaaaattttttttattttttttacacataatgatgaatattaagtattaatagcacaattatggagaataaaaagtatattcacgatttttaaccaaaaaaatttttacaaaacaaaagggtcccccttatggattttgataaaattcaaaatctatcactttataagtagagcctaatttggttaacatgtgcacataattgtcatattc

SEQ ID NO: 32265 - DNA, 934 bp, Heterodera glycines
tggtcataaatttgactattttttgcttttcaaaaccgcctttttcggacaattttttcaaaaactaggaaaaaaggggtccgtctatgcagataggcgccgtctgaaatttttttttaaattttatcaaataattaactgattttgaccaaaaaatgaccaaatgttacaccttttgactcaatctacaggattaatgtcgatccagtggtgtcgataggcgccgccgggaaatttttttgcaaattctaggtgaaatttgacggtcaggtcgttttcgcgtgggctgttttcgcgtggtcgttttcacgtggggttcgttttcgcgtgggggtcgttttcgcgtggttgcatataaaagataagtcattactagagtggcgcgacgccgagaattatgataaaaagcagttgaccatgacttgccaggtgatcgggtgtacgccgatctcgcaagtccacttgttctaacgtggacggctatcacatttgccaaaaactattttctgaacctaaaatctcgataatattttcaacgacaaaaataatggaaagcatttctgtgtcttaaaaaaaaattatcgcaattttttgcaaaatctttgaattttgtatacaaaaaatttttgaattctattattataatattgagtgcgatgcaaagatcgtcaatatatttttttaaaagtatggcattcccgccaatagtgccgtgtcgattaccccagggatttgttagaatcacattcgaatttaatgattattattcatcatatttaaaatattgattaattttattcagaaaatgaaaagagtaatttataatttgccatttcccaattatcgccagaaaattgcatgcaagcgaacctcagtttgtatgctcttaattgcacacgctcttcatatgtttcttgacggggtaaattaattt

SEQ ID NO: 32266 - DNA, 1400 bp, Heterodera glycines
ctccctccttttttcttccattcgtcccccctcctattctctctcttcgtgctttatttctccactctcatttcatctccccctcttcctctttcccgcatctccgctttttctccccatttcctctccccatgtcccccgctttctctcctttctgcgccatttatacctttgtcgcccccaattttgtttttaacttcatcttttttttcttatttttgctttcaacgccaatatgtactatatatattgtggctttttaacaaagtcttattttcctcttttctcgctttatttttaaattttcgtcagttttttagaataattacatatttagatttttgcactaactttttttattttttaaatattttggcgctttttctacataagtcatttacttcaaataacataattttcttcataaatatttttctccatcacccgcttcccttcccttttttgtttattattttcccttcggccattttaaccgcttgccccttttatgtccgtccaaccctttgcatttcgttttaatattttttcatggttagttaaataaaagttaattttgaaacattaaataaaaacatcatcatacataatagcagaaattttgtttttctaaattttcttcattttcactatgcatctgattccgcgttttggaaatacgcttctttcaatgcatcagatgcggaaattcgttcgttcggccgaacattgagcattttctgaaaaatgtatttttacttctttttaaaaatataaaaaaagcccaaaaaattgtaaaaaatttattagagtctaaatttataattctattttatgctttttttcttgcaccatttcgtcccgcttcttttgttcaacaaaaaaaatgctataaaaaggacaaaaatactaaattcccctattcgtaatttttgctgctgctgcccccctcccttttaaaattcaaactaccgctagcagctgcactccggcaatgccgacatcgacaccccctttcaatttgttactaagctctcccctgaccaagggctggtccatgtcgtccggagaacccattatgctaaaataagaaaaaagtttaatgattttatttatttttttaaacctataaatttttcgcagctgtatttccacttgctcctttcggaaaagtggcttacgctgtatcatttcataaaatatacagcccacgctccatatgtctatgccaaaggcatatttgtagctgcccaagagtaactcaggcgctctataccaaaatgtaactacatcattggaatacccccggcctgacgcgcgcggtgatcgcgcaagacagaaagcgtcagtttttgtgcgagtgaggggcgtctaggggttgtggggaatagtgagtgacataa

SEQ ID NO: 32267 - DNA, 752 bp, Heterodera glycines
ttaagatagacctgccattgctattcctgcaaatacccttcctagtccccccaagattgctattcgaatggtttgtccctttctcgccccccacacaagttgtgctgcttcttgcaaagaagacttagccaactgtaaacagcaagccatcctcctgcttcaatgtaaaaaaaaattacatttgtatgcaacctttatttttcctctcctctcttttccaaaaaaaaagatattatcaagcttgtttgaaccaattctaaaaaaaatcgtagtaattaatttaatctagactttataagataaatgagaatttaagcgaagcactcatgcaaaataataatctatagaaattctctaaaaagtagttcctcgcagattcggagaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatcgacctgccattgctattcctgcaaatatggagtctagtcagcccaatcgattgctattcgaatggtttggggtcgttggcccaaacaaaagttgtgctgcttcttgcaaagaagactaagccaactgtaaacagcaagccatccaaatgcttcaatgtaaaaaaaaattacatttggatgcaacctttatttttcctcccctctcttttcaaaaataaaa

SEQ ID NO: 32268 - DNA, 772 bp, Heterodera glycines
  misc_feature (731)..(732): n is a, c, g, or t
aagtgcgaagaaaaacaaaacgccaaagacggacccattgggcacaatctcctcattggcacacactgtcagcccagtgggcaaacacagcaaattttgagtgtcttttgtggtgaaagaagtgcctgaaatgatcggagaggtcaaaatttatcaatgttaattagccggctaattaattaattattcaattgcctgcggcaatgtcaaacaaagccaacggagcaaagcaatggcggaggagagtaatctgaaaaggggaagcatagctcatttgttcaaaaaatttataaattagcaagggatggaaatgacaaaaaatctgtatttttgggttaataaaacccgagtacagtatttctggggggtttggggactgactttgtcgtggtcactcatccactctttcgtttcgttcgttttcttctgctcttccgtcgtcccaagcacaaatttggtctccagcaaagacaattctctgatataatcgaccgcctcaaaattccatttcaaaaaaattctttctttgccgtgccgtgcccaccttcgccagcgtacggtacttacagaactccaattcgtcttctgtgatgcgacgcaaccggatacagtaattcacctaaatattcattttcattttgccggggatacagtggaaaactgtgcacagtacactcgcctgtgttcggaaacggtccaaaatttcggggcacaaaaacagcgactccaannccgaagtggccctttggcgcttcgttctcactgaaagtcg

SEQ ID NO: 32269 - DNA, 1655 bp, Heterodera glycines
tacttttccattatggtacaccccgaaacttcttttcattatatttttttagacctattttaagcgctgaaaaatccggcattgtttatttaatttaatttacaagatttctggtttttatgaaaaatttagcaaaatatttttaaaattttgggtgagattttcgttttaagaaaaattaaataattgcagctatataaattccttttggaatttccgtcctattagaataaattaaattaatggacttattatatagtaaaaaaatatattataaaaattttaaaaaacgaaagccaaaacttaaaatatgaatgagaaaagcagtaaaaatttttaaattaaacatgtatggtttttataatgaaaagtgaattttctaattaataaatattttattattaatatgaaaattttctttaataatatttaaatttattactttacttaattgattttataaaattaatcgataaaagacatgagaaaaatcaagggtttgatttgatgggtttttgactaacgccctttttgatggtttttgactaacgtcatagcacccgccagaccccttgttctcaaaattttaccttgaaaaagcgcgacgcagaaaatttttattgattttttctttcgaatagaaaattttcatatcgatttttgaacaattaatttgtccatcaaatgcatggccaaacattttgccgtcagaattggcgttgtcggcttagaaatgaattgtccctatccaatcccaaacaaattcagcaaatcggaagagttcagatacccgccatgagatgttgatagaattggtgtaagtaaatttaataaaacacaaaaatttggaataaatttttattgtttcaaaaaggggtaaactgaaaaggcatttgaaattttgttcagattgatgactctggcgatatgaaaatcattcaaaagcgtattgagtcgtcgcccaaaaaaatgcccggggtgaatcatattcagcattttgcccgagtgatcgacgcgaagaatggcgcgttgttgagaagcggagaaaggatcaaaataaaaattccaatcgacaaaacggacggatcacttgaagagttcaaatttgacattaatttgatgtacgaaggactcagttcgcatccgatcagtgagttcaaagtgccggcagatcaaattaaaaataccaaatttataaaaaagaaatattttaaattttattttaagttgggaaaacggtcatgaaaatggcgagtgaacaacacagaaagattccatttcagcagttttgccagtcaaaaatttagcgtaagttaaaaaggttatgttgggataagacaaaatagacatgcattaatttattgtctctatcttttcccttcgctattttccctcaatgtcttttcctttctctctgcccgtcgaagtgcataaatagtgaatgttccttacacatttcgttctctccccattcattcgcaatttgccttctctactcttctcttcattcactctctctcttctgacttttattattatttattgtcgataaatatttgtgttctttggacacaacattttggcgcggtcagcgaaggcaattaaatttctgctctaaattttgccagtcctaggcctatttttctcattcattt

SEQ ID NO: 32270 - DNA, 937 bp, Heterodera glycines
aaaattttgaagagctctgcggaacggattagcatcggggttacgagatagaaaattgtcctaaaaagagatagccatttttctgagaattaattcacaatttccgcaactcttgcggtaatggaaaaattttgaagaggctctgcggaacggattagcatcggggttacgagatagaaaattgtcctaaaaagagatacccatttttctgagaattaattcacaatttccgcagctcttgcggtaatggaaaaatttttgaagagtctctgtggaacggattagcatcggggttacgagatagaaaattgtcctaaaaagagatacccatttttctgagaattaattcacaatttccgcagctcttgcggtaatggaaaaaattttgaagagtctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttaaagaggctctgcggaacggattagcatcggggttacgagat

SEQ ID NO: 32271 - DNA, 1283 bp, Heterodera glycines
cccccccccccccccccccccccccgccacaactcaataaattgcggaaaaaaaggaatttgttggcacaaaaatctgacaccaaatgccaaaaaacaaaagcagcacgtacatgttgcgcttcagatcaagcactgcttggtgttgacgattctgcaccaccaacagcatggcaccgtccgccagcgattgccagcgaggccaaaagtcgaacattgaagcgaccgcaacaaattgacggcctgcaaatttgcttcaaatacgattgatttcaaaaaaaaaaattctagaggttgtgggttatggggtacggcagttatggttagaggtagggtggaattccttccggtttctgaaaattttttttaacgaaattccgattttttgagtcaggaattttcatatcctgggtttcattatttatgatttatttctacgagacccagttccgatttggtggctgatcagaattgatcaggcagtcccgagttggtttggcactctgatcagggacaatcctgatttagttcaaccctctgatcagaattgattgggcaattctgaatcgctttgaaactccgatcaaggacagtcccaattttggcactcttgtccaatttatcaggcattctcaagttggtttggcactctgatcagaggcagttccgatttggctgttcagaattgatccggcattcccaatttagtttggcactttggcctaagccccacgagtttcgacattaaaaaaaaatttaatccagagaccttcatcacgcaagaagcattttgtttggtgctgatcacttgtgcttggcgtcgaacagcagaccaactgaaaatggacagacaatttggcaaaaattgaaattttgaaatggcactaatcacttttttggagaatcgcatacagtcgtcaaatttatctggccaattgttggtggcattaaatgcaatatgtcttaatgtgaaaaaataattgtcgaaaatttaacattcgctactacgtaatatataaatattttacaaaaaataagaaacaaatattgttttaaagtttattaaaaaaaaaaaaatgtaattgccttgaagtaatttaatttgggcaaaaaatgccctaggaaatcaaaatgatctttgaatgtgtaaaattaaaaaaaattttaatttgtcaaaaatcttaattgcctaatggaaattaatttgaacaaaaaaaacacttgaaattaaataatctttaaatgctgctaattagcctgtaaaatttaaagtatataagtttg

SEQ ID NO: 32272 - DNA, 1318 bp, Heterodera glycines
  misc_feature (1287)..(1287): n is a, c, g, or t
atcaatttcggctacgcatgtgccatttattttttggacgacccgccagaaatggacgacgaagacgaatatgaggaggaagaggaagaagccgaagggatgggtgttttggcataccaaacggtggagggggcacaatcgacggacaatgtgcaactgatcggcacctcctcaaacactggtgcggaacatgctgggatttttatccagtggagaagcgggggggggggaggcgctggtagccatttggtgaaaaatttttaggagcacacaattttgaaaataatttaaatagtaagaaatattggaaaattaaggcaccaatgagaagaaaaacgaggacagagtgctcgaaaatggcacgtttggccaacgttcgtccgtgcaagagtcggattatgtcatccgccaaattcgcactgataacaatccgcggctgttcaacgaagtgccaacagtgccgggggaattgtttttgctgcgacaccaaaacgaggaaataccgcattactgtatccgtcctcagggcatagaggtactgtaaaattatgcaaaatcagacgagaatttttttttttttttgaaaaatcttcattaaattaattatgctaaacaatttaaaattaaaaaacaattaatataaaaaaaattaattaaataattgttagaagattttcctagctttttaagaataattagttgcgagattaaaaatgatcacattaaattaattgttatgaaggaatattttctcaatattttaccagagttttctaataccatttttaaaacattgtcattaattaggctgatcgtttcatccaacagtccctctccgagagaaatcggtcggaaataaagaaatttttggagcgaaatgtcgcgccggatgacggcgactgtacgcttccaaaaacacacaaaaaatataattattcgaatgttttcagggtcatatttgtggatatcgcaagagcttaagttggaggtgtttattactaattagcgttaattaatgaaaaatttaactcttcagaattacccagtgttcatcttttcaattaaaatgttagaaaactttttcaaaaatgaacgaataaggagggtaaaatggtaaacaaattcaaatttaagtaatttaatcactaattgctaaatttaggcgccatttgtccattgataaagtgtccgtttaccgttattcgctgcctcaaataacaacaaaatttcgactgaggtacttttacactcttatgtaattcaaatgaatatagtgcaatcatttanatattgttccattctttcttaattgcagaat

SEQ ID NO: 32273 - DNA, 811 bp, Heterodera glycines
taaattcatattaattaattacttcatttctccatctctcttcttgcttcaataatattaatgttcatgttaattgctttctttgcgatggtccgccttttatatgttgctcatcgtgcagtcgcaatttgtgtttcgaccattcccaaccctccccccaccgttgcattgatcaaattgttgtgaatgggataattaaatttggttaaaaaaaatttgggtttaccagggaaatgcccaccatattaattttttttaatctaaaccaggctgtcagatgtgatgatttatcatcattttttgacagaaaatttttcataacttcgcataaaatgaattaaatgttttaaattttggtattgtataaaaactagatgcatataattttttagttcatttttatatattttattatcaatttaattaattttctttattcttatgaacagaaagattattttatttatatttctccacttttcttttgacttttattccgttactggctttttattaattggttaaagtctgataatttacaataattaattcaaaaaattaattttttcctcacaaaagagtaatttttaagaattttgctttcaacagatttaatgcaaaatcttttttttcgtctaaatttattaattaattatgaaaattttaattgctaattaaattcaatttgttatgttataaaattaattccaaaataaatttatttgagatcatttcattatttttttttgactttttgattgtttatctttttttctgtaaatatgagtgtaataaagcagacaaaattttt

SEQ ID NO: 32274 - DNA, 912 bp, Heterodera glycines
gagcctcttcaaaattttttccactaccgtaagagctgcggaaattgtgaattattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgacgaggaccgttccggagagcctcttcaaaattttttccattac

SEQ ID NO: 32275 - DNA, 936 bp, Heterodera glycines
gtcgagagacgggaagaggtggcgggagggggcgaggcgggcaccgtcagtttggcgtcagagattttaatctcaagacaaaatttaaaaaaaattcgactaggccaaaaaacatttccgtctttttttctgccagaaaaatctctgccgccgatgggtgcggcgggtgcctttactttgaacatctagccccatataccatcataatctgttgttgtgccatttgagctgtgccgttccgttccgttccgtgttgtgttgttcctcccccttcgcccatcctctcgctgccccacttatgcttcattccccgccccctccgatttatttgtgaggatgttttatgctttatccccaccccgcccctttgcccactaacccgcgcactttttcattattcactttccttttccttatcgctttatccaattggtaaatgcccttaaaacctttgcttatatttgactctaccctttttcaaattaaaatcaaattttgttttttgtcttttatcttataatttaattttccagttttattataaaattccatttattttgatcttactgatttccgagtttttgatttttgtcactccgcccgaccattcactgcccccgccgcaattagccgtaattagccgaatttacccgttcgttctaattaattgcaaaaacctctctatctgacttttttaatattaggtaaaagaccatttgtccttttgatgctgccatttaatatttaattattgttttcctttcggcatttttctttgtcataactctttccgatgcgaatttactgttctatttttaacattttattgtactttggcttattctcagatttgttattttgcctttgtgtgatataaacccataattttcgtccattttccacggcattgtgccaatgtcggcacccatcgaatgg

SEQ ID NO: 32276 - DNA, 1182 bp, Heterodera glycines
  misc_feature (9)..(9): n is a, c, g, or t
  misc_feature (20)..(20): n is a, c, g, or t
tcataactntttgtcaaaantcgttgacaaaaataaaaaacctttcttgggtatcgttcaatagctcataagcttctcatctatttccttggaaaaataactaaaaatttagtcctgtttgaaaaaagttgagcaaaaaattttttttttcttgattctcatggaaaaaattaagggctatcgaatgatactttaattttgtcaaattttacaaaagtttatgactattttttttttgtcgaacaacagtatacgagtttgggtttcgtccacattgtgcacccccagtggggtaggggtagggggaggggctgcaaaaggtaaaaaaaaattattattttttcaaaaaatcaatgcaagaatttcaaaaaccaaaccacatgccaaattcgtggggtatttatttctctgtatattataaattatcttttttttaatatttttaaatgttgtataaaaattgctcacccagtgggccttcgcgcttcagtgtccgcataaaacagtcccatgtgccggtgtaatgcgtgaacggatcctggcaaattttataaaattattccctctggagagtgtgtgagaattggcatttttaaccggcgactccaaaacattccgcaattttccggcattaatgttcaaaaatggtaaaaaataaaatatttttttagtgtacaaggaaaaactcagaaattcagtaaacaaaaatttttccccattttttttttcaaaaaacggcaaaaattttgcttttttttgttggtattttgtttagcattttttttaactaggaaaaaatagagaaattccgtaagcaaatatttaattttttttgaaagaaaatttgcgtttcttttttataattttattgaaaattctccattaaaaaaaatttttgttgtacaagcgcttaaaaattttaaattttgcacattttttaccccccgaaaacacctgcagtcgggtgcgcaacacttggtacggaaatgtgatggtggtggacatgcacttggagctgatcgaaaatgtcagatagtccaccggcgccaattgcgagtcgcgcggaatgccacgcgcatggcaccgccagtccttcagccaattgtaaagggcgaactgcaccgcgccgttgatcgtgccgaacaggccgggcacatagccctaaaggcacaaaaaaaagac

SEQ ID NO: 32277 - DNA, 1110 bp, Heterodera glycines
  misc_feature (1099)..(1100): n is a, c, g, or t
aggacaattttctatctcgtaaccccgatgctaatccctttcggagagcctcttcaaaattttttccattaccgtaagagctgcggaaattgtgaattaattctcagaaaaatggctatctctttttaagacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaagttttttcccattaccctaagagcnntgcggaaatt

SEQ ID NO: 32278 - DNA, 839 bp, Heterodera glycines
aaatatatttttttgtgttcgcggcacactcccccagccgatgcgcgcacatatatgtggagacagaatctctctggagtagcttccctatatcctgtactctaattctgcgtgggatattttctctccacatatgtgtgagtgccccacacgcgcactcgaaaaaatatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatagatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggagaccgaatccttcgggagtagcttccctatagcctgtactttaattctgcgttggatttttgctccccataaatgttcgagtaccccaaacggacacttgaaaaaatcgatttttttgttt

SEQ ID NO: 32279 - DNA, 942 bp, Heterodera glycines
gtagagatgcgccgtgactgaaaaaacccgtgaatcgtgaccgtgaccgtgaattggtcccgtgaatcgtgaccgtgaacgtgatcgataaaacccgtgaaattcacggttttcgtgaccgtgaattttttgagtttattcaatttatattaaatcataattaaattgaagaaacaattgcattttcgcatgttcactggtaaaatttgagcgtttcggcttaaaacttcactgtttcgaaaaagttcgctcactttctacgctgcttggaggtggacataaaaattttgggacaagcttttttattgtaggaaattgcgagttttccttccaaaaaagcagtgggtccgattccaacggttgaagtgtcgactaaataatttatttatttttaaaaatgatttaatttgtgcctgaaggtagagcataatttcatcacgaattttgtttgtttgagaatcagtaaaatcaatcgactgagtggctccaataaaagattccaataaatttggagagtcgctatttatttttggttgttccgattcagaccctcgacgtgatggattcgttagcatttctactgtgtcaagcaataacacttcattttgagctcgttcttttgtcgagaaaatgttaggattgtttttgaatcgaggatcaacgagagtggccatgcgcaaaaagcttaagcattataattagcaaatatgacaacaaaaaaaatccaaaatttacattttagattggtgttctcgcatacgggattctaatccatcttttataacattttttaaacgcagaatgggctcattttcttcgccattaacacggagataattttgaaagcatttgtagacaggaataactgatgaaatcgattcgtcacgttttgataattggttcgtgaatgtaagaaagggctttagaatctaaaacttagat

SEQ ID NO: 32280 - DNA, 1006 bp, Heterodera glycines
  misc_feature (911)..(911): n is a, c, g, or t
  misc_feature (939)..(939): n is a, c, g, or t
  misc_feature (962)..(963): n is a, c, g, or t
  misc_feature (974)..(974): n is a, c, g, or t
ttttttgaacatgtgtttcgaatccatccaaaaatgaccttggcattggtagtcatttaggaggatttcctttggtagctcataagtgagcttctttacattctcatgaatgtaacagttctctgcacagcagagctcaactttattaatttcctttggaatctttgctttaacgcctttgttaaagcaaagaagtttgcactcattgcattgattggttggataagcatttgtttctgttccccccttaacgggaagagggaacaaacatgctaaaattacagtaaacgccattatttgcaaaatatggcgcgctgtaaaaaattgagggattgcccctctttgccttccttcttgaaagcaaggcgtgctctgatcctcaaaacaacgtaatgatactttgagttggatcattagccaagcaatggttttacgcccaatagaaagggcttttaaaattgagagaaccatcagacttatgctgatgtaaaaacaaagcgtcaatgctatgattgattgctctgttcgattaggaagagtttcttcccatttattgtccattcgattaatacgaatggaaaaaactgaatggctcacaacaccattcttttttatgcaacagccacagattttcttatctgtgggagttactttcggtgtcttctgctcaccgaaatgagagtcagattggtatgaaatctgactcggttgatcgaaaagaactgacttttcgatcattttttgggtggtcgtgctttggcatgaccatggcacgacaaaaaaatgaatgtgatttatttgtcacatttttcaacccactggttgagctgcagtcgaaagcaatactttcagacggtttatcctctactctagaggatacgccctgagtaaaagggttttagaacgagaanatttcctctttttgttttggaggactgnttcttctgaacagtccttccttnncctatcctgtntgcggagtgctcccaattggagcatctccatg

SEQ ID NO: 32281 - DNA, 969 bp, Heterodera glycines
caaaatgcacattcgcagtgccatgtctgttgaagacttgctgcagtgtttagcggtgcaaaaaaaaggattttaccgaaaataaaattgttttattttttcccaacaggactgcccagaatacgaggaaatccctgtccgtcacaatgaagaccaaatcaacaggtgtctcccagcatttgttcattttgatctattaaatccttaattcatgcgccaattgccattttactatattatccattcattttcaaaatttgacacccaatttttgcaaaatttcagtgaaattcaatcctttttgcccatccgattgtctacctccgattggggttcaccccatgtgaaggcccatcttctttaccaggcccacttttcccgcatgaaattgcccgtcgattacaccactgatcagcgttccatcattgaatcatgcattcgaatcatacaggcaaacagcgatcatcattatcatttttgccaaaatggattacatttcggtcaattctgttcaggcaatgttcgacatttgtctggaattcgcgtttgtcgacacggcaatcaatgtgctggtgctgcttcaacaaatttaccaagcccgatggtactctgaccatccgttgttgtgtctgccccacttcagttcacattccatcgatggcattgcgtaataattactcattcacacataattttaattggtttgaaattaactattctcccccctttttttgtcagaccgttttgcacaatcccacaacttcaacaccaattgggcatttacgcattggacgatgcaagaacgacaaaatctaatgaatttgaacggcagctgattcgtagacttagaaagaacagcattttgaaggagttcgaggccaaggaggtgcgtaaagatagtgtgattgagttatctgtcgcgcgctaaatttttccccaatcacccaaaaggatgcccattcattctcc

SEQ ID NO: 32282 - DNA, 1362 bp, Heterodera glycines
gggtaattgtcgaatccaattacaaaacccccatgggagaagacggaacgccatgaatgctgcccaagaaccggcatacgaccctgttgcggcttctcgaattcaaaaactttaccgccaaagtcgtcctcgtgcataccgagaaatcacagaacaatcatcaccattttgtcaaattgagggaaacgatcttttcaaccaattcagccaagtttttgaggagaatgctccgatcgacgaagaaatgccaccggaaataccaaggcatggaccaccaactgagcgaaacccgctgggcccacaatttacccaaaaagaagtgtgggaacgtcttaaacggtgcagcaacacggccccaggcccggatggtatccgttattcagtttggaaaaaatatgaccaaggagcgcacatccttacgactattttcaattgtgttaaaagatctaaacacatccctcaaagttggaccaaatcagtcactgttctgctccacaaaaaaggagacagaaacgaagtgtcaaattggaggccaattgcactctcaaataccatcggcaaattgtactcttcagtcttggcaaaccgattggcgatgtggtcaattgccttcaacagagtcagctcgtcccaaaaaggctttatgcctgtcgacggttgtgccgaacacaacttcgtactccaatcgatcattcaggacgccagacgtaccaaaaaacggtgctcaattgcgtggctggacttgaccaatgcttttggttcaattcctcaccaaacaatttttacagccctaaaatggtccggactatctgaccagtcaatcgctgtcattcggcagttatatgccacgaattccactcaaattcggcattcaaacggccttactcccgaaattccaattcgcgcgggagtaaaacaaggatgtccgctcagtccaatcatttttaaccttggaatagagcccatcctccgcaccattggccaactcagaactggctataagttgcaaaaaaaacgcattgatgtgttggcttatgccgacgatctcgtccttgtggccgaatctgccgaagaattgcaaagaatgctggacgccacctcaacaatagcaacttgggctggactttccttcaatgcccgaaaatgcgcgacgctggacatagatgggcggagaaaagcagcattaaacactgaattcacggttcaaaatgcccacccgcccatcctaacaatcgaccaattctatgaccatcttggcgttccaacgggctatggttcagcccaatcagcgaccaaaatcttagaaaaaatgaatgaccatgtccaaaaaatcgatgagtctctcttaacgccgtggcaaaa

SEQ ID NO: 32283 - DNA, 703 bp, Heterodera glycines
ctaaattggcttacagatttcctaactaacaggacattcaaggtcagaattaatcagcagttttccaaagaatttcccataaaatcaggtgttccccagggatctgtcctggggccaattctatttttgatttttataaatgatctatccccagtaatcccagacggaatttcgctaaaactttttgctgatgatactaaaatttacctatgttataacactgaatctcaacgtaaaaaactagatgaagccttacattgcgttaaccaatgggcccaaaggtggggtctacaatttcaccagaaaaatcagcttctcctttacctcggcaaggataattttaaaattccctaccaatttaatggaaagacaattaaagagacccaaacaattcgagatcttggaatcttaattgacaataaattgacttttaaatcccatatttcagctattctccaaaaagcataacttagaagccgaaccctttttcaaaaaattaaatcaaaatcatcaaagacatggattaaaatctataaaagctatattagatccttacttgaatattcatccgaaaattggaaccctcacattaaaaaagaaatcgttcgccttgaaaaatttcaaaagtttttcaccagaagagtgttcctaaagtgcccatttaccggttttaccatattcagaccgattaaaataccttact

SEQ ID NO: 32284 - DNA, 1823 bp, Heterodera glycines
  misc_feature (1457)..(1457): n is a, c, g, or t
  misc_feature (1460)..(1460): n is a, c, g, or t
  misc_feature (1462)..(1465): n is a, c, g, or t
  misc_feature (1467)..(1467): n is a, c, g, or t
  misc_feature (1474)..(1474): n is a, c, g, or t
  misc_feature (1477)..(1478): n is a, c, g, or t
  misc_feature (1482)..(1484): n is a, c, g, or t
  misc_feature (1486)..(1487): n is a, c, g, or t
  misc_feature (1494)..(1494): n is a, c, g, or t
  misc_feature (1497)..(1498): n is a, c, g, or t
  misc_feature (1509)..(1513): n is a, c, g, or t
  misc_feature (1517)..(1518): n is a, c, g, or t
  misc_feature (1520)..(1520): n is a, c, g, or t
  misc_feature (1532)..(1532): n is a, c, g, or t
  misc_feature (1538)..(1540): n is a, c, g, or t
  misc_feature (1542)..(1542): n is a, c, g, or t
  misc_feature (1544)..(1545): n is a, c, g, or t
  misc_feature (1548)..(1548): n is a, c, g, or t
  misc_feature (1574)..(1574): n is a, c, g, or t
  misc_feature (1659)..(1659): n is a, c, g, or t
  misc_feature (1672)..(1672): n is a, c, g, or t
  misc_feature (1683)..(1684): n is a, c, g, or t
  misc_feature (1686)..(1686): n is a, c, g, or t
  misc_feature (1698)..(1698): n is a, c, g, or t
  misc_feature (1701)..(1702): n is a, c, g, or t
  misc_feature (1704)..(1704): n is a, c, g, or t
  misc_feature (1706)..(1706): n is a, c, g, or t
  misc_feature (1711)..(1711): n is a, c, g, or t
  misc_feature (1713)..(1713): n is a, c, g, or t
  misc_feature (1717)..(1719): n is a, c, g, or t
  misc_feature (1725)..(1728): n is a, c, g, or t
  misc_feature (1731)..(1732): n is a, c, g, or t
  misc_feature (1734)..(1736): n is a, c, g, or t
  misc_feature (1740)..(1740): n is a, c, g, or t
  misc_feature (1749)..(1749): n is a, c, g, or t
  misc_feature (1755)..(1755): n is a, c, g, or t
  misc_feature (1759)..(1761): n is a, c, g, or t
  misc_feature (1763)..(1763): n is a, c, g, or t
  misc_feature (1776)..(1776): n is a, c, g, or t
  misc_feature (1779)..(1779): n is a, c, g, or t
  misc_feature (1782)..(1782): n is a, c, g, or t
  misc_feature (1785)..(1785): n is a, c, g, or t
  misc_feature (1797)..(1797): n is a, c, g, or t
  misc_feature (1799)..(1800): n is a, c, g, or t
  misc_feature (1818)..(1818): n is a, c, g, or t
cgttcgttccaccctttttatggaccgtcgtcgcctcgaccgtctcgcgcttctcgtcaatgttgcggatgccgcaattgcgcaactttcgatggccgaccgtcccaagggaatggtgcgcaatttgtaccatttccgttgctgggccggctcgcccggcttcgacgaccgtttctcgcagcagtggcgttgtgtggcgtagccaaaagcgcaccgacaaaagccgcgccattccttcgcctttatttttgcttttcctttccattcgccttttcttggctcatttccgccgtttcgtccttttgtttttttgtcctcctcaaatatctcatcatcattccttctccattcattcgctttctttcattttgttttttgttttcatttttaattttttcgtttattttttaattttaatttatttattattctcggggtttgcgcttttctcatcggcagacaaacattctcttaaatgtcttattttgagatgagttcgctcctgaaatgtctccccgcctttctccgatcacttttttcccccttttttttgtttgccttacgaattatgttttttttctcttcttccgtccattaacttttctttctttttccttttcgcttatttaatcactttttcattttgtgtactttcaatgaacagaccattcgcttctcttttgccaatgtttgttcttttcttcccacacttttcgttgttcgttcgttcgttcttcaatctttaaaattcaaaaagtgttttttgagtgagtgctttctcttcttctcctgctgatgttttgccattcttttggcattttttccctctgcgaattttgttgcgtttatttaattttttatggtaattttatcgttttgctttttgtaatttaaatgttttggcacaataccaacggattttgtattaatcgcatttgtcattcgttttttctttaaattaaaatttgtcatcggcgaaaatgcctttggaatataaaaaatataaaagtaaaattagccgaaaattgtcccacggttaaacatttgttctttccaaacggaaaaacaaaacaaaaagagaatgaatgatgaacagttgacgcaaaccaaacggaagcattggcatttgtctggcaaatcctttttcttcgttcccgaactttggcccttcaaaatattggcaagtgtcccccggggaaagctcagtttaaaaaatttttttgctcttttctttcatttttttcgttccgttaattgagcaattccatcccaaaaacaaatccaaatcgtctcaaaaacacagcacacatttattttctgcgataaataaaaatttgtccgttttattttaaaaaataaataatcaaaatatatctgcgaaattaattaaagtatttaatccctaattaaaaaatatttgtttatacaaaaacacaaatttcccttttcaaattttnccntnnnnanacaaatnaannaaannnannaaattanacnncactcccccannnnnaatnntnccatttcaatcnactaannnanannatnccaaatccattcattttttttctctncctcttttcccttcatttctttttcacataaccttttctccccactattttttccctctctttccctcacattctctccaatttncacattcttttcnttttttctccnnancaaactccccanacnnancncaccncnaaannnccaaannnnccnnannnttcnccatttatnccatcncacnnncnccttctccccccnccnccncantaatttatcctnanncaaaattaccttcaaatnaccaa

SEQ ID NO: 32285 - DNA, 1445 bp, Heterodera glycines
  misc_feature (7)..(7): n is a, c, g, or t
  misc_feature (13)..(13): n is a, c, g, or t
tcctatntaatanagttgagtgtctgtatccgccatgctttgaattggcgtggcgttttgttattattttgcgttaaaaaatgatttaaaaatgaaaatgtttttgttttgttttgcgttaaaaaagcatttgaaaaatgaaaatgtttgttttttttgcgttaaaaaatgatttgaaaaatggaaatgtttgattttgatttttcagtttgttttgcaaaaaacattcttagtcatttattcgcttttttgtgtatgttcaaatataacgccaaaatcgtcctcaaaaggctaggaaattgtattcctagtaataatgcatcaaatctgtttttaggttctgacagtatattacttataaggttttttatttgttagtcataatttttgcatatatatttgttaaaaaataaccaaattttagcattaatatcagtaaatagcttaattgttctctattggcctgtaagaaaaaatttggttactttttaactttcatattgatagttttttcaaaatccgtccagttataataaatgtagttggtcgatttacaaaaaatacaaaaattacagtagtaatgtgtgacaaagtccatgcatatttttcttacgtcttttgacatattttaaaatttattctcataataattcatgcataacattggcgcaatcagcccggcattttaattcatactaaattatcgccagctcaagccgaatctttttaaatttaattattgatatattgtctgaggcctttcctagcacgtaatacacatctgccgggtacgtcaaagaaattttattaaaacgagaatgcttaaaaataataaatcaaaatgataggagaaattatgaatatttagcaaaaatgcttaatgctgatctaatttgtcgataaatcttgcataaaaattaataaatgacactcctcattaaaaaagcacttaaggacaaccgcataaacaagccacattacataccgcgcgatgaaaacgtttgcatattcatttaatattgttatttaaaataaaaatttatttaattattttaaaggtttatttgtgtaaataacataaaactcagaaaacattttaattataattaaaccaaatgtatagatataattaaaattatatgatagattaataaattattataatagaaaagatcatcccgaaaattaaaatttgagttttcgtactaatatgaaagtgattaaattgtattatataataaaagatttttctaaagaagtcaatccaatgatgaggagggtcttcaacaccatcaaaagaaaattaatgcaataaaaacaaataagaaaatataaaaaaattaactcaagcaaacttattaacaataaaagttagtttaaaataattaattacgaaaaaaatgtaaaaattcaatctggaatagggaaaaataataaatttattt

SEQ ID NO: 32286 - DNA, 1392 bp, Heterodera glycines
  misc_feature (195)..(195): n is a, c, g, or t
  misc_feature (1244)..(1244): n is a, c, g, or t
  misc_feature (1307)..(1307): n is a, c, g, or t
cgacagtgcaacgcaacggctgggcagtgcctgggataagaaaaaaattttaattccgaccaccagcagcatcatcacgcagtacattttctctttaatttctgatttaggatcacgttgagatgggaaaaggtggttagatgccagttaggtttgagccggaatgagggtcaaccgaagcctcaacccacttgngatagtccgatggccgactagtaggaattccgtcaacgaagaatgcatgacctgaaaaactgtgtatattagcaaccttggtaagcccgtggtgcgtgccacccctcttccttccttggaaaacccgtgtgcatgcccatctgtccacccgagaaattccgcccttcgtaagcccgtggcatgccaccctagcttcacatatgaaaatgtcaaccttggtaagtcctgtggtgggttcataccccgtccctagtttcctccctcacctgtttatccagcacagtgcccggctggcagttctgttcctgcgcacggccgcccggctgcacattggtcggaatgatgcgatagttggagttgcgttggcacacaaccattgtcagtgccggctttttggccatgctctgctgttcagccatcagttcggcaaaggcggtcatgaatgcgccgccctcccaatgcgcgaccttcacaataaataaaatatttcaaatttttcagataattctaataagaattttcttaaggattactaaaataaatttcaaaatgttttaaatttaagaacgcaattttttctttcagattttctcaaaaaagttgtaaaattttaaatgaaaatttttttcctgctttaaaaaagaatattttgtgaaaaaattatcaattattttcatcacatataccaaattaagtaaaagacccttgcctataagcacacacaaaaaaaattatcttataaaattatttaaagagatataaaatttaagtgaatcttatttattttttaatttcgactgcctccttggcactgttcgtcacctttttgtattcgccttccgaggccccggcccggaacacgaaaatgtgttccgggaagaatccgttttggtcaaggaatgccaatagcgcttgcttgatcgcgttcaccatcggtgccgatgtttgcactgtggtcacccggggctgctgcatccaataggtgccgtttagcttcaacatgtgcttggaaatggtgtaggccatctgaacaggtcatgtatatgtantcagagatgggaccaaaggccccgaaaaaaacttcgaattccgaaggcccaaaaatctggtanatttggaatgggcctcccagtccaatttattgcagtagaatatcccataattggcaatttaacttatgaaaattattcacaaatg

SEQ ID NO: 32287 - DNA, 924 bp, Heterodera glycines
  misc_feature (13)..(13): n is a, c, g, or t
  misc_feature (22)..(23): n is a, c, g, or t
gtcttttgctaancatcagacnncttcgtttggatcgttctcaacctgcactaatttcacgtctcaatttgtcctcaaaattggtaacatatcgcaaccatttgcagaagcaactttcaaattcattcgtaatttcttcatttacaagcgatgaaatgatgggacttttgggcgaattgctgactttttgttgttttttgattggcgtcgaagtgcagaaattagactcgctggccaaagtcatcgaaaacaaaactccgtttttgtttgtctcaacatttccgcctgaatttaatcaatgagaacgccaaactaaaatatgacctaaccttcagctttttcagccgctctttctttgttaattgtaaaagaatgctccgtttgagcattttcatttatttcgacgaattcattgcctccattttggtcttcatcgcttcccgattcctcctcactttcggacgaaaattcgcaaaagtcatttggccgtaaaaattgtactgtagaaggagagctaaatgcttttttaaaaatgaaatacatgtagagtccatagtttttatgggccaacctgtttttattcacgggaacacaacgtactgctgggtgagtgattttttcgttaaaggtgagataatcattctgatttgaaaatttcaattacctattgtactttataatataaaattcgataactaacgaggatagagcatttcggattcggcgccttaacacgagcaagactcagttttctttcaaattccctgtgaagtttctccttctccaattgtaaactcctctcaaagcgcatgaaaccatcctcaattttggccatcaattttttgtcatcgatatatttcaagtaatttgctgacgtaaaatctaggcttcgccggtggtaccaatttctaagaaatatgtaag

SEQ ID NO: 32288 - DNA, 1194 bp, Heterodera glycines
atattataactaaattattaaatcaaataaatataaattatagataattacacgacgaaaacaaatattgaaatttattatacttttaaaataaacaaaagctataaattatattaagaacaatggatatgcgaaaaaagaatttttaaatacataatattggataaaattttcagaaagatttaaatggaaatacgaatgaacctaaaaaagtgacagatatcaacggcgctgactattttatttaatggtaacagaataaatgcttaaattatttgaaaaaagctttcgatacgctatttcgatgacgaagtcttgtacaatagaaaaaattacaaaaaagaaaaatattcttgattgggctttatatagttttattgtttaatgggaaaaagtatttttaatactcttaataaaggtagaaaaatatactaataaccaaatatacattgtaatcttgaagtgatacatataaaacaaataaaaatggaaataccagtaatctatggtctataattattttttagaataaaatgaaacaattcggaaagaaacgacaaccctcaacaagattattaatttgaaaaaattatttttaaacaaattatttaaaattagatttcgagggagaaaaatattgatgctatcaatatcaaaattattactactaatatatactggatattatataaatttaaattccgtaataaaatatttaaaaatttaattaaaaataataaataaaagccaaaaaaaattaacatttataaatattaaactcacaatattgattttatgtcaacctttgttggatgcgtacattatttaaaactactttttccattgtgaattttatcatctgcgagttctgccgctatgtgagccagcatttctcgcgcatgttctaaccactccgtcaagtgccggtcatcacgaataaaggcagtgaaaagcacttcctccgcctctctcgctgggccttgaagtccgttcatgatagcaccccacgcttccagctcgacttccatccttgacaggatacgagtgatgtgacctcgttcctgttcaaggttttcaatcgtttcggcattgctcacgggctcatccagcaaattttcggccgttgtgacatgttgccgaagtcggaacagcgcgggccccaaagccatccggcatcgagctgaagacatcttt

SEQ ID NO: 32289 - DNA, 2079 bp, Heterodera glycines
  misc_feature (4)..(4): n is a, c, g, or t
  misc_feature (1465)..(1465): n is a, c, g, or t
  misc_feature (1488)..(1488): n is a, c, g, or t
  misc_feature (2048)..(2048): n is a, c, g, or t
tttntttttctcataaatattatttttactttctaaatctttcctattaattgctgttgctaaccaaccgtttcatactcattcccgatggttgaataatatgcgtcatcacggtcctgttgttccaactgttgaccccttaaaaaatgcaccaaaataatttatatgttcgttgattgaggctttagcccgttaaatgattcggaacaaattttaattaccccttatgccttaaaaaattctcgtgttttgattggtcgaagaggatgaggagggtccggcgctaccaggaacactcccaggttttgtatcccctccaaagccggctggagccctacggtttgccaaaaaatttttatgaagaagtcacccctagcctagcaacaattcacttcacccacaagtttgcccgttgctggtgctgttgttcgctttgttgttgctgctcctgctcctccctgagtcgaatgcgttcccgaatcactgcggcatcctcgcggaccgtcaaataacgataggacggctgcgtactgctgcaaatactgcccgaaccactctcaccaccaaagtcggtggtcgtcgtcgattgctgatgttggaatgactgttgacggaggagttgttttgcgatggctgccgatgttgtgggctgttgttggtcagcagccgatatcttccggttgatctacaaaaaaaaaattgaaaattataaccgaaattttaagggaatggcatcccccgaaattaaaattttttttcaaacttaaaaatttcccaaaaaatcttattgttagaaaattttaagaaaaaattaaacaatttttctagcgtttttaaaaattttattgctgaattattaagtttttcaatattttttccaaacattgctagaaattttttattttttttgtaaatttttgcgtggggaacgactcgctcaaaaattttaaaaccaaaaaaacaactaattttctctataaaatttcaaaaaaaaaattcactcataaaatgttggatacacctccaatttaagaaaatccaattaaagccactcatttcagatgaaatacaatacaacctttgcatagagttggtccaattcagcaaaattattggcattgtttttgttcatagccgctcgtgctaacattgttgtcgctggtggcactctgaaaggcgacaccgatttcttgaccccaaaaaataaaaattccaatgcctctcttgacccgtgaaatttttttggaaaaacgaaatttcaggaaaggaaaatatttattttcataccctgtggtcgcttttgataggccggtggtgccgtttttgttggagttgatgatccgtgaatagccgtgctggtcataggtggccgaaccactgccgtaaccaccaccaatactcacaatggaacttaaacataattttgctgtttgaagatttctcattaaaataagcaccccccccncatcgggagcagctcgtcccccncccccccctttcctgcctcctccccgtatcgttgctccagaaaaattttcctattttttgactaaatttgaaattttaaaaaaaattccgggggttgagggggggggctagttttagattcgtttcgtcgcactttttttcattttttatgctccttcaagaacccgtcccctctctctctcgccatgtcacaccaacctgtacgggtcttcgctgccgcccaacgagtaaatttgtgaagacgcagtcgcatagagcggttcatctgctgacgcagcagcacgtcgcagcgccggtggcggcacagcgacgcgttgttgcggcgctgctcgctgctgttgtcgtcgcaactgatgctgctgcggttggtccggtttgccagcaaagtccaggtagtcgtagcgcgactggggcgacgatgatgacgacatttgtgcatgatgggacgaggaagggcgggtcgagttcgagttacgctgaaactaccaaatttcaggggtatgtaatcagcagaatgcacataaaaaaacacccaaaattcgattaaaactttgaccctnagggtgtgtagtaaggggatcgtttaccctc

SEQ ID NO: 32290 - DNA, 1191 bp, Heterodera glycines
actttttgaaatttttaatttgttttttttgtcttctcttccctgaaaagagtcggcttttcgatttgttcttcgtcttatttgtgccagtcagtagttacaaattcgtatgatttataaacaattaagcatcaaaaatccattaaatttatcagtttttttgtttgttgtaaaattattatcaacttcttcactttaattgtcatcaatttgcaataaatacgaatgccgatcgttgtaataattctctgtacaaaattgatttataattatatattttgcatttatgattcataaagctccgccattttagaagcatttccatattcatgttgtctaacaatttgcgaactgttgttcagaatttcatttttaccagtcctaattttcccgggctctcggttgccgtgacgggaatgcaatggggacttgccaattcactttgacaatatccaatcaaatcgtcatgattgtttgttcaattgtctttttctgtatatttgtaatttgttgttattactattgtataaaaaaatgtgagcttgttgtatcttgatcatatatgtatttaataaaaatttttgtatgatgaatcaattaattttcaaccttacaaacagtgaagaatggagtgatggaattcagaggaggaagttacccaaaatatttcttaaatgggaaatttaattcccgaggcccaaaattctcgaaaatcggttaatttccgaggcccaaaattctcgaaaatcggaattccatccacctcaagcaattaattgaagttgtcataatattgtttcatttaccaatgtattcttttcaatgctcttaattatgtcataaaaagccataaaaataattcattgttttatttatttttaatatataaatattctttgtcatgttaaaataaatgcttgaataaaatgaaatatttgcaattattgtttttatatggcttactcatacgtgaacaaggagtatgccgactctcgtgggcgccataacgaagggagaaaaattttaaaaaaattttaaaaattttcacggcggcgcctatcggcaccgccggaccccgctaccccctctggttccccataatctttgaaaaaaccatgccgcaaaaaaggtggtttgaatagcaaaaaaaaaaaagggccgcaaccggagaaaagtgtgtccttcgtacaa

SEQ ID NO: 32291 - DNA, 1180 bp, Heterodera glycines
  misc_feature (1162)..(1162): n is a, c, g, or t
aattccgagtttcatgaggcatcaacttcatcttttcttgtcctgccccattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacaggatttttacatattagcgatccttttttatttgtgaccgcaaatttttacatactagccattttttattttattgtgaccaagcatatctttcctcgtatttctgggatttttttcagaatgtggtcatagaatagatgggttgaattatttgtatttttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccatttttttttatttgtgaccgcaaatttttacatactagccattttttattttattgtgaccaagcatatctttcctcgtatttctgggatttttttcagaatgtggtcatagaatagatgggttgaattatttgtatttttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccatttttttttatttgtgaccgcaaatttttacatactagccattttttattttattgtgaccaagcatatctttcctcgtatttctgggatttttttcagaatgtgngtcatagaataggtgggt

SEQ ID NO: 32292 - DNA, 1105 bp, Heterodera glycines
tttcagatgagaaatttttttataaaattttgcttattttcatatacgaaaatttcagcactttatgtaggttagcaacaggggtggagcgcgaccgagatccgcggcatttttttccgcgattcgcgatcgcggcaatttgaatccgcgatgcgagatacgcgggtcttttggaaacaaaatttattgaaattataagtttgtatgtctggaaccccttcgcaaatttgggaccccaccccacccacatccattcccgtcgcaaattttttatgtccacccttggttagcaagtactttttcagtaggattccacctctctcgccgccacgtctaagccaactttgagtcatcatattagctcttaaaatatcttctaaacttatacatagagctttcgaatgacacaaaatttgttaggtttaaaaagaagaaaatattatggcttcttaaaattggctgagacggagttggccagacagacagaattgactcctacacgcccttccagtttaccagtccactgatcagaaaatgcttttgatcggaacggaatgaaaggtttggcgctactttaaaagcgttacattttaaaaaattttttcactttttttaacataattttttttttgtttattttgatacagaatgatgaacattaagcattaacagcacaattatggcgaataaaagtatattcacgatttttatccaaaaaaaatttacaaaacaaaagggtcccccctatggtttttgataaaattcaaaatctatcactttataactagcgccaaatttgcttaataggcccaaataattgtcatattcgtgatcagcgacctttaaaacacccgggtacttggtttcaggactttttaaacaaaaaaaaattttgaccaaaaaaaagtgaaaaaaaatttcaaaagtttcctctttgcaactagcgccagaatttttttataaaaattcatttttcacatttcttttttgtgcgggcctcgaaatcggttttccgacaagtcaaactcccgaaaaaacagtcgtccctattctaaatttacacactgtatatagaaaataattaactcaatttttactcaaaatt

SEQ ID NO: 32293 - DNA, 1218 bp, Heterodera glycines
  misc_feature (77)..(77): n is a, c, g, or t
  misc_feature (108)..(108): n is a, c, g, or t
  misc_feature (132)..(132): n is a, c, g, or t
gctcgagcgcaaaacgtatgcatggttggaaagtatcgttcataccaataatgaggggtttattttaaatgaaattntatgataacccttattatctcagaagctatntaatgatttcgaatgtttttatcncggttaattagagcaacgaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgttttggattgacaagcccgatgataaatagctcgagcgcaaaacgtgtgcatgtttggaaagtatcgttcataccaataattgagggtttatttttaattgaaattttatgataaaccttattatctcagaagctatttaattgattcgaatgtttttatcccggttaattagagcaacgaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttatgtgacacttcttcaaaataacctatgccctttattcgaggaagaacagcatctttgttgtttcgttttggattgacaagcc

SEQ ID NO: 32294 - DNA, 1122 bp, Heterodera glycines
agcaaagcactaatagggtgtttgactcacttcaaaaaatatttcattacacaaaggttttttacaaccacttattgccaatctaatttcttgcagatttaaagccatccattgcctgccggttctcggcacagcaaagcactaatacggtgtttgactcacttcaaaaaataattcattacccaaaagttttttacaaccacatattgccaatctaatttcttgcagatttaaagccatccattgcctgccggttctcggcacagcaaagcactaatagggtgtttgactcacttcaaaaaataattccatacccaaaagttttttacaaccacatattgccaatctaatttcttgcagatttaaagctatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccttacacaaaagttttttacaaccacttattgccaatctaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagattgaaagccatccattgcctgccggttctcggcacagcaaagcactaataggggtgtttgactcacttcaaaaaataattcattacccaaaagttttttac

SEQ ID NO: 32295 - DNA, 1368 bp, Heterodera glycines
aggtcatatagaagaccagtcgttgtattaaagacaaattaatttctctccccagaaaataaacgatattattaaaagataccaaaattccttcaaacaaatttaattcaaaattagtattgtttgaacaattcgctgacaattaaaacaaacatagaaataattttaaaaaaatattttaaaactaattcttgtaacaatattaacatggatataaaaaaatatagaataaaaatgtaatttctcattttcgttaaagaataaaatatttaattttaaatatgaatttttaaacacatagaaaggcattaaacaaagcaaatttattattgtttgcatttaattattaggaattaaagaaataaaaaaatgcatttattgatgaaccgccgcgcgcaagcagcaagcacatggcatggaccatgagaacaaaacatgaaaatagattcaaataaaaacaaattaatttattacataaatattaattaacaatttcttaacgaaatttttttaattttaaattcatttgtattattaaaatatgtaatatattgaaatgcttattaaaagttaactaaaaataataaattcattttatttaatggaacaataatatctaatgaaaattcaaatattttaaataagaaatttttttaatatatttttaatcttaacatcaggtttgaagcaaaataatttacaaaaaataaccgttacatcattacctaataaccattatatatttagtatacaaaacataataaataataaatttaaagaaattcatttaaataataaaacttattaatatactcgaaaaaatatctaatagataaatatatatatatatatatatatatatatatatatatatatatatatatatatatatatatatatataatataagaaaaaaaaaaatatatatttttatatataaatatatatataaataaatttaaaaaataaaaactattaagtataccaaaattctataaattttatttctaaattatttatatctaaaaacatgaaattaaaaaataataataattaaagaaatcaaaacgcatagtaagaaaataacaatatttcaaaaaatatttaaatgccttaaaggaaatttagagcaggataaataatttgaaatatttctttacttattacaataatatgcacagctgccattaaattaatattttatagcaattaattcagttacctaaacggctagcccgaatttacgttaaagagtgcgactgacatggaaaagacagagacagttaaattcaaggaaaatatacaaaagaaaaagtcacataaaattcattttatttattattttattatttctttgaattcattttt

SEQ ID NO: 32296 - DNA, 1123 bp, Heterodera glycines
  misc_feature (16)..(16): n is a, c, g, or t
tcagggcaagtgctgntccgtaattaatggtttagattctcgattctcgtggggtcaattcctcgttctgggcaattttcgaactcaatttatggagtcagttcttgattctcgagatcaagtgaaactcatgagataaattcagatgtcaaatctcgcgcaattttcgactctcggagaccacagaatatcatagttccgactcggggtcaattcttgatctcgactttgccaaatccacgtaattcccgatctagacttccggagtcaatcatacactctcacagcaattctaagtctctcaaacacattctatactctcgggccaacgggatcaattctaggtctcggctcttccaaatcggtgaattctcagtctcgactcggggtcaattctcgattttgactcccggagtcatttcaagactctcaagacaattataagtgtctcaaatggcaattctcggaccttgactttcagaatcgggggcaaatctcggtctcgaatctcagaaatgcgtcgattctcggtctcgaatctcgggcataaattatagacttccgggccaatttttgctctctcgaaaaaaactatagaaaaattaatccctgcagctccaattcgactcctcaccaacactgtacagtgcacatgacgaattagctgaggcgcacagcgtcgatcagatggagatgaactgtggcgagaccaatgtggacctgtttgcgctgaatgaccacgagttgcacctgttccaagtgcatttgccggccgacgagcgcaacgaacacattgggggtcattagttcgctaatgaagggtcattagcgcggctaatgatgctcgagagtctcgagaaatttttgatgtttttttggggggaggtcatttgttcgtcagaaaatgggaccaaatttcggggggaagtgtcgagaaaatcggttttttttttttcgttctcgagcatcattattggacaaccaaatgcacacagagacaaaatatttgattgattgaaaaattcattttaattgcacttttaattgttctaattaattttaatggcctttaatatttaatattggtaccatgtttttacaaccttttttttaattgtctctt

SEQ ID NO: 32297 - DNA, 1156 bp, Heterodera glycines
agatttgaccagcatggaaagccggtcggtctgagcccactcctcggttaaccccgtgaactgcttgaatttcttggttaaggtgtttccgaagaacgaaaagggtcatttcattttgccaaaggatgagaaagggtcgcccttcttccccgtcgatgatcgaacagtgcctatttttccatgggaccacgagaaaggaatgccaacatttcctgtcggtcagcctttgaatattagataattgtggtttattctggtaaattgattgttgtacgcttccagatgacacggatgagccaattttccctagaaatgatcagaataagccgattgtgccggtggatgaaaatggtaaaattggcagaaaagggaattgttgaacagttactttcagatcaaccaatctttcctgtcgacaaaacgggaactttcatttttccggtggatgagtcaaactgtccgatccccgcgctcactgtctatggttgcatttggggagagggaggcttaagtaaccataattggtattcgatttaggcacgcgtgttgtaccgaaggatgagttcggtaacgcggtgattccgcgcgaccgcgacggcaaagcactaattcatattgcttcggacggcgtcacaccgctctccatgggcgaatggaagcagtggaagaagtactacaaggagcaggcccaagtgcgaaatttctaccaacaacggcagcagcagccggtggctgttgagccggcggcagccgcgggcattggcatcggcgcagtgaattattcggcaatgaactcggtcagtgtacaccgttggccaagaaagtgatggatgcgagcgaacctttcgcagtttggccaaatttcctatcaaattgaccgatggtccgcatataaatggagtttttagacaaaaatgcaacaaaacggttggacttcattataggaatcgtctaacaccttttccatgtgtaaagtagtccacttggctttcatcattgcccattttccgttcagatgtttcacccactgaatttggaacagcaaagtgcctatttcgccgctgacatggaaatgttgcagcgggttcgccgtgttcgacccgaagacgtcgacttaccgggtcaaatggtttgtcgctaacattcagtaaaatta

SEQ ID NO: 32298 - DNA, 1094 bp, Heterodera glycines
tttgtctttaaaaataatattagcactggtattttttaatttgttgatgtgtgcttctatagttttgtgtgtctgcggtagggccgaaacactctttttttcttatttatcgttttctttaggaagagcaccgcactgtcgagtcccgctcgtgcagtagaaatttttataacaaaaaaaatttttttcatttaattttttctcaggaattgtccgcaaatgtccgtccgcaaatgtccgtccgcaaatgtccgtccgcaaatgtccgtccgcaaatgtccgtccgcaaaatgttcgcgtaggccgtttgaaaaagtaattcctattaccttcgcataattccacaacggttcatcaaacaattccatctcgagctgatgagaactaaaaaataattttaatatgattaaatttggttcgtattttaaaatacttgattaaatatgcctaaaagcataaattcgtattaaaagcaaaaaatagcatagaagacattttttaaaaatgctgattcattattatacataatcgccaccctgtgattagttaaatctgcaaatgttaaaaaatgaaaaaaaaaaattaacataactttttcaatgtcctaccaaattaagttttttgtattgttcaacatatcaagaaggttttctattagagtgttaatttttataaatttatatatttataattacgaaaaaatgataagaatgaatattaaaaacgttttgagttttcgaatttaattgagaattcagtttatgaatttatttgcatacattttttaaaattctaaccatagtgggatttaattaacgaataggatggtaggatttaacttatgctgtaacacccaattaaatatgacggcaaaaagtgccaatttggttttggtgccctccgatttgggctgtgtcggggcaaataaatctattttttgtacaattaccgtacccatttgccggtgtattgtcaattgaatagtaatgttcaatatgcgcatctgtgccgcaatgttctctatttttctcgacatacttgttatattcctcaaaatcaattggtaaacgttttgacaactctcgtccaaaatt

SEQ ID NO: 32299 - DNA, 1668 bp, Heterodera glycines
taaccactataccacacaatacacaattaacaaaaagaggtttactttatttaataaaatttggcaaaatggttaaaaaaaattcaaatttcttataacttttttgccttttcccccacaaaaattccattcttaggggtgtatacctatttaaccccgaccccgatcggggttaagggtcggggttcggggttggaagcgtcggggttcggggtctgggttttccccgaaaatggccaaaaatgtcgggggtcgggggcggggtcgggggcccaaccctacttttaagttttattcgtctcaattagagatcgacagggatcggattcgtgcgggaaaccaaaaacatggactagcaaaagttcaatcttaatgtccatgttggaccaataaacaaattgacgaacaaaatttttcatacaaaaatgtttggaaaaagtaaaacaaatatgtattttgaaccaaaataaaattttttgtaaaaacaatcgacgataggtttttttcggcacatttttcataatttttcaggaaccagtgagtctcgcgatgctgatagttgtcgagaaaaattttgaaaataacagttttttcatttcagcagaaaaccacaaaatatcataatggcataatacaaatccaaattaatcattccaacaaaaaaaaggacaatttttatgagcacgtcaattccaaatcaacaattcaaattgatcaatcatttctcagcaaagcattcattcatttctgctgatcactagggccgggaatttcgtcgagaagactaaaagtgtttaaacgaaataaatttgaatttttgaataaactcattcgcttacccgtcgccgatgtcacgctcactaaacattttaatgccaatttgattgcgctgctcatcattgcgccaatcagcttccttttcccattttgtccatttgctttcgtctcgcgcaattggacaacggatcagcaaaaaacgatcgcttttcttgatccttttcaatgccaattgttcatgcgtaaatccattggtctgatcaaatggcgcaacggagtcagcaaaaggcaaaggaagccaaacgaaaacgatgaaattgacgggggaagaagccgaggcaaaagcctaaaatatggtggaaaaattgattaagaaatacaaaatgggtaaatagatgacactttacggtttagatggcccgatgggacccaatgaaaaacataaatcaattaatatgcaccgctttaatggcttcgatcctcgacatccaattcacatcatccgtgttcaaatggcatttgaacacttttggcacatcatgttcttgaagtggagtaaaaagccatttggccaccatttgtccatccgatgccgcggcactgtcatcacatggaaattcggggaatatatccaccgaatacagtttgacaacgcgtaacaacggcaaattggtgaacagtgacggtacgaatttgcgcaaacggcggaaaaggctgacggacaatcccaagccataaagctgttttccaagcattggccaaatgttgtgcaaaatgaagtccgaaatgcgatcattgtccgtttggatgttcaaattgattggacaaacggcgagaagcggacgaaaacagtgaagaaaagcgatcacataattgtcgatgtacctgtaa

SEQ ID NO: 32300 - DNA, 986 bp, Heterodera glycines
cagaaaaatggctatctttttttaggacaattttttatcttgtaaccccgatgctatccgttccacagagcctcttcaaaatttttccattaccgcaagagtggcggaaattgtgaattattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccacagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaatttttccattaccgcaaga

SEQ ID NO: 32301 - DNA, 1144 bp, Heterodera glycines
  misc_feature (1130)..(1130): n is a, c, g, or t
ccaaatgacttaattgatgctaaaaaaacactaaataaagctaaaattttcaattttcactttgaaatggggccgttctaatagagaatttttcaaaaaattcccatattttcagaccgttttcaatcttaaaaaatttacatttatttaggataattttatgagcaaatctatggatttcgccgctcagggtggccaatgagatgattggctgacgcgtgcctttgctctgtcccattttgaacttttttttaatttttgaaatcaaaatcaccggccagagatggctcgccgtagttgctgggctgatcattcttcagcttctgatcattcttcagcttctgatcaatcttcagcttctgatcattcttcagcttctgatcaatcttcagcttctgatcattcttcagcttctgatcattcttcagcttctgatcattcttcagcttctgatcaatcttcagcttctgatcattcttcagcttctgatcaatcttcagcttctgatcattcttcagcttctgatcattcttcagcttctgatttaccggtccccttcgggcccccgcagtcaaccgcctgtggcgctcgtcagacgtcttcctccgccctccattataatttatatgcaaaacatgggcctgaaaagtagagtcgaatatcgaacgatggcaaaaattggtcggttattgattgacttgaaagacaatcggttatttatatccatataatttaaacctaaccatcacatggcggtagaatttggccaaattttgcgcaaaggctgccaaggaaaatgggaagacaaagacccctttttctcctccgcgatcatttaggcccaatatttgcacagcagcactctttcctccccatcgacagcagcagagattttttaaaaatgttttttcctttaaaattgagctaacgattggtgggctaatactaaatacagtaaaacacaaaaaaaatttacaaaaatatgtttgaatgaaggtgggcggcacggcacgtacaacacaagtgccgctggtgcttcggcactttgtcggtaaagttcatgcacttatcaaagataaatcctcgaaactgatcgaaataaatattctttacaattaatttcatagggntactacatttttca

SEQ ID NO: 32302 - DNA, 1222 bp, Heterodera glycines
aaaaaatttttttttgggttttcggggcactccccctgagccgatgcgcccagatttatggggagaccgaatccttccggaatagcttcactatagcctgtactttaattctgcgttggatttttgctctccatatttgtttgagtgccccaaacgcacactcgaaaaaatcgatttatttttgttttcggggcagtccccccgaaccgatgcgcccagatttatggggagaccgaatccttcgggaatagcttccctatagcctgtgctttaattctgcgttgggtttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgtttcataaatatttttttcagaaagtccccgaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttcccattaggtcgtccgttagcgttcaattgctctagtca

SEQ ID NO: 32303 - DNA, 1104 bp, Heterodera glycines
aaaagagatagccattttctgagaatatctattcttctgagacagcatttttcaaaccgaccttttgtaggactcaaccgcagatagtaatgcgtttttggggaaaccccccaggtacaacggtgtagaaaaaaagagatagccattttctgagaatatctattcttctgagacagcaattttcaacccgacattttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagaaagcaattttca

SEQ ID NO: 32304 - DNA, 925 bp, Heterodera glycines
cagtgggcaagcacacagagtgtcttaaatacacaccctttgtcacgtaaaatattccaaaaaaagagatagtgattttttttggattaggccggagaaataaaaatttccacctatttgaaaaacagtgggcaagcacacagagtcgcttaaatgcacaccctttgtgacgtaaaatatttcaaaaaaaaagagatagtgattttttctggattaggccggagaaataaaaattaccagctatttgaaatgcagtgggcaagcaaagcgagtctcttaaatgcacaccctttgtcacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggacaaataaaaattaccagctattgaaaatgcaggtgagaagcacagcgagtcgcttaaatgcacaccctttga

SEQ ID NO: 32305 - DNA, 911 bp, Heterodera glycines
ttgttcaccaattgtaaagtgtgtgcttagttagacccctccccgagttgtgcagaaaaccaaaagcaaatatcgcataatcgatcccaacggacgaaaagcgaaaattaaaaaaaggaaaaaaacatattattttagggaaaaagcattggttcaaaaatatgtttaattaaatccgtaaatgaaaatcaaatgacaagcattgattgactcacttcgagaagcaatttgagttgtcacttaaagctatttgtaaaagacccattttggcttttcttcaccaatgctaatgacacaaatttcgcatttactctttgttaaattgacttaatttattaatacaaattaaattaatttttaggagtaatatttttatcaactttttatttctatcaatttgaccagttttttatataaaattttttaataatagctttatattgtttcagagatgaaactaatttacactatatataatcacttgtgaattttacatttgatttatttaattttatttgttttatttattttgtcgcactatataagagcattaatgtgcctttggtttgctcgataaattaaattaattatgaagagtttaaaaaatgtaatcaaattaatggccaaatagagtgttttaaacaatcccaaaaatttaattttctgccaaatgcaaatactggccaaaaattttgccaaaaatcctccatgaaactgatgaaaaagaaaaagcttattgtaatagtaaagtttatccccccttttttcgaaaatgttttttttttgttttcaaaagtcacaaaaacatgtttccatgggtttcggggtcgctgagcacgaatccggcacccatttcgaccaattccgaatcccggacccgaattcgaacaaaaatcgaaaattcaaatttt

SEQ ID NO: 32306 - DNA, 1786 bp, Heterodera glycines
  misc_feature (1624)..(1624): n is a, c, g, or t
ccccccccccccgcttcagagcacgacaaatatttcaacaaaaatttttaaaaattgactagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcaacaatcgttgcttaacttgccagatcggacgggtgcgcatgattccactgttccaagcaccccaccaaaagcaaaacgatataaccaaaatataaggaaaaattttttaaaaaaatttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcataaatccaacgcagaattaaagtaaaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacctgtaaataaagttttgtgtgtttcagagcactttctgaaaaaatacttatgaattaattttgcaaaaaataaatacaaacgaaagactcagattttccaaaatttttttgagccagctatgtcggcgctcatttcagagcaagatactgctgtaccggagagtatcccagaccagatagccacgcttctggtcagttaccattaagtatgacggatcgaattttcactaacacagctaagactacatctgttggcatattataaaaggccattaagaaattgttaaaatgtaagactttgcctgcaccgaaggtactcgctcgggctcttcacggactcgtggcggcacctgtccgcccactgcgacgactgtcaaatggccgcgaaaaacccaacaaaggcacaaattcagccttggaaagcggcagacgaagtttttgagcgcatccatctcgactntgcgggcccatgcgaagacggccaaacgtatctcgttgtcgtcgacgcctattcaaactggccgggagtttgggagatgagtcgtgcaacagcgaaagaccgtcgctatgcttaaatcgtcgtccatcgaatgggaattccccgagaaatgtgtccgacaac

SEQ ID NO: 32307 - DNA, 1177 bp, Heterodera glycines
  misc_feature (1092)..(1092): n is a, c, g, or t
  misc_feature (1109)..(1109): n is a, c, g, or t
  misc_feature (1117)..(1117): n is a, c, g, or t
ttcctttttaatcctaaacatcagaagtgcttaaagtaagttgtaaataaaatctggtgcgccttagagcactttcgaaaaaaattatttaggaaacaaaaaaatcgattttttcaagtgtccgtttggggttctcaaacattctatggggagcaaacaccccaccaaaagcaaaacgaaagtacaggctataaggaaaaattttttaaaaaattttttctccccatcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatgcggagcaaaaatccaacgcagaattaaagtacaggctatagggaagctattccccgaagattcngtctccccataatctgngcgcatcnggttcggggggactgcccccgaaacaaaataaatcgatttttttcagtgttccgtttggg

SEQ ID NO: 32308 - DNA, 1263 bp, Heterodera glycines
caggacagagccaaaccccccccccccctcgtttttccccgtatttcgcttgcccgatttctgtgtgttccacacaaattttccaaaaaattgaaaaaaattactttaaacagccggcggcggtcggcctgttctgcaccatcaaatacgttttggccaacagcattcggctctcatatttcttttcgcgcaacaatgtgtccaactgttggcgaatgccgggctctcgcaccgcgtcattttcagcacaaatgtacgtggcgctgtccggctgaatgaacggcacgtcgtcccaatggcactggaatggcaaaaaaaatgtatttacacagtttttttccacaaaaaaatgtttgcagatttcactcgaagaatataaatggtgggaacagcgcgtccacaaaaaaatgtttttcaccgaatttagacaaaaaattcggggggggggggaggaggagccgggaaaactgactccaaatatgaccatacatgcacaaggggtggtatgggccgagggccatacgatgtacgatcgtaccagggggggggggtggtacgaggccaatttttcttacgatggggtccatgaccaaaaaaattttaacgacctttttttttttgctcatcgctgatcttttttcgcttgcgcataaaattccgcttaataagctcgcaatttaccaagaaatgaaaaaaataacaaaaatgaaacgcaaaactagtcgtccaaatcgtctgtcaaaaaactgttcagggtcccatcagatttggcaggcgcagtcggaatcgccactttcttttttggcaacaaaaattttttagaagaacactccgccgtccacggcacatttaaccccgaagaacactcccccgccaaaggcacgtccgaaactgagtacttttccgttttggggccttaatttgaatttaaaaaaaaagcaacaaaggacgcgctcttaggcccaaaacggaaaattacccatttttgaagaacactccgccgcccaaggcatctgaaagcgccgagccgaccattccgaagcccatggcatttccaattgcttcgtcccccccggcaccgatggatctttgatattttgggcatttaggtcggcacgtcttatcgctgaaaatcttgatgcaaaacttagaattcgccttaatggacccccggttgaacaaatttcaatggattcatttaaacaacgatggttattagaagaggggcattatgccagtgacagcctaatgcgaacacatgat

SEQ ID NO: 32309 - DNA, 1177 bp, Heterodera glycines
ccctacaaagggtcggttggaaaaattgctgttcccagaagaatagattttctcaagaaaatgcctatctttttttttctacacccgtgtacatgtgggtttttccccaaaaaacgcattactatctgcggttgaggcctacaaaaggtcggttgaaaaattgctgtctcagaagaatagatattctcagaaaaatggctatctctttttttctacaccgttgtacatgtggggtttccccaaaaacgcattactatctgcggttgagccctacaaaatgtcgggttgaaaattgctttctcagaagaatagatattctcagaaaatggctatctctttttttctacaccgttgtacatgtggggtttccccaaaaacgcattactatctgcggttgagccctacaaaatgtcggtttgaaaattgctttctcagaagaatagatattctcagaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaatgtcgggttgaaaattgctttctcagaagaatagatattctcagaaaatggctatctctttttttctacaccgttgtacatgtgggttttccccaaaaacgcattactatctgcggttgagccctacaaaatgtcgggttgaaaattgctttctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaatggctatctctttttttctacaccgttgtacatgtggggtttccccaaaacgcattactatc

SEQ ID NO: 32310 - DNA, 1729 bp, Heterodera glycines
  misc_feature (557)..(557): n is a, c, g, or t
  misc_feature (563)..(564): n is a, c, g, or t
  misc_feature (582)..(582): n is a, c, g, or t
  misc_feature (584)..(584): n is a, c, g, or t
  misc_feature (586)..(586): n is a, c, g, or t
  misc_feature (588)..(588): n is a, c, g, or t
  misc_feature (613)..(615): n is a, c, g, or t
  misc_feature (625)..(626): n is a, c, g, or t
  misc_feature (640)..(641): n is a, c, g, or t
  misc_feature (664)..(664): n is a, c, g, or t
  misc_feature (672)..(673): n is a, c, g, or t
  misc_feature (677)..(677): n is a, c, g, or t
  misc_feature (700)..(700): n is a, c, g, or t
aaaaagtttgaaatagtgacgaatagtgacataatttcagccaaaaattgagcaaaaataatttttattcactgattccattgcaaatgagtagggctgggatttttaagggcaaaaaaacaaaataggtacataaaaaaataattttttaaattaaaattcttgccacgaaaatacctttttgagaaaatttttttcatttcttaggagtgctttttgaaattttttttgtcgattcttaggggtgtattttttggttttattgcatttttgttaaagaattttccaagaaatgtcgaaatagtgacgaaacgccaaaatagtgatttttaactattttagtgacgaagtcgccaaaatagtgatttctagtgaccgataatgacatcagaatcgaaaaatttttatgcggaaatgcgttttttaagctcctttcttcaaaacaattattgctgattataatgtggcgtctttcatttgctgatacaaaaccaatttcggctaaggttatggagggggagggggtccttttgaatagcgacccaattttgggtagncttatnnaatctataaaaagaagantntntntttctttttctcatttcatccactnnnaaccattacnnataaaaacattccnnaaaaatcattaatactttttatnatcattannattnaaatttttaattaatcgaaaaanttatttaccttattattattatattattaaatgtgacaaataagtagcaagaaaaaaaaatcaattttacaatttaatgagtgttgtaatcatgtcaatatttcactttaaaatgtgtagaatttataagagaaaaatataaaattcattttgagaaatatttttatattcttatttatttcgttcttatcaaaaaatattattataatttctaaaaaaaaattctgcaatgaatcagtggatattattctttttaattgtattatttttaattattcaaattgaaattggagcggaaaagaaaaaattggaacaaaaaacatttgacgaaatatttggagaaaaatgggaagaaaaagaaaatgaacagaaaaagagagaaattgttcaaaaattcaacaaaattaaagagaaaattttacaaaaagagagaaaatattcaacaaaagaatggaataaaattgaattgaaaatcggaaaaaaattgggcacaaatcgccaatatatttaccaatggatcaaagaattaaatcttcagaaaataaaatcttacaaatcaaaaacggatgaacaaaaaattgaatttgtgcaaaaatttattaccatgaaaaatgaatataagcaaaatggaagaaaatattcgagaaaagaatggcaccaaaattatgccgaaatttgtaagaaaattggagtaagttatggaacaattgaaaaatggaagaaacaattcggaatccgtgaaagaatgacggagaaagaaaaaatggaaaaagtgaaaatttattttcatataaaaagagaaaatccaaaaataagtgatgaaaaaattgcaaaaatagtgaaaattaatcgacggaccattgacaaatggaagaaacgctttggggaagaataaatgaggattggatacattaaagagattaacatttcgttctattattagcatttttctttatgaaaaatattaaatgctttttacacattttaaggaaattaaaattacttttagccatttttaaatttttattg

SEQ ID NO: 32311 - DNA, 301 bp, Heterodera glycines
cggtgtcatctatgttactagatcggggatcgatccccttgcggccgctcgagcaggacctgcagaagctagcttgatgtggatcagattgtcgtttcccgccttcagtttaaactatcaagagagggaggagagggttggagaaggaaaggaaaaaaaaatgaaggaggagaaagggtgggtggcggaagaagagaagggtggggggagtatgagtatgatggtcaatatggagaaaaagaaagagtaattaccaattttttttcaattcaaaaatgtagatgtccgcagcgttattata

SEQ ID NO: 32312 - DNA, 1001 bp, Heterodera glycines
  misc_feature (21)..(21): n is a, c, g, or t
agctgttcttatagtgtattncattttttacaatggtttctcctaaaaagaaaaggattcattattttgtaaatttattttccctaaaattatttcatgaaaaagttttaagtctatttttaacctacgactctcaagcgacttttgatcataaatgtttaacaattcagcataattaggtaaatcagcagcataattgttacgtctaaatattactctcaaaaaagttttttggacattctccagtttttcattcattggtttggccacctgttttatttgggcgcggtccggcaactcggacatggccaaaagtgtgaatttttccgtgtcgaatctgtacagtgccgaatagcaactgctttggctgctgctccgtttgctccgcgccgcctttgctgccaaacatttcattcggcgtgtgctgttcagcaacggattcttacgacggatcttccggggaaatgtgaggggatatattttaagatttaattgtaaaattaatttattcgaatttaaattctcgaaaatttatgaacataaaaaatttgagccagaaaataatggacgactttgtgtcattcatcgtcaacaattatcgccattaattatttcggcctgattttcgtttgtttgtccacctgttcaagcaggtcagacgcacttggcctctgttccgggtcggcgcggaacaactcgcgcacaatcagccgaatgtcctgcgaataagggcccttcaggggttcgtattcgcactgaaaacggtgccaaaaatggaagataaaataattttattttttttaatgcaacatttataattttgtggatcaaaattgtcaaattgtccgcgtcaaacggtttccgcaaggtgcacatttcgtacagacagcagcccatcgcccacatgtccgacttggcgttgtacgaacgcccttcacactttagggaataaatgtaaaattaaatttcgcaaattaaaacgcaaccaaaaaattgctaaa

SEQ ID NO: 32313 - DNA, 2100 bp, Heterodera glycines
  misc_feature (21)..(22): n is a, c, g, or t
attgagctcttcagtcacatnnaagctgttacgctctttcccgcaccaaggtcccacaatgctgacaagacatataaatttgccctttgttttaaatgtgacgtcgttgcagttgcgagtctcaatgtcggttggcaacaatttaggttgtcctaatttggtccatgtttcaatggtaaggactgtcgcctgagctcctgtgtcgacattcatttcaatttttgtgccgttaatttcgaccaaaattgtccaccaccgtccttgagtcgtgccaatttgtaggcatgttgctttgacttggaccgtgtgaaatgaacggcgttggttctttgtcgtgaatgctccctttcggcaaacattagcaatgtggccttgtttttggcacttgtggcatgtcgcttctcggaagcgacaatctgatctccagtgatcagtaccaccacatgagccgcacggctgggtcggttgtccacgaattgcttttcctcctgtggccggtttttgctgtgccgggtggttttgttgcacggcatttgctgaattggccttggattttgattctctccactgttgagggcgagttcggatggcatttgtcgaagctggcgtggaaaggagtgacaaagcactatctttgacaatttggatcgcttttaactcctcttccaactttttgagtgtgactgtggtgccacttttctcggcttcttccatcattttaagacatttctgcctcaaatcgtgatattcatccctcagtgaaatcaccaaaatcatgcatttgagctgttccttggtaaggctcaaattggcatgctcacacgctgcgttgatttgagcaaccaaagaactgatgacttggtttggatgccgtctgattcgaaagcattcatatcggcggacgaaaagagagcgcgtttcagcgaacaactcctttaatctgttgattgattcagcccacgaagctttgtcgggtaactccgggctgattgtgtccctgtacttcgtgtaatcttcgtctccgagttttcccaacaatagtcggactttggcttgctcggttaagtctttgccatcctcttcaatcaatatgccgaagcgtttgtgccactgttcaaatgtttgaccattctcggggtcataaacaaactttgaaattctactgtcgattgagctggccaaattcgcttggcttatgcttgaagcggcatttccttggagcaaagcggtcaaaagttgttgaatttgttcggcgttcattgtccgtcaattgaaattgttgaaaaaaaaaatccacaaaatccacacctggtggatgcttacaccgtcttggtgctaagctgacgaatttgttgaaaaaaacgcttcttgcggaacctcacccttcttaggtctattggtttttttttgagttaaactgcttcttagcagacctcacaccacctgggtgctattggtttttgttgaatttgcagtggtccttgtcctcagtgatgaagaaaggctgctgactgcgccaatttgttgtgttcttccacttagaacacacaaagaaaaataaataaataaataattttattgattcggtcggagggcaaattgggaaataaaatataaatgaatgatgaaaggaaagaacaaataatgggaggaggtgtccacttttatggacgagggagggggcggatggacatagaaataacaaataaagtcaataagtcagatcgccataaattcaaattattcactacccaacaatcagaaataattgtgatttattaacatttagatttgccaattcatttttatgtaaagcaattcttatgttttcctgttagcttatatattcacagggaaaatgttagttcaattatcattataaaagcttttttaataaattattatacaaaggtaaattttatatcatttgatttattatttatttttcgagaaaaattttagttcagtcttaaaaaattcttgactgccctccccctactagttgttcatctctaagctgaagatggtttatttgttcgttgaggattttctggttatgaatatttattaagttagttttttatattacttaaaagtatt

SEQ ID NO: 32314 - DNA, 1330 bp, Heterodera glycines
attgaacgctaacggacgacctaatgggaaaaaaatcccctaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcggagagtcaattagcaaaaaatatgagtgatcgaattttcact

SEQ ID NO: 32315 - DNA, 847 bp, Heterodera glycines
caacaccaagtcgagcagatagatcagatcagcggtgtaatcgcagagaagccaaaggcgaaggttggacgaagtctgaacaattgagggaagggggagggattgggagaggaagtcggacaaaaaagggacacgaaaagcgatggaaaaatggagacccaattaagcgatgaaaagcgacattgcctgataagggtaggaacagcgtagcggaatgacaaaagcattgtacagaaaagcgaccagcacaaaggaaagccatccgacgtacaaagagccttcagaatgggaaaagcgatcagaaacagtgaccaaaggagcgaagaagcaccgaaagtgtcaatgtgagaaggcaaaaggcgcgacggagtggccacaatgtcctccaattggtcaccctttaaattttcaatagtttttaggccccaagtcattcagtgcccccgggggatcacccggtgcagtccgatcagtgacaccagcgatgcttttgcccccgcttccgagtccgccaccgtcgtcccctcctcctccgcgcgttcgtcgtccggcgtcggctcgcgcactaactgaacgtccagcaaaagtcaatgaatcggctttccctcccaaatgctcttctcattttacctcgtcacgaactgcagaagtgcgtcttctaaggtcgcgcgcaaattcgtgcagtttttccttgacaatgaaagaaagttgagaggcggtgtccgtgtgatggcgcgaactgaaagaaatggacgaaaaatggacgaaaagccgagtaaaaaggccggggggggggggagtggcgccaaccttgcggaccaggccgttttcgcgccagcgcagtttt

SEQ ID NO: 32316 - DNA, 1206 bp, Heterodera glycines
agtccctcgtcttttttcacgcttttctttggttgtggcactcacggattatctcaaattattatctctttgaattcgttgcttttccattttctcttgatcattttgaaaattttgatattgttcaccttctcttgctacaaattttccaataaattttcccatttcataatttataagcaaaaaaaaaaaaaaaatctttgaaataaacaaataaataaattgtaaaattgatataaattattttaagaaaaaaggccccctggaaatactattgttcactttatcgaaactgacaaaattattcgtttcgaacaattctttaattaatttgtgataattacaaaaaataaataaatatgaaaaaattacgaattttaaaggcaatcaaaaaaaaaaaaattgaaatagcgaacgccggtaatctttggaattgatatcccgacggaaaaagatagaaaaaggaatttctgtgcttgctatttttctaggttaaaaaatatagacgaatcaaggcttggctttagcaaaatcattggttttagttattcatcaagtaaatgatttcaaaatttgccagatcgcagtgcagcaccctttcggcagtcgtccgcgagcgaattgcggaggggtcgacagtaatgagtagggaagcaacttttagtgaaaaaactttttttttgctcaattgttttgaagaaaggagctcaaaaaacgcatcttcggcgtcgcccagttggtagcgcccagtcggcggcgcccagtcgtgcccgtccgtaagaatcgacctaaaaaaatttcaaaaaaatacacccctaagaatcaagctaaaatttttcaaaatatactcctatgaaatgaaaaaaaattttctcaaaaatttactttcttggcaaaaatttttaattttaaaaatttttttaggtaactactaatttgggtttggaaaaatttcacaaaaattctccccccaaattttttttcttgttcaatattttctaagaaaatattttgtaactgcaatcagtgaataaaatctttttccttaattttaaattattttcaaattaaaaaacagctatttaaaaaattacacccctaaatttggaactttttcgccactattttggaatttttttctcactatttagttaattattttgggattttttatcactaaaaatccgatccctagttatcagtaaa

SEQ ID NO: 32317 - DNA, 993 bp, Heterodera glycines
gagcagctcgagctctacagaaggtatgaaagaaaaaatagtattctgggacttttcagaatcagaattattctccaatgtgccccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaacctcagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggtttcagaaaaaatgccttgtggtgaaaacaatattca

SEQ ID NO: 32318 - DNA, 1318 bp, Heterodera glycines
  misc_feature (77)..(77): n is a, c, g, or t
  misc_feature (1171)..(1171): n is a, c, g, or t
  misc_feature (1221)..(1221): n is a, c, g, or t
  misc_feature (1240)..(1240): n is a, c, g, or t
  misc_feature (1292)..(1292): n is a, c, g, or t
cactttctgctcaacttccagcaaatgtttcatcaaaatgaaacccgcaaaatttttttgaacaaatggctaaaatntaaaattgaaaatattttggctcaaaacgagatttataagtggacaaactttttattacagactttgtacatttttgcgcaattttataaataactaaaatactaatgaattaaaaatcttatgggtcattgatacttcttcaggttctccattaatcatttttacaataggttcttctagcaccctccgaaccaagaaacattccctgtctcggacaaccaaccgagttcggaacggcccattttggtggtgcattgttcaaggtggttattgctgacaaatctgtgccaatttctcccagatttgatgattttgctggtgccgattgcccactcactcgttttgatttaatgctaactcttaacgagttcattccgaccgataagcatttgttcagtcggcaccgcttacacgaagcagaatctacaaaatcatacgaaaagataagtgttaatgatatcaaaataaggaataatttctgtcatagcttagacttgaacttgtttacagattttttttaaatcggtcaaacaaataattgttcatttggatatactattcgaaagagaaaactttgggcttatttaataagccatatttcagattttaaattgacttcatgaattttattttttaaacacaactttcaaaaatgaaattcttcgaaaattttgaaagaattttaatcgcgggattcaacaaaaaaataaataaaataataatagtttgtatattgtaaggactagatgttggttatctcatggaacattaattttgttaaaaaaaatttctctgattcatcataaattgttgattcaacaaggtccaaaaagagtttcgatggtggtataacttattcaatatggcaccatttcaaaaaatccatgcaattattatgttcagtcataggcgttacctacacccaaatttgcaatttttcaagaaaaactaaaaataaattctgaaaaagccccttatctcaagaaccctatggggtcgatttaaaaaacatgttaaatttgtcgactactatgacaaaacttattccccaacctaataattaaaaaatgatattttttgaataaaaatttanatgatttaatttaattagtttataatgttttttgttttttttgccctttntccaattcgcacgttcttnccgttttttgcatttgtattccttcttcaacgaaattgaaacggcgaaaaanatgtttacagcctgaatttttatttg

SEQ ID NO: 32319 - DNA, 1116 bp, Heterodera glycines
  misc_feature (15)..(15): n is a, c, g, or t
tagcattaatttaanttattgtagtacaaaagaccaaccccaccccgtattttttcaaacttaaacattaatgtactgtaatcggattttattgtaaatttgttcccatcgtaattcacgctttaaatttcaaatcatcatgctaccgtaactcgttttgaagaaattcgaattcattgatgcatttttaaaaaaaaatttaccatatccaattgtaagaaaagtgacacacatcatccacagcgtattataatagctaagcacgtccatttcatcattgctaattggtttaattatttatttaaaagttttttaagcacaatgaatgcacctttcacataagcgaagaatataggcaccaataagccaaaaacagaactaaaattcaatttttccaaaaatttcttaaattttaaataaatgtactgaccacaaatgcagaaagagttgggcctaaataataatgatttgtattttatataagtttattaagaattgaaccatttcgaaagttagttttaaaaatgaaaataaaactttatagaaattaagaagcatatagattgacaggtgactaattctaatttaatctcggatcactctcgtagagtaataaaagagaaaatataccaaaattaaattacaatttttttaaaattaatttattagcaatcagtattctgccccctcgcatagagcaaaaaaaaaaaaatgaaaattatttaaaataaaaattcacaaaaaaaatttagaacccacctgggtggaggaaaagcatacgcttcaacaggaagcgcgtgtccgtcttcacacaattcagtcccgcgatggattttgctgccgcgtccgtgctgaggcgtgagcgcaaatgcaacacgcgtggtaaccagtatagccggaggaacatcagtgcgcacgcgaacgcgtcaccaccgcatggcaaacgcaaaagcggcaatggcacaacggcacacagcacaagttcgagcagtatcagcacccgttggcgcaagtggaccgcacagtgccaacgcttgattgagttcacatgcatccgaaactgtgaagatgggttgaaaaacatttggacaggggctagttagacatagaaaattt

SEQ ID NO: 32320 - DNA, 1285 bp, Heterodera glycines
tttcacagcatgtcaccggatttttagtgattttgggacacaaaattttgtgtgaatttgtttcccccattccaatatttctaattgaatttttttgttttgaaattttctcgctttttctttccgcgaggctctcaaatttcggagtgttgaaatttggtggtgctaaaacatgcggaaaaaaaacaaaagtggtcgtaatttgataggcaccatttccatacacataatagaaaaatgggttctactaaagttgattttgaaagaattggaggccaaaaaagcgaaaaaaaatcaaataaaattaagcaaatatttgcgtaattcaaaatttaaaagcgaatgaaaaaagggcaaatttatttccctaaattttattggggtttttgaccatttttcgtcaaaaatcaaaattgaaaattttttatttgtttgttttttgaggcctttttttgcacagactctccaataaaaaaaatctgaataatttacaaatattcaatttaaataagaatttataaatttatttgttaatttgcaaattttcctaagcattttttgttttgttttatatttttttgaaaaaatataattttaaataaattattttttttaaggaaattttttttacaaataatctaaaattgaataaaatttactaaaaacggcaaaacataatcaaacagttaacaaaattgctccagggctcgcatctgttcttttttcaaatattgtatttattttttcttttttagtacttggacatacataccctatgaaattttatcaatttgtaacaaaatttatttaaaatctgtttttttaaattggacaatttttaattaaaaccattttttggcgtccctatttgtcctaattgttcaacaaaaaaaaaaacaactagtgagccatgatttgttccatagttgcattttaaaagtcaaataatggatttttatttgccaaaatgttttttgtatttaatttccaatttttaaaaaaaaaaatccggtgtgtttcagagcttccactttctgaaaaaatatttatgaactaatttttacaaaaaaattttaaaataacaaaaactcagaattttgaaaatttttttaaaaccaataagcgttgaaaaattttcaggttaagttagttctgtgccggggagaatgcctctaaaatttggtgcgattttattaattatagaaagggttaagttcgataaaatttttaaaatttaaacctaaaaaattaggcataattaaaattttcataaaattttttttaa

SEQ ID NO: 32321 - DNA, 1767 bp, Heterodera glycines
  misc_feature (1422)..(1422): n is a, c, g, or t
gctattttactcgaagtttcgggaaaaaatacacccctaaagattgagttttcaatgtgaaaatgcaccactagtgattgacttggtaaacttaaaattaatatatatttaaactatttgcttgtgttttttcgcataaaatttaacaattaaaatcgcaaaattttttcatttttggactaaatctgttaacaatgcactaaaaatttcaaaaatttcaccggcggcgcctatcggcaccgccggagctccaaaatttcctttattttttaaatgctcaaaaaccgtgaatattctaagaagtataaaaatttacaaaatatattgctcaaaaagttaattatatttatttatcgaaaagggttggttggtctctagaaactagagaccggcgcgggacgggatcccgcgcgggattttgcgagatcccagtccgcaatcccgcattttttgaaaaatttccgatttcttgcaccgcaaaaaagtggttttgaaaagaaaaaaaaatagtcaaatttatgaaccgttaataatttgatttccgatcaactttttaccgtcggatccaatcgaaaaatcttagtcgacccatcagccccttttaatgcatcccgacagcccctaaaaattaatttatggaaattttttgaatttaattgaaatttttcgaattttccaaaatcctgcaatcacgcacgggatcccgcaaattttaaatgcgggatttgcgggattaattccgcgggatcccgtcccgcaaaaaattttgagttccagtcccgcagcgggatccgcaaatttgaaatttccggtctctactagaaactgcgtcaattgattaaattcgatatttaaccgaaattatgtgatgaaaaaaattttgaaaaaacttcggcttcggcttcgaaaacttcgggttttttgggcttcgagcttcggacttcggcttcgaataaaaattgggcttcgccttcggcttcggcttcgagtgctaagccgagcttcgcccagccctgatccgcaggggaatgctttggttggaaattggcaaattttccgaatttcactagggccggtcggaagtgaacgtttgggcgaacaagtagctaacaaataaggggcattccactgcaaatattggcaactgtggaacaaagacaaggagctaaatagtgggccttttcatcaaaatcaaatcaccagtggcaaaaggttgccaacttcaccggcagggatggaagctaatccatcccgaaattccgtttcgcgttattttcgggaaatggcttgaaaagggaaacgcccggctcaccgcgatcagccacacgaagattccaaacacattcagcagtcttaccacgattaggcgctttttaacataattgttgtcgttgtcgtccgtcctcgttttttacgggctanggtcgtttcataaaaactaccaattttgcagatttttcgagaaaaatccatcataactttttttttaaatacaaccaaaaaaataatcttcgtaacatagctcttagattgctctattagcataaaaaattttagaatatttcagaaagttatgcctatttttttttctgaaattttttatgctaatagaacaatctaagagctattgtatgatatcaaataattatttaattaggttgtgtttaaaaaagttgtgacaaatttttctcgaaaaagtgtaaaattggcagtttttacgaacgacctagcaccgtttttttcgtcaaaatcatcgtcgagcgagca

SEQ ID NO: 32322 - DNA, 1121 bp, Heterodera glycines
actttaaataaaaaattgagaaataatgaaagaaagtattttttaaatatgtatataaattaattttagtttctaagttgattgacgaggataaactccctcaccttcttttctatgggcctcctggaacaggcaaaacgagcacaattttggcagctgctcggaaaattttttcacccaaaaacattcaatctcgtgttctcgaagtaatttttcgttttttaatttctttcattactcaatagaccctaacaaacatgatcagagatgctcctaaattgaatattttcgtttttcttgaattatcctgttttcgtttttgccaatataattccgggcctttaattatggataaccagagaacataatgattaattttcccaacgcgtcattaactttcctcccatatttaagttaaatgcttcggatgaacgtgggattggagtggtgcgtgagaagatcatcaacttcacaagttcccaagggttgcatgacatggcatgttcaaaagggaaacgtatggtcaaattggttattcttgatgaggccgacgcaatgacgaaagatgctcagaatgcgttgagacgtattatcgaaaagtacacggacaccacacgcttttgcatcatctgtaactatctttcgcgcattattcccgcccttcagtcgcggtgcactcggtaaaatgactgaatttattttgaaataacaactgttttcagtttccgttttgcaccgctaagtcaaaagcaagtgttgccacggttggattacattattgaacaggaaaggctgcccgctgtgacggacggagccaaaaattctctattcaaactatcgaagggcgacatgcgacgggtcattaacattcttcaggtttttagcaaatgtatgaaatggcatcatcaaatgcgaattgatcacagagcacggctttgtcaacatcggctgaaatagacgaggaaaacatttacaaatgtgtgggctatccccacccgaacgttgtcaaagacattttccgtgctcttctcgacaattcaattgaaattgcatacaaaagtaaattaaaaattttgaatatttttctgtttatgtctttttttgtggcaagatttattttt

SEQ ID NO: 32323 - DNA, 966 bp, Heterodera glycines
  misc_feature (937)..(937): n is a, c, g, or t
cacaaagtacatcagcaaagtgcggagcacttctctcttatagtaaatgttgtcactcactttaccataagaaaggaaacatacggctcgtagttctcttcgtccagtccggtatacgaccagcggtcgtaacggtaccgcgtgaattggcgtgggaccgaaaattgaacaaatgaacagaaacaaaaagtgaaacttacgggttcattccaattgcgacgatgcattgtgtgcgagtaattgtcgtaagggtctctctgttcgtacgtgacaacgccaatttcgggatagtctccaatctttaaaaattttaaacgacataaaggccaataaatgaacacaaacgtggttgacgaagtcgagtgggtgatggggccttaacaaagcaatgggatttgttacgtccgtttttcaacttctcccaacggtcacttgtaatcctcgggtcgtagtccgtattttatggcagccgcccttcgttcttcttcgttacgcgggtaaggcccaggcatatgatctctgaattcaaatgcaaatggaaggcaacggaggggcaactcaaagacatggggtgcactcacctcgggtaccatccgggttgagaaacggctccacggcctaaaattgtattaaaaggtaaagtgcgaaatgagaatgggaacaccacttacataacggggccgaagtatgcaaggagcgacgaattggaatttttgagagaaccatcgagcgaagaaagtacaacacttgtaatgaacaaaacatagaaaaacaaaataaaaaacaaacagacaataagagaacagggagaaacgaagggaaattgctaacgaaattagctaatcattgtttatcaaagggagaataaaacagagaaaaataaggcgtcaatcgtctgctttggtccatcgtctgctaatctttttttacttcttcnccttttcaatgcctgacgattttttcagc

SEQ ID NO: 32324 - DNA, 1697 bp, Heterodera glycines
  misc_feature (53)..(54): n is a, c, g, or t
  misc_feature (56)..(56): n is a, c, g, or t
  misc_feature (61)..(65): n is a, c, g, or t
  misc_feature (76)..(76): n is a, c, g, or t
  misc_feature (89)..(89): n is a, c, g, or t
  misc_feature (94)..(94): n is a, c, g, or t
  misc_feature (105)..(109): n is a, c, g, or t
  misc_feature (120)..(120): n is a, c, g, or t
  misc_feature (126)..(127): n is a, c, g, or t
  misc_feature (135)..(137): n is a, c, g, or t
tttattggtttttgagaagaaatgtataatatcaatttctgtcaaaaaaaaanngngaatnnnnngggagaactgnataacctataagngcaanactatgctgannnnngaaaaaagccncaaaannagccatcnnnatgtaaaattgctaccaaaaagtaccaaattttcaagtttttgtcgatatgttgatttttttttcagttgggagccctggtttgaacttatgataaaaatttttaaaaaattcgaaattacatataaaatattgaaaagcaatttttttttgttgcattgtttaaaaccacgacttaaaatttatttttaaacgaacaacctttatttgatttaatttaaaattaagaatttttgcgtttgtccttgtcacaggtgtaatcgggaaatcggacgttttggcttataataatatattttgctgttacactcattatgcgggaaaaaacactgaccgacaatatgtccaatccacgaagtgtcaaggcttggttgaaatagagccatggttttaaaacttctggacatttcgtggctttctattacatattacacgacgataaaaaggacccaaatttaattaatttaaaaatttaatgcatcaaaactttttttagaagcctcaaaattaaacctgcttgatatcgttcggtaactttaagcattcaatgttagcttatacaatttcaaaaaatttctttgctttcataaaatatgacggaaaaagttaagaacttttatcacatttttcgctgctattagataaatttataagcattaaagttatcaatttattttatggccgtgtaaactacaatgtagctgatttcatggctttttacttaatatgggcttggatactttgtgggtccgtcgacattaagtttgggcactcactatatggaggaatttcgaaaaaaatatataattttgtaaaatcttattaaaatttaaaattaaatttagtaatttaacaacagatgtgcttacgaatttatattttcttgaaaataaaaaactttaattatggaaacctcttgaacagactgagccttgtaatgattacaaataatacatatgtatgaaattgatatataatgaattataatgagcctagcaaaataagcatggttaacacaccgtttcaaaaaacgagacatgaaccaataaatagagagtgcagagaaaaaaacatctctctttttggcgtactatttatttatctctgttaatagagaaaaacaacattcacttctctctaagaaaattttttttacgttaacagattttctttaaattttgcatatcgatagagaaaaaaattacgaacaaaattggagggtttttggaagcaaaaagtgggttagctaaaaagttattcgagaaacaaaatttcgaatgctcatattttttttctaactcatcaaattgcttagcatttgcttataaaaagcttctcctcataaagagctttcgaatgatactaagattgtccaatttggttgggaaaaaccttcaaaaataattcccaaaattcgtcattttttaatattttggacaaaaataaatgaaaatattcatgttgcacaacggactcgaaccaccaccctttgtccctttactatcttacaaaaaccacttcgccacacatgcaaatctttttggaactgggaggccaaaat

SEQ ID NO: 32325 - DNA, 256 bp, Heterodera glycines
ggggacctctagagtctgcggacatctacatttttgaattgaaaagattggttcttctctttctttttctccatattgaccatcatactcatactccccccacccttttcttcttccgccacctacctccctctcctgatagtttaaactgaaggcgggaaacgacaatctgatccccatcaagctagcttctgcaggtcctgctcgagcggccgcccgggggtcgatccccgatctagtaacatagatgacaccg

SEQ ID NO: 32326 - DNA, 941 bp, Heterodera glycines
  misc_feature (50)..(50): n is a, c, g, or t
atagaatttctaaaaattcaacaaaaggactaactattctacttggccgngtatccaacaagagaagcatagaatggcatcttcggttactgatttactcattaaaattccagattggacggatagaatttctaaaaattcaacaaaaggactaacaattatttcttcccgtgtatccaacaagagaagcatagaatttcatttacggttcctgatttactcattaaaattccaaaagccgattggacggatagaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaagagaagcagagaatttcatttacggttcctgatttactcattaaaattccaaaagccgatatgacggatagaatttctaaaaattcaacaaaaggactaacaattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaagagaagcatagaatgtcatttacggttactgatttactcattaaaattccaaaagccgattggacggatagaatttctaaaaattcaacaaagggataactattatttcttcccgtgaatccacaagagaagcagagaatttcatttacgggtactgatttactcatttaaattccaaaagccgatttgacgattaaaattttaaaaattaaccaaaggactaactattatttcttcccgggtatc

SEQ ID NO: 32327 - DNA, 666 bp, Heterodera glycines
ccaccgcaaaggccgaggaatgttcatgtgccacaactcccttcaaacggacagccgcaaaacccatggaatgttcatgtgccgcaattcccttcaaacggaccaccgcaaagcccaaggaatgttcatgtgccacaactcccttcaaacggaccaccgcaaagcccaaggaatgttcatgtgccacaactcccttcaaacggaccaccgcaaaacccatggaatgttcatgtgccgcaattcccttcaaacggaccaccgcaaagcccatggaatgttcatgtgccgcaattcccttcaaacggaccaccgcaaagcccaaggaatgttcatgtgccgcaattcccttcaaacggaccaccgcaaagcccatggaatgttcatgtgccgcaattcccttcaaacggaccaccgcaaagcccatggaatgttcatgtgccacaactcccttcaaacggaccaccgcaaagcccatggaatgttcatgtgccgcaattcccttcaaacggaccaccgcaaagcccaaggaatgatcatgtgccacaactcccttcaaacggaccaccccaaagcccatggaatgttcatgtgcccccactcccttcaaacgaccaaccgcaaaaccatggaatggtcatgtgccgccaattccttcaaacgaaccac

SEQ ID NO: 32328 - DNA, 1472 bp, Heterodera glycines
  misc_feature (1449)..(1449): n is a, c, g, or t
cggattctttttgctgcttccattcttccatttcgaattgcccttttcctcccccctcaaatgcgttctcctccgcctcctcctccgatttttccagggcggcacttccatccaaaaactttggcatttctcttctcggagtcacttgaggctgatgagccggcacgaccgaggcaaatgcaattaaccgattaagtgatttgataaggaacaaaaaggcacagaaacgcaagaagaaaggcattgcgtgaaaaatgggcccaaaatccgaccctttaaccttaattccgattaaaaaaatatataaaaaattggaaaatatatttttaaaattcattttctcatatggattttattgggtaaataaaacattcccagcggcggcactcatttcgcctttcgcccattgttttaagttctcattcatatttcgggagaaagtgagcgggaaaggggggaggagaagataataatctaaaaataaaagtcaaaatgtgcacatccaattattcgcttcaatttccatttcgggggtcttaatctcgacattgaagggaaaccaattaataattgccaagcagataaaagtgccattcaacaaaaaatttaaaaaatttaattaaaataagataaaattataatttccacattatttttaagtttgtttaattcttattttattatgtatctctataaaacattttatctagttttattttaagtggattggaagctctgacctctgattaagaatttgatcaaacataaagactttgtttttcatttgaatgtattggcattttgtctcaattatttttggtaaattttttcgtttttttgccgtccatggtctctgttcaattactcaatttgtaaaactgttccccggacccaacattttccactcgcataaataaatttaatcataaattggtatttcagctaaacaggataattttgagagtatttctatttgcttttgcattcgctccctaaatgattttagtgagtttcgagtcataatattttacaactaaaaatggacgtggataggctctcccggggaaaaaataaataaaaagaggaaataaacagtctgtttacagttacctcctcgtcaacgacgtcctcacttcttacattgtctaaaaaattgaccccttttccaccgcaacaaaatgagtcgaaatcgtctcccaccagaacttttactagaaattgtcctctgcgttcgcaggggacacaacacgcctaacatttgtttctcttctcgcattttacgaactttcatggagcctcgagttgcactgtggcggagagtttggatttctgtatgggtttttagtgtgtctgtgttggtgctttgcttctgtttgcctatttttgatttatttgtcgttggcttggtggacttcttcaaacattctgattgtcttttcttgtgattgntcgcttttttatacgttttgcag

SEQ ID NO: 32329 - DNA, 1954 bp, Heterodera glycines
aaaaaacaaaaaagaactctttgttttttaaaaaaagtaaaaaaatatttaaaaatttaaattggaataaattacaaaaattaacaaacctcatatgagaagagactaaataagtacattaaactcaatttttatgtttataatattaattatacaaatgaattaatgattttttaataaacataattcattaaaaaattccataattaaataaaatatccacatcaattttttaggtgaaaaataacgctgataaataatttaaaaaatattggtttctaacaaagcaattaatgaactagcgacatgcacgatactatttttttgaaataaattctttaaatcattaaataaataataaatttcacggcattttttctatcaaatagattagctacacttacactatattgcgataataactctaaatctaaccaaattaaaaaaagaagaatgtagaggcgtaaatgttgcagcaccacctttaaaccatctcttaattaaaaatgattctggttaaataaattcaaccacccttttaaagaaattaatacacggaaaataagaattttatatgcactcagtaatttttttactttttcatcatttataaaagcatcaaagctagagattcggcttccaccaattatttccggtgagtttggttttcggttttttattaaaaagaaaatcaaaataatagcaactacagtcaggtgcaaaagtattgcctcaaaaaaaatttttttttaaaactggttttctcaaaaatataactctctttgtcgacgagcaaaattcggtacatgcgccaccccctccccctcctcttgaaggacacattctgtactggccgcttagacgcttgatccctgcatagctaattcttgaactgcggcaaggaaccaaggaaagacgtggtatgagttgtgagtccatcaatgcctgatcaaccgaaccggaaacgattctttttgaaactttggcagaattctttgaatcagaaacagcagatgctgacatgtcggctttctgaggtcggccgccaataacgcccctcttcttgccaatgtttcgcagcggagcagcgttcttcaccccacaaacctcactataacatatagtactatatttttatataatataagccttactgataatgcaaatccatgattccttgccataattttttgcactgacatgggcaacttactcttggttgttccgaatacctttaaaaaggatttaaaaggaacaccaatcagccaggtttaccagcattcatagtggaaaaatgccgaacagcagcgcaaaaaaactttgctttggcggattccagttggctgcaatttgaacagctgctgacaaagcatgcaaaaaccgggatgctgactcttgcattcgagacatttaccagtgttttgtcgtagcctcaaaatattgacaaatatgcaaaaaaattacataattctactttatttccaattcatcagcgtgtaaatgtgatgccgacgtgacagaacagtaacatcctgtctcgaaaacaccggcccccaagttttctttgcattctcgacaccgaacttttgtaaatttcttcttgcaagcatcattcatgcatttttttatagatgattctgcatacctacaaaaaaaaaatgcaaaaaaatcattgtgcaaacggaccaatcagcaaagggcttctcaaaatgccatttatgactgcaatctaccagtgcataaccatccatggcatccaactcctgcttgcaattgacgcatttgattgacgtgaattggcttcgtttaccgactggtaacaaagcagtttgcattggcttttctgaataaaaagttccaaaaaagaatattgtttttgcattaacctatcccttgctccaaacaattttcacgatcaacagcactcaacgtcaagtcgatgcaagtaacatca

SEQ ID NO: 32330 - DNA, 845 bp, Heterodera glycines
  misc_feature (822)..(822): n is a, c, g, or t
cgcgcgaatgataagcggtgacggagtcgggtgactttccaaaagaggtgggcggcggtacgtgtgccaagttcagaatgtcctccttcagaatccgtccgtctctgcccgacccggtcagtccgaccgtatctatgccatactcgcggatgaggcgccgatcgaccggcgatgcgattactttcggagattgagacaaaagcgaagacggagcgtcagttcttacagttggcaaaactgaaaatggaaattaaatgattaagaaggcataatagagaatgctgacaaagaaatcaccatttgttggtgcttccttttcttcttctgaagaaagttcggcaatttcaatgtcacccaatggaaggccaactttggcaatttcgtcgggttggtaataccttaacagcagaaaattgagaatctttgaggaaagatatcctccctaaatcttaagaaatgacaacggtcaaaaaagggtacatttttttgatttttccattgtatcggctggtgattgtattctgacgctttgtcactctgaactgaacaaagctcatcaaattcagcaatcgaatcgccttctttcacgtgccttaaaacgattgaatagaagtgaaatgcatagattaaccctaccattctttgacttgcacctccgcaatcccttcaccaatgtcggacaaattaaattggaccaatttgaacaaagattttgaaaaatgatacgaagcaaattgttgatagtggcattttgttaacaaaaggggcaaaaatttatgcaataaaaacatctaaaacactaatagaagtattttaaaccanaattatcagggctgccaaaaata

SEQ ID NO: 32331 - DNA, 1214 bp, Heterodera glycines
ataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaaattctaagaaaatttataagcatttgaagggttctcagcagtttccctgcaaaatttggtgagattctgatcagtctagaacgttgggtgatatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaaggttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttattcaataaaa

SEQ ID NO: 32332 - DNA, 1764 bp, Heterodera glycines
aattttaaaaaacaaccaaatctaggccccaaaacggaaagtacccaaaaattttttatcatcaatcggcagcaattgaaaaaaagagtttttttttgattcttcattgtttaaagattttttttttattattttggtttttctattttttatttttggtctaataaatattattttttttaatgttaagtgggttctgttttgctatcaaaattacaaaaattataccaaattcgaaaaaagagataaagcaaggacccggaaaatttttttttaatttttacttgcggatcagtgaattttatgctgctccatggtgtccaattttttatgaaacaagcatgcaaagggatgagtaaagacgaaatggaagagaaaaaggaagaaagggaaggaaacagagaatgcggaagaaaaaaatggacgaagaaaaaaaagggaattatggaagatcgaggagaagaagaagtaatagtataagagaacaaggaagaacgggaagatgaagaaccggaagaagaaatagaagagtaaaatgaataaaggaacgaaaatgcggaagaaacaatggaagagaaaagaaaaagaagacaattatggtgaagagaagaggaaaaaaagagtgaatgataaacaagtgtaagaggaagaagaaatggaaaatgaaaaagaaagaaagagaagacgaagaagcgaagataaaatggaagagaaaaaaaaggatgaattatagaagatggggaagaggagaatggtgaagaaaggtaacaggaagaagaagtggaagaggaaaatgatgaggaataaatcgatgagcaatcaaaatggtaattattaagaattaatttttaattttcgaaaaccataattttgatttgaattacattatcaccaaaaacggcatatcaatctgacactcttttacgcgattgaagtaataattttaattatttttaattaaattattattattattttttgcattttccgttaattgagatttatagacaaatcatcctcaccaaattagtacatataataaaaaatttaaaaacttttttgaattgtaccaaactaatgtaaattattggtgacgttgtgaattggacccaaatttggacgcattagtttaaatggactcattacccaaattgggagaatatttgaaacatttaagtgttcattgtataatttttttataagcaaaaaaagtgaaaaagtaagaaaaaaaaatcaaaataaattcaaacaaaaaattaagagaattaaaattaattttttatatattatttattaaaatattaaaaaaactttttaaatttattcgtctttcatgaaaaatacaaatatattttaattgttaaattctataaatcattgtcttagaccagagaataccacagatttttcactttatttttcaacataatttttgggtttttctgttcacaaaaaaatccgttactctgtcgatctcgagaataaattttaaaagaactgatttatgaagtttgatcggtcgagactttgcaattgcgcaacattcgagagaaagcaaatgcgaccaattttatgatcatttctttgatttgctgaacatttgaataaaaaaatttataacggataaagagagtataatgatcgaatcgggtttcggggttggcaattacatccaaacagttaaatttgtccattagttttttattgaccaattaaattcttggtataactataattttaagaatttttcattactgaaactaa

SEQ ID NO: 32333 - DNA, 916 bp, Heterodera glycines
aaattttatttaacatgttagtttaggcactctgatgctttttctatcaaaaagggagatgaataaaattttaaaaaatttttaatccctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttataaggagtccgaatccttcgggaatagcttcgatatacctctactttatttttaccttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctcccccataattgtttgagtacccccaaacggacacttgaaaaaatcgatttttttatttca

SEQ ID NO: 32334 - DNA, 1151 bp, Heterodera glycines
cgatccgttctccaagaagagagtgcggacggcgccgaccacggaaagttcggcggcgtcgatgccatcggattgcatttcccgcactttctcaaaaagtgctgcacaaattaaatgttctcttataaattcatttgttttaaggacgtcgtacaaaatttttacacctccgacagtattttttatgaaattgaacacgcttttgcgcaatttggaccatgtcaatttcatcgttttccaggtaatatatatggtgcaacaattgctcattatccaataaataaccgcctattttcataattataaaattcggattatccaaaggagccaaaatcgatgcaaataatccctcccgtctttagacattcactctaactgatgcatttgttgagcgattcgtttgtcacattgagccaaggattattacgaatggtattctcctcattcctttaatccacttaattatctcattttgaagaagtccgactgattcggttcgagcccggcaaaacccacaaccgtgccgttcgttttttcttcggcgccattctggggaacaaaattgtttggagttccctttcgccatagctgggaaatttggaacccacgtgcaatgttttatatacatttgaattggtttccacgtgatttttattgtattcatatattttatacccataaaatttggtacgattttattagttggtctttatttgagtacaaaaattacaaaaaaagaaagaaaattggatgttaggctgcaaaaagagattgtctcctcttcttcgtgttgtacacaaagtcttcggcccctccaccgtccttttccttcgactgcggaatccatgacggaattttgcgctttgtcagagatggttcatgtattccatctgcactaatgccatattcgtactcgaaaattgagaggattattctcagctggtcgtaattgagcaggttttcgggcagcagttccattattggcttcatccggattatgtcttaattactctcgattatttgtcaaaacgaagggttgtggtggtgctatgtcgatcgacgaaagttgctaaatttttgactaaatcaattcataacttttcttatacgcaaccaaattgcacaatcttgatatttacgatagcccttga

SEQ ID NO: 32335 - DNA, 1622 bp, Heterodera glycines
ggcgccggagtggaagccggacgagtcgagcagagacagcgaagccacagagggggcacggcacgacggaggcgagcacgaagtggcgccgaacagaggaggaccctgaagaaacgacggcaatccaaatttgctggcatgattggcccaccttttcttgcattctgttttctcggcattgtttggccaatgaaagcaaagtcatcacatgggcattgctgtcgtcgttgtccatgttcgggttatgacattttgcctttatgccattcttcggtggggtggcgcatggcattgcctttttcggcacttccgttgtccctcccggcaatggctgttcctgcttctgttgttgttgctgctgttgcggttgtacgatgttattatacgccaaacttttgaatggtttgtctgagcttttgtaacatttcaatttgaatccgccattctccgcagcctttcgcgcgacagtcaatgacctaagcttttttgaggtcaaaagtcgtgaaaagttgcccacttttttaaagattctcgactgccgaaactgacgccttcgctcatgaatccgatggcctcgtcgatcaattcgttcagattggcattcggactggcaattgcggccaaaatgagctgactctgagccgagaatggatttttatattctttaaaaaagttattaaagaaaaattatattaaaaaataaaaaaaaacaaaaaaaaatgaaaaaagtcactttttggctactttaattaaattaattattcttttatttttttatttttaccttgaagtattccaattcggccacctgtaaaggaactccgtaattattcaattaccgattccaatataattaattaatagttccagttagtctagcgctttcttaactaattaagtagtagtttcagttagtctcacttcgtgttccgccgggtgattgtgttcgcctttggaaatgccctgtccatcgtcgtcccatgtctccgccctgcctttgcaccacgagcgcgagcaggtcaatttcttggcacaaacacatcgccacgtttttacgccctttgccggcacaatctgacgaagcgagtggaaatgtgtacgatatctcgtgatacattatacggtattacgtggtgaatgttgtaacggtaaccctcaaagatcagcttctgattgcctgaatatttaagcaaattagccatggcattctgagtgttatcaaacggtgcctttgaaagaagtgactgtcctcggctgggccgggtcataacgttggaattggtgcattaattaaattaataaactgaaaaggacgaattgagttttagcagatggaaaggacagcagcagtggcaatcaatgattttggccctcggccttttttttgtgccattcgttggcattgcataattaatgatgggctgctgacaattagcagtctttcaaatggggagcggaataaatgggcaacgacgaatgccctccgggtcattcagtcacacatcgctttgatcaatggccccgctgttttggctggcggaggggggggggggcgagcggtgctccgattcaatccccccggggagaccctttttatgtgccccattttgctgttcgttcgt

SEQ ID NO: 32336 - DNA, 1117 bp, Heterodera glycines
aaaaaaaataaaattactgcaattgagccgtgttttcgcggccggcactgagtcggccgagcacaaaaaaattgtgggagcgcggcaccgcgtaaagccatcgtttatcaaaaatgggaaaataataattttataatttttaattttacttacaatattataaaataattaataataattattattattattttaagtgacaactgtaaaatatttttaaaataattatttaatttaaatatatttttaatttatattaggtatttcaacagactgttctggtcacagggtgtgtattgaaagaccaagtcggcctcggaacagtgccgaacttcgcccgcaaaattgtcggcatcggacaaaatttgggcggacaaaatgggcgagaaaaggacgaaaagcggaaggaatggcagaagaaggaaagacaaatttggcacaaagcaaaacgagacggaactaaacaaaaaaaaaacggtggagaaaattggcattttttaattagggcaattaaaaatgccaatgattttttatgccataaaaataaacaaattaagtgaattcttttgccatttcactttttttactcacattttcattttttgctgcttctttcttcccattttccttctcctccttcgcatcgcattttgctcctccgttttgttgcgctttttgttctccgaatggataatccgtgcggataaagccgagaattatttggttattatccgatctgaaaaggcggcgaagcttttaagtgttcgtcgtcgatgtgctgcccggccggggtgtgccattgcattgtgagtaattaaggggggaagcgagcgacggaccgcggcgcagtgccaaagggccgcgggggacggcatttggccaatggcacaaagggacggagaggaccagcacgagagatagggaaaggtggaaatattggggagaaagggaaagcggacagtgacaaaatgagaggctgagaaaatagaaagaataagggaagggagagagagagagagggcgtggacgtaagtcaattatcccccgccgcttaccccacgataggcatctatagcagtgcatggcatggacattattcaggcgtttatcccccact

SEQ ID NO: 32337 - DNA, 1356 bp, Heterodera glycines
  misc_feature (1291)..(1291): n is a, c, g, or t
  misc_feature (1343)..(1343): n is a, c, g, or t
tgctaataagcatgaaaaacggatttctaacttggtttgaggcttctaggttcaactttttcatgctgatttttgcttaaattggtattttcatgcttactgacaaatgaccatgtaatttttgtgcttaattgacattttttgtaaaatattgactaaaataccgcctcccagcaataaaaacgaaaaatacacccctattaagaatcaaacctaaaattttcaaaaattcgccaataagaaaaaaaatttttcaaaaattcatccccaaaatttttttctgacaaaatttttgatttaaaaatgtcaatttttgctatgattattaggattgtcagtgcgaaaagaaaaattgagaatttattgttaactaataaacatgtttgcctaaaatcaccaaatttatgtgccttttttcgatttttgtgcatattttgtcattttcatgctttttcgtgcttaattaataattattaattatcatgttttattgctgaaaaatccggtctctaataataataatattaaaaatttaataaagatcactgtttcataataaagttaataataaaaaagtgatgaaaatttttcccatcaaaatgggtatttttgtgtaaaatattgtcaaataagagaattaaaatgcaattctctccttttataaatttaaagtggaacatcacggatatattgaattaaatgtcttttattttttaacttatttcaaatgggaaattaattttaggagggtatgcttttagtcaatattttcataaacttttttatttacaaattcaacctattggcaggtgttacctgccaaagggattattttattgggaaaatttatgattttttatgaaaataaacgatgccacacttttggcagcagatggaagatggttgagccggacaccaaaactgagacaaaaagatggacgatcgatgggacaaacacttcttaagccaacgaagcagcaaaatggcagcggaaacacggataggcgttgcgctagaagaaattttaaaaataagagatcggagttttaaaacacaatttatgatcgggattagagggccagggcggtccctggcatacactcgggatgtttcaaaaatggcataataaaaaactaaaatagaatgtaaaaattgcaaccgggaatatccgttatatttaggaaaaatagaatattttataaaataagaaaaaaataaataaaaaataaataaaatatgttttataaattaaagaagttattaaaataaaagtaatttaaaatttcttagnaaaaattatttttaaagataaaattttgtaaaaataatatgaaaaaataaanataaggagttaat

SEQ ID NO: 32338 - DNA, 1142 bp, Heterodera glycines
ttttggttttattgcatttttgttaaggaattttccaaaaaatgtcgaaatagtgaaaaatagtgacaaaacgccaaaatagtgatttttaactattttagtgacgaagtcgccaaaatagtgatttctagtgatcgatagtgagatccaaatcgaaaatttttaatgcagaaatgcgtttttgagctcctttcttcaaatcaatcgagcaaaaaatttagttaaaacctaaaattcacagccctaattattaatgtttttggaatgtgtcaaaaacttatatcttaaatagcggtaaatcatttgagaaaaagaaaactaaaagcagaagaataagctaaaaaacgaaaaataaattattacggactttggtccgtgagttacgcaattaataacaaaaaaaatgcacttagccctgattttaaatcaattattgtataaacctttgacgttgtagagttattagctgaagctaaggaattggtagtagaacaaataattttggcatctaaacattgtcttaatttttctcttgctctaaaaatacaattttataggaaagtccttgaagttaatttctctgtagctaattttttaatgacttgtattaataattcacgctttggtgtatccagtgcttgggttttggctaatttctcctttcccccaaattcatccaatccccgattttgatcgttccttttatcatctttaggctggataccagggctgggcgcaactggattttcaattacggaaatccgcaatccgcaattatgggggtccaaaaaccccgcaatttcccgcaatccgtaatccgcaattttcaaaaatcaatttttgtcagaatttttgaaaattttttgaaagtctgatcattatgattttcaatatttataagaatcaatatccaaaaaaaaatttcggggggggggggggtgcccgaagaacttttttggccaaaatttttttagtgttatttaaaaaatttcaccaccgtagagcaaaaacaggaattgtagccgtttttagccaaattgggactaaattttgccattttggagtctcaatttaaaaataaaatggaacttttgggcaccggcggtgcagataggcgccgccgggaaattttttgcaatttt

SEQ ID NO: 32339 - DNA, 756 bp, Heterodera glycines
atttttcgtgttttgtggggtgtaatttttaaaaatttccaaaaaattgatctttaggggtgtatttttcgttttttttcatttttcttgtgaaaatttccaaaaaatggccaaaatatggactaaaaacccaaaaatggcgaaatatggatttattccccaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagtgataacggaagcgatgttttatttaaaaaccgatgactttttttaaaaccggaaccgttgttatgtccacaaaaaaaaaataattaaattttgagttgattcacccacactcaattttttgtctgaatacagaattacttactgtatatagtctttcttgtacgttttttaaatagcccaatttgcaaaataagattattttcataaagcctaaattaaaaaagacataacttataatttcgataaagtagcaaactttggaattaaaaaattcaaccgaaaattcaaaaaaaaaaacattatgccaaagtgatattttcaaagataaatgtacaaaatgaagaatttttgactatatcataaaccggtcaaaaatgccggtttccggaccggttttgcattttcaaaacgaccggtttccgggcccggtaaaaaccggtaccgggcccg

SEQ ID NO: 32340 - DNA, 1086 bp, Heterodera glycines
gaatgttagttattattgggggtcccaaaatttctttcggaaaaaaattttcaaaaaagtgttccgaaaaaaagagatagtcggtttttcatacgatatgaaaaagaaggcgtaaatggctctgaatcgtttttacatacgattattgaaaagaaggcgtaaatggctctgaagcgtccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcggaaaaaattttcaaaaaagtgttccgaaaaaaagagatagtcgtttttacatacgattattgaaaagaaggcgtaaatggctctgaatcgtttttacatacgattattgaaaagaaggcgtaaatggctctgaagcgtccataggccggagaccacaacgtaaaatgggacaacattcataaaaaaaggttggcctcaaaagggccattcccaagctaatttcggaatttgctgataaaatcaaatagcctaaattatatacgcattataaaaaggaaatgacagaagcctcgaatgttagttatattgcgtgtcacaaaatctctttcggaaaaaattttcaaaaaagtgttccgaaaaaaagagatagtcgtttttacatacgattattgaaaagaaggcgtaaatggctctgaatcgtttttacatacgattattgaaaagaaggcgtaaatggctctgaagcgtccataggccggagaccacaacgtaaaatgggacaacattcataaaaaaaggttggcctcaaaagggtcgccggcgaaggagaaaaagagagaaacttctgaaaaatttgtccattttcttaattaaattcgcattaaaaatctgaaaatttttcagccggctgcgcctatcggcaataccgacgtgtcaaaaatcctcttttttcttaaaattttcaaaaaagggttccgaaaaaaaagagatagtcg

SEQ ID NO: 32341 - DNA, 1917 bp, Heterodera glycines
ctttaaggtattactgggagatcataaataattataatattttataggacaaaaattaacaaaattattgattgtaataattatacttttatcaaattttatttttttgtttttcaatgactgtgtttaagaattttatttgctaaaaatacataagtccacaatcgctgcgtttgcgcacgcatatcgttggaaatatgtattttttatatgtttaaccattttcatacatatgtaataatttttatttacattttggtaaaatttattttttaatcatatctttattttttcagtcaattaattcaaaatattttcgaatcgttttttgatatttgtttggttctctttgcataatttttgtaataaaatatagcctcatattaattagggttcttcgatgcaaattaaagatatgttaaattaatttttacaaatttaaaaacaatttagatgaattacgctttccttttgttattttttaaaattatctcggtaggaagaattggtttacctcacttttgtacagttatgcaaattttgaagcttttgaatgaccttattaaaatgttttctctgtatttgagcaatttatacgcacatcattcaattttttctggaattggcctaaatttttgagttgatctcgccccactacttgctccgtcttcgcatgctcccttttgcgaaattttgcttgtaaattgttatttcacgtttattattttcggtactgaaatgttcattttcactgggactcagttgccccagtgctcaaatggcgtcggttccaatgtatacattgttttttagacttagctcatcaagagctttcgaaggataccaaatttgtgtgattttgaccgttttaaaaggtcagttgcctccctttcactcaaattttcgagttttaaaacatgttcaaaaaccggtttaaacgctctgcgcgcagtttttttgatggtttaggcgttttcagcacctaagaaaacttataaaagtgtttttatgcaattttgagtctgggacctatgatggatatttaccgaaacggaaacgaaatacggttaaaaaaatttctggaaatttagccccaagaggatggcaaatttcgagtatatttttaatacaatttttgaatatttttcactcaaatatttgccattgaaaaatgctattccataatattcttaattttcacctcttttcaaactggtacaccaaagataaaagcccaaatataattccgtgctgccgtctgtgctgcttacgccgtttgggtctggattaaaatttgccattaattgccatggaaatcccttcaaatgcacggtttcgcttatacggtcactgtacaaaatttcgcgcgaaaattcggacactttttcaatttccatcgaaattgtgccgaatgaattgttttgttcagtagcagaagcctttttgtccatcgcttctgcttctttcaaagtgacgtcaatggcaagtgtcaatttgttctcataagatccatttctcatgccaattaattccttaatttgccaataattgattaattaagtggcgggggggggggaagaaaaatttcaaatgttatattttacttacgggttttaatggaaattcaaaggtgctaaattcattgttaataacaaagtcattaaatgttccagtgaaatgcgttgcgccgatattttgcgacaaaactcgaagagttgccgaaccacggcagttccaatcggaatctttaaaaattattcttttgtataaatttttaatcagggttcaagttcgtccttgaatggcaaggacgtcctggaaaattgggccctctttctgaaaaattttaaaatatccttgaattcaagatgttcttaaaaataaccatggggtgtttttttttaaattttatttctt

SEQ ID NO: 32342 - DNA, 1306 bp, Heterodera glycines
ttaattcataaatatttttttcagaaagggttctgacccttaccgaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttattaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaattctgagtctcctattattttatttttttttcaaattttgaagggcgggggggggggccttttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaaaacaaataaataatgaactctcttccttaatattttcctgcaccgaaggtactcactcggccgcttctcggcctcgtggtgggccttc

SEQ ID NO: 32343 - DNA, 1924 bp, Heterodera glycines
aagagattgaaaaagttctcggcgatcgcccgtcgcgccacaacgaaaacatttgccttgatgagttggtcaattccgtgtttggcgtcaagcaagaagggaatgtgcctgccctggcggtggcttcactttactaaataaatgacaaaaatgttttttaggacccccacggcgaattgcgaggcaaaaacattttgcacagagtcgacgaatatgaaatgtcgaaaattgcctccgaaaacaaaatgaccatcgaacaattgaaacagtgtatggaagacgcaaagcgctttttggccgaggtgcgttggagttcatcgacggaattgccaattttgcactaaaaaggaacgcgctaaacgcccgagcccgcacttggacaacaaaatactgaccgcatggaatgcccttgccatctcgggcttttgtgctgctgctcaggtggtcattttaatttggattgatataaatgggaattcaaattctatcaaattaaatgagagaattcccttttttgttaggctgtcccaacgcgcgcggccgagttccaaaaacgtgctgaaaaagcggttgcattcattcgcagccatcttttccatgggggcgaattgctccgatcggcttacttggacaatttgggacaagtcgttcaaatgtccggagtaatttgccggaaaataataacacaacccttgttttagaagacatcccatcaaagcgtttgccgatgattatgcttttcttatcgaagcccttctcagcctttactcgctgaacttggatgagaatttgcttcaatgggcgcataatttgcagcttcaaatggacgaacttttttgggatagcactttcgactcgggctatttcatgtcgagggttggcgatccgtcgataatcgtccgaatgcaagacgaacaggacggggctgaggtgacaccaatgttagccactgttttactattcatcgtttagccctgcaccaattcggtggccgcttccaatttgctttgccttggctttcttctcgattccgctgactttcgtcggcgtgccaacgattgttttgccggcgcagcaaaacgaattgagaaataccctttcataatgccacgtatgctaatcgcattgcatgccgcaactcatccgccgtaccaagtgaccaatttgggaatgaccgacataagcagcaaatcttttaattaaaggtaattgtggtcggacaaagcactgacgaggcgactcagaaaatgctcaaagcgattcgtgcgaagtttcttcccatggcaacacttatttttatcgacaaggatcgccctggttagcaggatttatttagccatttttgataatgctttgattgtttcacatgcttagatcaatggattttgcggcaaaattcgcatttggcggattatgcgagtgcctacagacccggacagccctcagtgtttatgtgccgtgagatgtcttgtgaaatgccgatcgcaactctcgaggaactgcaaaagcgactggcagaactgtgagggagtctctgccggcgcatttgttaattattcactgccctatgggaattgaagccgctatttattattttcattgtttcgtttcgaaatttcccgatgggaacagtcacaatgtgaccattcgctatgcccgagggcatagtttaattgatgaataaactcatccgacaaacttacttgagaagcacttttattatctttgctctgttatcactccgtcttatgagtgatcattttccatatgttttggcaactgtttttctcctctctctctctttgcttctgtcttttcctgtgtctgtcagttatgcggtattttgtggccattagtgctgctttctcctggccattatccgtcgactcaaatcattcctcgggtatatttatgccccccccct

SEQ ID NO: 32344 - DNA, 1695 bp, Heterodera glycines
tcatcattgtgcgtttgatggaaatgaatgttgaaattgcgtgaacatgcgcactgttcgctgggtaatgaggcggacactgtggtgatgcccggctgatgggcattgtaaattaacggtgccattctgtccttgtcaatttgttgaagacacactgaatttattttttgaaattgcatttatttattttaataaaaaatcgttttttataaaaattacttaattcataatacaactttttatatgaaaaaattcatttttacacaattttgaattgggataggatcagatcggcgttgattgtacgacacggccgtttttttagggtagtcgatttccgaaaaatttttcggctcaaaagaccaatttttggaattttttaatttcctaaaaatttttcagctcaaaagatcaatttttggaattttttaggcatcagaatttcgatttccgaaaaatttttcggctcaaaagaccaatttttggaattttttaggcatcagaatttcgatttccgaaaaatttttcggctcaaaagaccaatttttggaatcttttaggcatcagaatttcgatttccgaaaaattttgggtgtcgaaattgcatcgctaaatcttaatgggaaaaaagccgacgtaccaaagtcgtagtcccaattttttaatttaatttaattaaatattaaatatttgccttaaatattcatgaataaaaatcaaattttaattagcattatttaaaactttgttttaccgccattttcgagtggacttcgtagctttacatcataattgtctggcccagtttggagctcaatgtcatcaatatcgtcaagctgtacttgaatcggcgaatcatggaaattcgtctccgctactttgtctaaaataaaatttagttttacaaaactaaaattaattgtttttccatttacagtacccaaatttgccgaaatattgcttgcaattccagcaggggttaccgtctctttgttgttctcatcgtcacctaaaagttgtgtggattacaaacattaaatttaagccagattactgtaggtcgaacgtgacgatggtggatctgttgtactgtatgttcgcctagtgtaagtgacaggtcgtgtactataagtggtaaccggttgtgtgctgaatgtcactggtcgtgtgctgtatgtgttggtgactggatctgcagtactgtatgtgttggtgactggttgtgtgctgtatgtgtttgtgaccgggtctgcagtactgtagcttggagtcggtaggcattttccatctggaccgaataagcagcgtggtgttactgtaggctgtgatacagttggaactgtcactgttggcatagttattgttggagatgtcacggtatgcacagtgaagaccggaacagttacggtaggcacagttaaggtcggaatggttacggtaggcttagtgaaggtcggaacagttacagtaggcacagttaaggttgggacagtcaaggttggtacagttggcgaatatgttggtaccgtaggcgggtctgttggtatcgaaggcgtgtatgttggtaccgtaggcgggtctgttggtatcgaaggcgtgtatgttggtaccgtaggcgggtctgttggtatcgaaggcgtgtatgttggtaccgtaggcgagtatgttggtttggtagggctgtatgtaggttct

SEQ ID NO: 32345 - DNA, 977 bp, Heterodera glycines
  misc_feature (17)..(17): n is a, c, g, or t
ggtggggggggggtggnatggtttaaatagaattccgagaaatttttgatcttatattgaactttgttaacagatttagtcagaaaaatggctaatataaaatctgaaaaaaatcggggtactaaaaatgatgaacaaatacaattattaaaaaaacaaatacattagtgaataactctccatctttaatgaactctcgaagtttttgtaattgaccttcaattctgtataaatacctgttcggccagtggctcggcatattttcgcaccacgtggttcagtcccaagtccaactcgtaaaaagtgagtgtctgctgaatttgtttcgccgcatcgcccgttgggtcgtggtcggagtccttcaattaaataaacgaatcgtttaaatgtgttatttcttaataacccacctcataatcaatttctaaacatgaaaaggtcggattttcgaagcccacatcgatgccggtgatggcgaagcaaatgctgtagtttttgtgggcttccagcggggaactgatggtcaaattggcatgggcatctctgttcagaatatacaccaatttttgacgttcagcctgaaagcattgacaaaatttagttggaattcgaatttaaaaccatttaatttttatggatttatcaacataatttttaattttcttttggttatggtcatatacaatcaaaaatatcatatcattcgccatttaagtctttttattatatgtttgtgattttaactcaagaaatttttttaatctcggcaggctcttgagataacagtaatagttttagcacattttcataaataaatttatgtattttctggtgaacataaattggtgataaagcccggttcgtcgtgtaaattgtccggatcagtcagttaaagtcgtatatcaagcaccgggtttaggtatcataaaaattagtcgtaaaatccttaccgctccgatgagtactgcgcgtccctt

SEQ ID NO: 32346 - DNA, 1127 bp, Heterodera glycines
taattaatgttcgttaattaacccattatttaattattttacattttttgttggtgatgcggatgttgaagcagcaaccttctttgttgtcccattttttggctttgatttcacactttttactgctgatgctgtggacaattcgtttttttttaaatttgattattaattgaaattatttttaaataattcattattttaaattaatattaatttttttgcatatttaaaaatccatttttaattcaccttttgcctcgagctgcgattgattttcaatggccttatagtgaatgggtgaagaattcaatttattgctgatcaacggggggagtgcctttgaaaaaatttatggaattcattataaaaaaaatcaggaaataaaaaaaaaaatttttttatgatttacccgaaaaaatgtaaaaaatatataaatctaataggattaaaaaaaccaagcagtttttaattttttttttttttaattttttcaaataatcgcaaattcgtatttttttttgtccacctcataaaaaacactcactgccgttatattctgtggcccaacaatttgttgatatgcaaatgcattggacgacaacacatcatcctttccctgctgattgtccatgcttggcccgtaaagtatgcggccctttaggcaaatttactttaattgaattaattagtttttttttcaccatttggctgctcgccaagccgtcaatttcgagctgttgttgctgctgcggttgttgcagatgcaactccatttgctgctgttgctgctggtggtggtgatgatgttggtgttgttgctcatggcatggctcacaaattgcataactgaagaaatttgaatcccaaaaatgaattatggaacttcataattaattaatcaattaattaattaattattggcaacaaagaaatattaatgaatgactgagtttaattgattcattaaattgataggttgattaattagttaattgattggttgaatgtttaaaatgaatgggtgtttaattatttaattgattgataattggttgatgaagtgatatactgtttgattgagtgattgaaagattgagtgaggattaatgatttgattgcttgataat

SEQ ID NO: 32347 - DNA, 948 bp, Heterodera glycines
tggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaatggctatctctttttttggcaatctggtaatagaaatctctttggaa

SEQ ID NO: 32348 - DNA, 836 bp, Heterodera glycines
agttgtgcgttcagctcgcggcacgtcgcctccgattcgcgcaacgcgcgtctcacaatttcctccgactgtacagaaacgcgccattgtgcgcgcaatatgctcaaattggcatgcatttgcgcttcttgtgccgtgagttcaatttcgcgcttaaatttccttttcgtcatttttattgtccgtttgaatttgccttttgcaaaatgtccgtcgcctctctttcttttgtccgttctctcatttctctgtccaatttcttttgcaactgttctgccttttgcagcgattgcatcagttcctggtgcactttgctcagttccgaatgtctccgattcttttccgcccgttcgcggcacaattccgcctatttttttaggtaaaatcaattaagcttttttaaatattactttattttttcatttcctttttccccattttctctctttttaccttaattatcgccatttccgcttcttcttcttttcccgaaattctcttctccctttcgtcgtcgcacttttctccaattctttgcttttccattttttgtttaagcgtcaaattctcatttcgaagctcttccaacgaattggaaataaactgaaattatgaaaacgaaatatttaaaaaagaccaaatatttaaacaaaaagttgtggtattttttgttaaaaaggggggggggaaaggttagcaaaataaaataacaaaacattggacagcatggatttgctggtgaactaaggtttgaagctaaagaaaggatcagcagcaacaatgggttagtgtatggtaggacggcgaacgggtactgtatgtacatagtacagtat

SEQ ID NO: 32349 - DNA, 1351 bp, Heterodera glycines
  misc_feature (1130)..(1130): n is a, c, g, or t
  misc_feature (1163)..(1163): n is a, c, g, or t
  misc_feature (1267)..(1267): n is a, c, g, or t
  misc_feature (1288)..(1288): n is a, c, g, or t
  misc_feature (1291)..(1291): n is a, c, g, or t
attgggtcacaaataaattcaagcctttttctcatgctgtggaaacgaagagttaatctcaatgaaaaggataaataaagtcagggaatatggtttagcattatcaaaataaagcataaatgaacggtgatatccactagaaaattttgacaaaagcatagtctacatttgttaagacaacttccgatattatcgtttgtctcaggtagatgtgttcaggtggtttaaaagaaagatttttgagagtttggggtatcttaaaattttaactaaagtgcaattcctattattgacatgtgcgcataaaactcctggaaggttttaccctattccaaaataaaagggacattgcttttgtaatcagaagaattgttgggacgttgttctaactcaaaatgccccgcgaattgggtcacaaataaattcaagcctttttctcaatgctgtggaaacgaagagttaatctcaatgaaaaggataaataaagtcagggaatatggtttagcattatcaaaataaagcataaatgaacggtgatatccactagaaaattttgacaaaagcatagtctacatttgttaagacaacttccgatattatcgtttgtctcaggtagatgtgttcaggtggtttaaaagaaagatttttgagagtttggggtatcttaaaattttaactaaagtgcaattcctattattgacatgtgcgcataaaactcctggaaggttttaccctattccaaaataaaagggacattgcttctgtaatcagaagaattgttgggacgttgttctaactcaaaatgccccgcgaattgggtcacaaataaattcaagcctttttctcaatgctgtggaagcgaagagttaatctcaatgaaaaggataaataaagtcagggaatatggtttagcattatcaaaataaagcataaatgaacggtgattgatatccactagaaaaatttgacaaaagcatagtctacatttgttaagacaacttccgatattatcgtttgtctcaggtagatagttcaggtggtttaaaagaaagatttttgagagtttggggtatcttaaaattttaactaaagtgcaattcctattattgacatgtgcgcataaaactccntggaaggttttaccctattccaaaataaaaggnacattgcttctgtaatcagaagaaattgttgggacgttgttctaactcaaaatgccccgcgaattgggtcacaaataaattcaagccttttttctcatgctgtnggaaacgaagaagtaatctcnaantgaaaggataaataaagtcagggaaatatgggtttagcattatcaaaataaagcataaat

SEQ ID NO: 32350 - DNA, 1590 bp, Heterodera glycines
  misc_feature (1518)..(1518): n is a, c, g, or t
  misc_feature (1528)..(1528): n is a, c, g, or t
  misc_feature (1530)..(1530): n is a, c, g, or t
  misc_feature (1534)..(1534): n is a, c, g, or t
tgggatgtataaaggggattgtagaaggaattgtaagcgctaaattgtttgagaagcttttggagcgtaattaggacaattactctcaccattttttctagtattagatcacatgggattttcggcactctgataattgtagcgctcataatgggatgtataaaggcgattgtagaaggaattggaagcgctaaaattgtttgagaagctttttgagcgtactgggggggggggggaaggcccaccacgaggccgcgaagcggccgagtgagtaccttcggtgcaggaaaattattaaattttaaaaattttttagttgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaaacttaacttttttttcagaaactgatcagaagcgcaccaaactttgcagggatactgaaaggaagagaaataacctattttaataattatctagtcagttcatttaaataatttttatccaaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgatccaaagggcccggntttatggggngnccgnatccttccgccataaatgccctatagcctgtactttaattctgcgttggatttttg

SEQ ID NO: 32351 - DNA, 1239 bp, Heterodera glycines
gtgttaaagcgcgtgttgaactgtcaacgagccgttctcgtcgcgatcgggatgagcggggccggggaattagtcgcgagaatgaggaaaaatcacgcaaaagggaacataagtcacccaaaaagaagaaaaaggagaaaaaacacaaacggaaaagcgaaaagtatgaacttttttaaagattaaaactcacaaagttttgacggaaattatttttaggaatgacaaacgaagcaaagggaaatcatcgaaacgaacaaggagagaaagtgagtaagttgggatggagttggaatccgaggatgaagagttggcgatcgaacaacggagaaagaagcgagaggaactgcttgaaaagctaaagacagaaatgggcctgactgatcatgtgaatgagcagcagcaaaacgatcggtataattcgacgcgatgtttttatttaaattttgcattttcttcttcaacacagtatccaagaaaagacgagtgctgcttcatctccaaagcacacgtcaagcagcgactcttcgagtgattcggaagacaatggcagtggctgtaacaaaagcattggccctggaggatggtgaaagggcaggtgatgaagtaatagagtgtgaaacaatacatgttgcagactcaaacgaacaaaatgacaaatttatgtgtgtctattattaggaatgagaggagcaaagctcaacatagcataggcggcaatgcataataactaaatttcaggattataattcataatcaatacctaacttgcttttattttatatttacgtgtatattcaattgtctggtaaaatatttttgtaaataaaagaccaacacggcacgcacttaaagagctcgatgttaaaaaaaataccattaatttcaatattttgtggaactgtttataggttgttattgttctttttctggaataaaaatgaagatttacagtttattgcacaaactgcatatggtatttttaaaaagttaacctgacgcaaattatatagaaataaaatttggccacaaaattcagttttgatatgtgtgagtttatcacttataatcaatttggttgcctataaaacacttattaagcagtgatgaagtaatagagtgtggttaagatattagaaaatattcagataatctggatcattatgaaactccagtaagctttcttgaacctgattaaatttctaaacattcatagaaaattattagaccaatatacac

SEQ ID NO: 32352 - DNA, 854 bp, Heterodera glycines
aactgctcgttgtcctcttccaacatctccctgaccgtctctctgaattcgttcattccttccaacagtttccaattttcaaatgcccttccccatccgtttctctgcgcaaccaatgcattccttcgctgatccgcgaagaatccgatgctgagcacgggagtgccgctttgtgcaccctccagcaaagagttgtaaccgccgtgggtaatgaacagacggaggcggggatgggctgaggagggggaggcaattggaaaatgggaaaaagcaaagggaaaaccaaaaggaaaagcataggaaaaaggaaaagcataggaaaagccaaacactctttgcgaaggacaacatgaagtgtaagactttgaaaagtgccaaattttttggtttcttttgccaacacatcgacttaattggaaaagagctcacagagaatggcgggctgaggcgcccacgaagtaaggcgaatgttgggcacgttctcagccatcctccggctttgttcgtcgtccggctcgattttgacgatgaaatgccaatccggcagttccgcaaatgctccgatcacatttttcataaacggcgccggcaaaacgtccgttttgacggcggaacccatggaaaagaaaacgacgccctttcgccccttcagcagctcacttttgtacggctccttcgggggtcagattaaatgcaggcaaatgaggacagtgatgagcgaaagaagaaaggacctgcagggctttgagctcgggtgttccttcgagttccaatccgccgatgaaaatgaaattgggaaaaagaggccgaggaaagtcggtgaactcatcgacgttgacgaacacctcgaaaag

SEQ ID NO: 32353 - DNA, 985 bp, Heterodera glycines
cgatgaaggggggtatgtcgagacaccccttgcacatgtatgcccctttcccctcaacccacctttgacccgctgctcagccattcaatcgcttttggtgctaacttggtcagatagcagtattgggcgaacgtcgacttggactcggacaagaaaccgttgttgcgcaacattttaccgaattccgtccaccaattttcggatttatttttgccacttccgaataattcgtggcccaaaagcccattgctcttcagaaaaggaaggagagacttctgtaacattaaataattgtcattagttcctttctctttttttttacattttcactgccccttagaaaatcaatgggctttttcagtccgctccgtccgttgaacaattcgagcgcattgaacagctttttggcttcctctccaaagtcgaccgtcgtcggttccccgtaaattttcgcgtcgttccctccaatttggcaccgtttttcacaattgtcacagcagtcggagttcggcacgtccgggtgttggatggaattgtcaaaataggacaggatcagatagcgacgacagctcgtcgttgtcaaaaactgttccatgcggcgcagcatttccaatttgtggttttcgtattccttcgaaaggttgttgttcataatccggcgccttggacagaaaaatgggttatcgggttcaaaaattgcatgcgcacttttgcatcattatatcactgacggcataaaaaactaagcaccgactggggaacccatcgcggccggcacggccaatctcctggtagtaactctcaatgcatccgggtgctaaatttgttgcacatttaccaaagtgaccaatcagcttttccttccccccccccccctcctcttacctccgtaatgaatcactcgtcggacgtcctttttgtcaatgcccattccgaacgcaatggtcgcaacacaagtggtcgcccgatcaatcgcgaactcttt

SEQ ID NO: 32354 - DNA, 1055 bp, Heterodera glycines
ccagcgtattagtaaaagcaatggtaataatagttcctgttgaccaagtacatgctatatcgttttttaaaagtgctaattttaattttacagcttttatgggaaaaaattcagcatgactttgcttaaacgcaaccatttaaataaatttaacgagctgttcccgaaaaacctgtaaaattggcaccttcgaaaccctctaatggcattttttacgaaatgaccaagcatcaaccaaaaaatgttatttaaaatttacttagttttcccaaaattattcccagcgtattgttgaaagccatggtattaattgatggaagacaaataaatgtaatttaaaaataataaatttcctattttctcctgcgaaatcactgccaattcatttattgtcttcaattcttccaaattgtctcatttgtaatttcatgtatgtttgcactgacttaaagggctacccgacttttggggatttgcaacttggggacccgacttttggggatcccgacatttggggacccgacttttggggatccgacacttagggatcccgacatttggggatcccgacatttggggacccgacttttggggatcggacatttggggatcccgacatttggggacccgacttttggggaccgaacaacatttgagctaaagacacttaagaaaaccacggatatttggcaccccgacatttagggacccgacatttggggatttcaataaaacaaaaaaaatttaaaaatttaattctaagccacaaaattagacaaaattacgtctgctttagccagagttaattccattgcaaaaaaaattaattaatattttaaaaattaactctgtttccggactcaccgcgaggaggcgcagaattttgagcccatactaaccacaacactatagacaaaccacaatacattttttaactacagtagacctttttccaatttttatttaaagtgcctttcccaagggtcaacgggaacagaaatccgtcaaggacattcaacaagctccagccgactttgctgcctaaccaccaaatg

SEQ ID NO: 32355 - DNA, 1222 bp, Heterodera glycines
tggcatcgaggtgatttttctttacaaaatttttgatacggtaaccatacccccccccacctcgctggtaaatttttatgaaattattttttttatatgcattttaaaaattatcattttttgtattaataaaataaaataatggaaattaaacaagataaatgtcagaatctactgcaatgcttggaaaatgtggcatttgagctgacggagcatgtgtgccaactccaactgccggatgtgccgtcatcgtcttcggtggaaaaggtgggaaatgaattttttttaatttttaaaaatcatattcggcggtgccaataaaaaaaggcaaaggaaaatttaatgtgtattttaggagaattaataaaccaattttttattttgtccaaaaaatggtcaacttttgcaaaaagtgtgcaattttgtgggtgatcgtgatttgtgaaggtttttgtttaacaagtcaaaatgctaaaataactgatttttagatttttttttattttgtattatttttatttactttttaaatttcggcatctttttttaataattttagaagaatttttttgcgaaaattttcgcgcaatatttattttgattttttctcaactcagtccctcttttggcacaggaagcgcctcaggtgcaatgcgtgcgcaaactgcaagcagtgattggcaagctgacacaacaattgcagcagttggacagtgccgaggagcgccgggcagtgcgggacaaatttgttgtaagtcaattataaatatttaaataacaagggaacatttcaaaaagagagagagggggggggggggagagagagcgagaaacagagagagagcagtcgattttaaattttttttttgctactacaccaaaaatgatcaaaaaaaagtaatcaaagtttcgaaaaaccgataaaaatgatcaggcccgtggcggactccagctcgttgggcttccgcgagaaaatgcgcaacaattgggcgagcgcgagccaccggccgaggcgtacaaccagcacaaaagttcatcggcggagcgccgaattgtgcagctgcaacagaaaaagcatgacggcgctggtggtgatgatgccgaaacagcggcggcgattgtgccagaagcggatgccacaacaagaatggtgttggcattgaggtgccccggatgggagaggatgttggaaatgatcgatcacccccaggacgagactgat

SEQ ID NO: 32356 - DNA, 1281 bp, Heterodera glycines
  misc_feature (31)..(31): n is a, c, g, or t
ttttattctccttttattcccacaaattttntgtgtcccaaaaaattggatttttcacgcttcaacaatttttcatttgttattgcaaattccaaaatggaatgcgtttatattatggctgaagccaacaaaatgtcaaaagcaaatgttaaaggccaatgaaattttaaaaatttagaaagatttttgaaaatttttagcccccccccaccattttgaggttttgtgagactaattacgtatcattttttaatcatcattaattagcactgatcaagcaaattccactctttctgtcccttatgtcaaagcaaccagtaagagatgacagacaattttaaaggccaatgaaattttaaaaatttagaaagatttttgaaaatttttagccccccccccccaccattttgaggttttgtgagactaattacgtatcattttttaatcatcattaattagcactgatcaagcaaattccactctttctgtcccttatgtcaaagcaaccagtaagagatgacagacaattttaaaggccaatgaaattttaaaaatttagaaagatttttgaaaatttttagcccccccccaccattttgaggttttgtgagactaattacgtatcattttttaatcatcattaattagcactgatcaagcaaattccactctttctgtcccttatgtcaaagcaaccagtaagagatgacagacaattttaaaggccaatgaaattttaaaaatttagaaagattttttaaaatttttaggccccctaatttttgaggttttaatgaagcagagagactaattatcatttgttgatcttcgttaattaattatcactccgatccaaattccattctgtcccttctccattgtgtttgttccattatcattttatcaatttcttctctctttttactgttcgtgtgttcctcccgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccgttcctcctcactcactcattgaagctcataattcacaaattcgtttaaaaactcaaaattttatcgctgccaaatttttttatgagggaaa

SEQ ID NO: 32357 - DNA, 2196 bp, Heterodera glycines
  misc_feature (2113)..(2113): n is a, c, g, or t
  misc_feature (2144)..(2144): n is a, c, g, or t
  misc_feature (2168)..(2168): n is a, c, g, or t
aaatttccccttttatcggatttgtcaagcaaaaatatatcgcacctcgctttttcagatcctacgaagatgagcgttgccttgcgttaactgcgcggggaagaacttggccagccgcttgcgcccgcctcaacggccaaaccgacgacgacggcgaagaaatgagcagccacaagaggcgaaagtgaacagaaacgccaaaacgactcaatgcctgtgtaaaaattcaacttgtcaacaaatgttcctcttccgatacaatttgtttccatttttcgtttgcaaaagtcacaattatttggtattttgttgttgggatataaaaaaggtttcacacgggctgtatcagatataggcctacccccttttcaatgggatgaaatttcctataccattaggactcaaatggggcgggactttttaagtcgactttggagatttccgtgatttaaattcccatcccgtcatttccaaattacgtgccagtccgattgaatagactctcttcacacattcggtgcaaaatgggcaaaattagtatatttaaaaataaaacaataaaagataaaacaatatgattgcaaaattggcattaacgtatttgcgcgagatcttccaccagtttgagcacatcttcgggccttgccgtaacgcctgaaaaaacatatctaacaaataagtgccttgtttggggtttttctcactttcgtccattgtgtcgggttccctccaaaggcgtaacccatcgacgacaatttccaacatttcacgcggctgaataaacaatttgaactcgattaacccttagttgtcacaagggcctaacaaaagaaagtccgaccatttcagtcactgtttccaccaaatccccgtcaatgaacccaatgggctgctcattgcgccgttcggtgaaaaaggaacggtaaatgttgtggtcaacgcgaaggctgaaaaagaaggcattgtgtacgacggaatgaatggcaaaacaacttgccaattgtgtgtttttgttgtgattgccttttgcaattcatggagaaaactaaaaacaaaaacgttttaatgattatcccaatccgtaagacttaataaatcaaacgtttcaaatcacctgtaaatgtggggaggcacttgcacaatggtacccaaaccgccgtcactcgtccctaaaacgtcccttttgtaaaaggagtctggcgcattaacatttcctcatttttcattttgaaatttttttttgtaaattcaatttttaataaaaaaaaataaaacagttggaaaacaattaacttatggttaaatttcatttttccattgtacgacggtaaaactatttctcctctcccgccccgctcaatataaactcattgactctccaaagcgtaccgtaaattatcggattcgaaaaaagcggtgccgacgtcgccgtcggtgtcccattcctgccagttttgccaccattttcacaaaacgttgccgctcctccgtcctcaatttccatgagtccatgcgccgtgccacaatccctttccctttgctgggcggaaacaatggagccgcgacggaacacattgatcatttcgccaaggtaatagaggccgacttgctataaaagaggacaaaaaccatagtgaaaccctttgatgtcttgcgactaacggacaccttcaaccgcgatcgatcctcgtccgattcggcgttcacgtcgattttgcagcagtaaatgttgtggttgttctccgccgcgagaaaagtctccgagtcgataatttcacaggcactcgtccattccgtggaatagtccctcaacatagaaaaaagcgattattttaatgttttttttttgattagagaccagactgggatcccgacctcggagtccgttccgatcgtttttcaaaaatcttcgggattgatcgggatcgggatttggttgggatccttccaaccccacctgtccggtctctagttttgatttgtatggcaacacctggccaactcttcgaaagtcgagtcgaccgctttgtagccgagcaccgtaacggaacgcatcaaatcggccaccagcaccacgtcgcccttggtcttcaggtaaagtgcgagaatgttngtgaaagtggagcactccaagcgcattcccntctcgggcgtcactcgaacagtcngacggtgttattgacagtgcaaatcaat

SEQ ID NO: 32358 - DNA, 1774 bp, Heterodera glycines
ggcaattgcaaggggttttaaggccttaaaaagccaataaataagttaatgaggtgttaattaaccctgccaggtgctacaaaaagtgtgtgtccggcgaagaggattttcccgtggaaagtgtcgcgtcggtttcgctttttttcctatttgttggataaaagcggaaaatgtgcaaaaaaagttcgtatggcaatgaatggcacgcaattttcaatgggaagagcatgcttcaatatttgactttcaatttttaaaataaatatttttaaattctaaaattatgaaattggctattttttgattttgaaattcaatttccaatttcaaaattggccctacaattaaagaattcattttaaatcgctctccctcatattttcagatggttggtggtgtcgaaattgacataaaaactagagtgccacgggaccgggaatttttgccaaaaccgggaccgggacttgccgggacctgagaagccgggaccgggaccgggacctcgattttttttcaggaccgggaccgggaccgcaagaaaaaccgggaccgggaccaaccgggaaattttaaaaattcaaaaaaattttaaaaatttaaaaaaaattcaaattttcaacttttttcgtgtatttcagaccatagggagctcagcaaataaaaattgaagccctagtgatgaagtgtgaaaacatccaatgggacataattacgaaatggcatttgaaattatgatgaaattcatggctttaattattttaatattatttattaatattttattattaagaaaatctattgatgatcagtttcacttattgatcgcatttttggcaatgcttctccacattcattaaaatgaaataaaaaattattttccgaagaaattagcttaattttaatacaaatatatatattaaaaacttattaattaattatttattatactttttttagtgatgctttttctcctttttatatttgtgttcttaatcataaacaattcaactgacaaaacattgtcagttaatctgtgtaaaaaatgtcgaccaacttttgctgaaatatttggcgaagaatggcaaaatgaaataagaattggaggagatgaaaatgaaaatgagactgatcaaaatgcaaattttcatcaaaatgatcaaaatgaattaactgatcggacagatcaattggatgttcaacaaaaaatcgaaattattcacaaatttcatgcaattagagaagcaattaagaaaggaaaatattcggcaaaaaattggaataaaattgagcaaaaaatagcggaaaaattgggaattaatcgaccaaaaatttataaatggaaaaaagaaattggattaaatataaaaaatgaccaaaattattacgaaatgaaaaagaaggaattcattgaacgaatcgatgagattaaaagaacgtccgaaaatggaaaacagaaacaatttgcgaaagagttgggcattagcaaagtgacattaagaaaatggaaaaaggaatttggcattgaaatgagcaaaagtaaattttaaattaattttcaatttaattattaatattaaattttattatattcttaggtcgaattcgattcaccgatgaacaaaaaatgagcaaaatgaatgattattatgaaatgaaaaaaggaaacccttctttaagtgacaaagaaattgctgacattttgaaaattggaactgccactctaacgagatggaaaaaggaaaataattcgtaatttttcgtttttcttatttgt

SEQ ID NO: 32359 - DNA, 1214 bp, Heterodera glycines
tgcttaaggttttgaagctgcaaacgccggtcaacgcagtttatctgaagactttggcggtgatgagtcagcagcaatttgcggagagaaaagtgatgccgaagagggaatatcagaaggaactgtgagtggtcgggggggggggggaatttgtaccaaacactgatcagtgatcacccattggcatcgggagggggggggggacttttattgccggccatccttttttaccgtacttattttctccatcattccattacgcattaccgtaactcattccccaccattcattaaatcgtatatttcagtctttcttcaaaattacccgttagttcattacagttttcctcgttctttaccgtattctttttgcttctcttacagtacgatggttccctcatggatgatttccgctagcacgacgacaacagctgcggcgtcctcttcgaccagcgccgccagtggccaatcgtcgcccggccccgactcgcatctgccgcccttccaccaacatggcgacgtcggcttttgcgagttgccattggaggtcgaaggcaccagtaaattgggcagcgcactgctcaaacacaccgccacccgctcgtacagctccaacccacgggttcgtttcgcatttttatgatcactcatacaaattctgatcagtttttgattgtgatttcctcctttccctaggaattcttcaaatttggccgtaagccaaccattgccaagtcgcgcggcgtaatcgaacagcaacagacggacgcggtcacaggcggtgccgtcggtgcgagcgtaggcgactccgcggcgggtccgtctggcagcagcggcggtgtttcacagttgcgctaccgcaagtcaggcggaagcggcatgggagcggggcggtctggcgccgtttcaaaggacgcggagagcaggcgcaaatcgctgggcgcggccgccgcagccaatgctgtcgctgcgggcacaattctgcacagggacagccccgtgggcacgcccaccggcagcgtaacgggcgtaagcagcagcggaaggctgagcagcgcagctttggtgggtgtaacgaaagaaggactgatcagttcacactgatcagtttggtcaatgttttgctttcttttaggcggttggcctcgttgcccccagtgacattccctactatggcgaagtcgaacccccggaggagccgcccctggagcagg

SEQ ID NO: 32360 - DNA, 1733 bp, Heterodera glycines
cgagggcacgtctaacgtccaacagttcagatatgtcataccgtcgagacgccaaagaactgccgcaagagcgggcggagagacgtctgcgagccgtcgaatggctcgcgagagaactcatgcgccgactacagcagcagcgacaacgccgaaacaatgggcagaaggacgacgatgaggacgagcacttgagtgtccagctggaacgctatgccaacatgctggcgcggttgtcaggccgtgaagccgaacgactacagcgacgcttcccaaacttgcctgctcctcgccgtcgaaaggtggggaacagtttgggaggcagttcgggaagcaccgcggcgcgcaccgaaggacgcaaaacgaacgaaatggcgcagatgagccggagggaccccacacttcaccgggagatccactcccgactgacaatttcgatccctccgccattttccctcgcaatttcccccatttatttttgccaatttttcattttattcacaattctatttctctccctctctctgtcctttgcctaccgtacccaatcgtctcacttctccgaattgcaaagtgtttatgcatttcttcgccattttctcatctgccaattcatccccttttttgttggcctttggccgtcacttatccgaaaacattttctttgtcccaatttttgcacattttccatttcattcattcattcattcccccctttttccttttgcattaccattttgtttatctgatcggcctttggccgattcattttgccgtcttttcttttggattgtattcgccacatttcttcgggggatttttttcccccagtcccctcccccctcccttctgtcattgcgtaacttggccatttttcattcattgcgtttcattcgccaatttgtaagggggctcctccccctgcgctcttccgtcccgtcctcatttttccttttgtgcctaattatatcgcattttcaccattttgttttccactaatcaccgatggggagttgactcccccaaatttcaatttcccccaccacaaatcgcggcattcatgttttatcccctgccgtttgtcactgtcaccctccttttcttcggtttaattacccaagtttgagctgcttaataaattgtgcttttaatctgtgtgcttcaacgggtgggaaatgaaaaaagggagcaaactcccttcggacgaattcgcctttgcccacggacgggctcgcgcaatcgatcggtcacacgggactccctcacttggagtgcccagctcgccttagccctcgtacaggctcagcacgttaaaacgggactcctgcctccggagtgcccagccgtcccattttttctctcccttccccctcctcaacgtcctctctccccctccgagagtcggactacggacctcgtcagcgcaacacgggagaagcacactcccggcagttcaacttgtgggattggccacggagtcccggcttctccaaattctaagtcggtggtaccgttattcacatcactcggcgccctcgcctgcgccgtttgctgccagcattttcattagggagtcaatttctccctcacaaatctttgtttgcctccccgatccctccgcctcattccccttgggaaagggaccccaacggaatcgcgaatccgcaccgcaattttgaagagtgaggcggcgccagtggaaagggagaaactcccgaccaaacacgagacggagt

SEQ ID NO: 32361 - DNA, 1552 bp, Heterodera glycines
  misc_feature (1333)..(1333): n is a, c, g, or t
  misc_feature (1417)..(1417): n is a, c, g, or t
  misc_feature (1482)..(1482): n is a, c, g, or t
  misc_feature (1511)..(1511): n is a, c, g, or t
  misc_feature (1515)..(1515): n is a, c, g, or t
ggacgaattggcacaggcggaacaccacgagccggactggggcgagcgtgcactgcgccgcatgttctgccaagtgtggacgagcccggcggagcaaattgtgcacgttgttgcacaaattgtggaccgaattggcacaagtgggcaccacaccgacccattgcattcattggcactgaccgtttagacgacagaaaaaacttttttggacgaaattgtgccaaatcatacccaattatctttttccgaatttgtatggagaaagtcgacggagtttacatatttactccatttctcctcctttcgggtccgttccctcttggagatttttaaagcaaaacagaattttctcaaaaaaataagtttttttcttaagcccttgagaaaaattcattttttcttaagctggaaaattttgctaaacttcttgtaaacatacgcattatttttttgttttttaatttcattttagaattttcttccagaaattggggatggcataatattaagtgccatccattccatatgaatgaatgcgtcccgttggagtttcatcgaaatgatcacattttgagtttttattattatgccccgtagaatctgaccctgctccggtggatgcgttggtcctccgtctgaacagccaattccccggcggtgacatcggcgtgctggcgccctttttcctcaactttttcacgctgcgcccgggccaggcgacctttttgggacccaacgagccgcacgcctatttgtcaggaggtgggaaaagctaccccgttttttgagtctatccgaatattttggaagtggagtcaaagcgaagcgtatgatgagagaaccctccctcctatccgaatatatcttttagtgcgatttacgtgtcgggactggaataaggggcgtgtacgtacccctcccgcccctctaatagtacccccactataaaattcctcccacttatttgaaaaatttagtttttttaattttctcaacgaaaactaaaaatacaccatccacatcattggcaccctcctttcttctccaaaatttggttgaaaagagtgagaaaatttagcgaatacagaataagatgttgtcgtagttcctaatagtctgagagattaccacgaacaaaaatccggcacataaaagccaatgtgatatgtaacagcctgaatatgtaaaaattgcaattttccgattgcgtggaatgcatggcgctgtcggacaacacaattcgtgccggactgaccccgaagttcaaggatgtgccaacactgtgttcgtcgctcacctaccgcatgtacgcgccgccaatctttgagcctanaatgctgccggacggtgtcattgaatacggtccaccggtggacgaatttgcggtccacaaaattgatgtgatttttgggaaggngcgggcacttgattaattggcatcaatttgaattttgagttaattgcgtagcactacacattggngatttcatttttgctcaaaagtaactaanattntcatttttttcatataatttttgtccaaaaaatatga

SEQ ID NO: 32362 - DNA, 1030 bp, Heterodera glycines
aatagctaaagcaaaacgcgtgcatgtttgaaagtatcgttcataccaataatgaggggtttattttaaatgaaattttatgataaaccttattatctcagaagctatttaattgattcggatgtttttatcgcggttaattagagcaccgaaaactggtttgaatcgtgaagtttatcatttctaactcacttctcaaaattgttgataaattgcaaatatatttttccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatatattccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcggatgtttttatcgcggttaattagagcaccgaaaactggtttgaatcgtgaagtttatcatttctaactcacttctcaaaaatggtgataa

SEQ ID NO: 32363 - DNA, 1362 bp, Heterodera glycines
ccccttttgggcaatttttggtggtaagaaggggtatcccaatttacaccggcgtcccgggtactacggtggaaaatgaagacccgaaacaagtgaaggaagccgatcaaaccgaaatcaccacacgtccctgactgtacgtaaaattccagtttgacaatgagcagataatattgaagaagcaggggaaggtaaaatgcagtgcaactaaatatgtgcctaccagaatttccgaagccggagtttgagaagccgtcatttccgaagccgccgccaccgcccgaagtgggactggtgacggaaggacgacgctccgattgaccgaatccgccgccagaagaaaagtcgttgttggagaagccaccgcccccgtcgctgtcctgacgattctgtcgaccgaatccgccgccacctccgcccccgcggcctccaccgcgtcccccgcctccgccgtcgttccaacgattgcctctcccaccgcgacggttgccatccgactgattctgtgtgtcgccatctccgaagccttgaaatgacaataatcaatattttccaaggcaaatttcaaaaaaatcttatattagaaaatcttttacgaaaattctttaaaaaaaaattttttgaaaatttttttagcgattttttgaaattttatggcgaattacatacactaaaacattaaaaaggggtggggtgtgaaaagttttttgcgaaggggggtcggccgctgagattctgatgactttttttttcaaaaccattttttgcggcgcactttttccaaaagaaaattcggggacatggggccggcggagccgataggtgccgccgggaaatttttgcgattttgagccaattttttttaagaaaaattgagatttttgggacttcgttgaaaaatttttcaatgatttttttcttgaaattttctcataaaaagaatattttaaaaaattcgggggggggggatgaagtgcactattttagtttcaaaaaagattgaaatatgattcgaacgaatagtttaacattggctacttatggcgaatttaatggtaccagaatttccgaagccggagtttgagaagccgtcatttccgaagccgccgccaccgcccgaagtgggactggtgacggaaggacgacgctccgattgaccgaatccgccgccagaagaaaagtcgttgttggagaagccaccgcccccgtcgctgtcctgacgattctgtcgaccgaatccgccgccacctccgcccccgcggcctccaccgcgtcccccgcctccgccgtcgttccaacgattgcctctcccaccgcgacggttgccatccgactgattctgtgtgtcgccaaagccttgaa

SEQ ID NO: 32364 - DNA, 1052 bp, Heterodera glycines
acaatgatttatttaaccttggtttgcttaaccatggttaaaaaaatttttgtaaaaataaaccgcggttaaggcgttgaaaccgcggttaatttaaccgggagcagggaataatgccctaggacctataatgagcgcccgtagctcagtcagttagagcattccacacagtgaggaaaggtcgtgggttcgagtcccaccgggcgagttatcttttatcttctacaccagggacctaatttagcaaaatgcattgaaaaaaattggcaaaatttcttaaattttggcaataatattttgtttattctttttttttaccaaatgttggtttttgcgataataagccattaaaattgtctccctaaaattaaaaacaaatttttaattttatttattatttttttaaattccaaccagaatcatatcgccaaaaaatcctggagttttagctgttgacattttgctgctattcgctgtcttgatgagcgacacaagagcataccgtatatgctctaattatagcccagtctctattaagcccgcagtctccaattatcccccagtgtacgaggtgttttgaaaaataatccctctatcataatcccccagtctctaattatccccccttttctgaggaggttgaaaaataatcccccatgggctataattagagcatatacggtatgtgcttttaacgggtattgaagtgcaaaaaaagagggtgcacaaatttttgctgccaatgcgaaatcaatgaaattttggccactcaacgcgacgaaagggaacaacaaatggccagataaatgcactgactcaaaagccgaaagcagtgccaacagaataaacgatgtgccatggagacttctgaataggaaattttgttttttttgatgcccaaaaattcacttaaaaaacccttatcgggactggaaattcccagtgcttcttccttaaggtcctgccagaaaatattttgggtttatattttaagaatctcttaaaaactcagtaaagttttcaaaaaaaaacaaaataaaaaccaagaattt

SEQ ID NO: 32365 - DNA, 1716 bp, Heterodera glycines
ttgtcttatgattatcatcatgctgtttgactctctcacatttattttgtacctaaataatcaacaatttactgataattaatgcattaatttcctggtccatcaacggttttttgtgcaccgcaaaccctacgaatttcatcaaaatgtaaagaatctttatcaaaatcacacacaaattatttatcattttttgtctgtctgcttatcctttggcgtgcctcgccaaaaaatttttgtgtgatcgatcacaatttaatgtgtgcgtcagaaaggtgatcagatggggcagaatgggagtgaaatgctcggaaaaatgacagtgttgactgatcactcgacaaaggtagctttttaatatacaaaaaattggaatggagaaaattttaaaaaaagttaataaattattttcaaataaagaagaaaattttttttcaaatttaccaattgataaaaaattatttttaaattaaaagaaattttttgggttttttttaattttaaaaaatgattttgtttgtaactgttgttttttatataaatcaatgggttgtgccgaagtacattaccaatctaagcatgaacttgtaccaattttctatcagcatattttcataattaacatttttgtgaatttaatatacaaaaagttctttttattattaatcctttaccatagggttcagccccgaccccgagctccccgaccccgatccccgacatttttgggcttattccccgccccgacatgtcgccccccgaggtccccggcccccgactttttgctccccgacattaattcggggaattggggactccgagcattgtaaaaagttaagttatttcaacaaatatttaaattttacccaaacactaagccaaataaaaaattttcatatttcatatttttttaattaatagatattttaaaacttaacttcacatatttttcaatttttatgtgttaatagatttcatccaattaattacttctaatggcttcaaaagcatctgatatttggaattttttcacgaaaatttcttcagaggttgctaagtgccggctttgtgaaaaccaattagcgtgtaaaaaatcgtgcacaaaaggattgtgggggcattttaaagcgaaacacgctaaagaatttgaaaactatgcaaaaatccgacccgtcaacggtaatacaagcttccttttttattgaatataaaaaaaattcagaaaaaccaaggcattacaaaattttttggcaatgaagacccacaaaaaaaggcggatgaacaaattgcaaggctgatgataagaacgaattgctcttttttatttgttgaggcaccggaattacagaatttgttctctttggcctacccgaaactccaagtaatattttttacccatttttactattgtcatattttttaagcttcgccgcaaagattattttcggaggaatgtaattcccaaaatggccgatgaaattcaacaaaaaattgttcagggaattggtcaggattttttttctgtgacctctgatggatggtcgcaaattacaaaatcaccagcgctcttaaggttctataatccttttcatggattatacaaacagactttagcgttaccgtacatcatataaatgaacatttgaacggcccgattttgtacttgatgtgattccaatgacaaatcacacaggagcagacatagcggaagaaatg

SEQ ID NO: 32366 - DNA, 1142 bp, Heterodera glycines
tatcagagtgcgaaaatcgcatgtgatctagcctagcaaaaatggtgtaagtaaaaatcgtattacgctcaaaaactcctcaaacattttagcgctcccattcctctacaatcgccttatacatcccattatgagcgctaaaatatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaattatcagagtgccgaaaatcgcatgtgatctaagcctagaaaaaaatggtctaagtaaaaatcgtaattacgctcaaaaagct

SEQ ID NO: 32367 - DNA, 1412 bp, Heterodera glycines
agaagttacatcagaaatttttgcaggtacaggattcataagacgaaggtaactgattgaaaggtatatttttgtcatttcagaacaatgtcttcaatgaccaaatcttttaccaacaaattggcttcagaaaagtcgccctatttattgcagcattcgggaaatcccgttgattggtcagtgttatgggtacttaaggagtttaaggttttaatttaaaataactaggtatccatggggtgacgaagccttcaagaaagccaaagaattaaaccggccgatatttctttcgggtaaatatcaaacatttttacataaagtttcacttcatttagtcggctattcaacttgccactggtgtcatgtgatggaacatgaatcgtttgaggatgaagcaattggcaaattactaaatgagaattttgtcagtatcaaagttgaccgagaagaacggcctgacgttgacaaactctacatgagctttgtccaggtgggtttttaggtaatttattttataaatttgttgagggtttcattcagagtcttacgggaggcggcggatggccaatgtctgtctttctaacgcccgacttggagccgatcaccggtggaacttattttcctccaaaagattcaatgggtcggctcggattttccaccgttcttcgaatgatttccaataaagttttttctttttgttttcttatttatatattttaattatgtcagtggaataataattcgcaagaagtgaaagagcaaggccgggaattggccgaagccattcgcgaaggcattcaacaggcaaagtcgtcgcagcttccaattgcggacgaagccgtacagaaaagctatgctcggcttgttcgccaatttgacaaggaaaatggcggcttcggttcagcgccaaaatttcctaaagcaggtcccctaaaaacattcaattctactgtaattgagcattttagttgatttggactttttattgtatttttcggttatcaaaaaatccaccgaagaatcggataacgctttgaaaatgttacgactgacttttgagaaaatgttttgtggtggaattcatgaccatgtcggaaaggtgttatctccgctactttaaaagtttttttaaagcaaatttagggattccatcgctattccgtcgactcagtttggcacgtgccgcactttgagaaaatgctttacgaccaaggacagctgcttcgttcatatgcccacttttacatgataacgggcgagcaaatggcgtttgaagcaatttgtgacattgctgattatattgccaccaacctaacgcacgctgtgagttccattccataaattcgtttgaaactgaattgatgtctacaacagacaattttttcattttttgaaaactaactaaaaagcag

SEQ ID NO: 32368 - DNA, 1815 bp, Heterodera glycines
ttcattttatcagatttggaccctccaaatcaggacccttttgataaataaggacatcgaagccttttacaaaatagaccatttttattttaaaaatgctttaattatcgtattttattccaagaagcaaaataaaggattttttaattaaaagatgtattttatttaaaaataaattaaataatttttatacatatttaactcactaaatattaagattcgttttaggcaaatgcctagaatttctgcgcacttaatacacataatacccccaacaaattttttttccttgacaagaatttttggcttagaaattgtcctcctcatcctagatttatctaataatctgcaaacaaaaaaaaaattgttaactttcaaaaaaagttatgaccagaagttttttcgatcactttttgtcgtaacttttttttaaattaacgaaatttttttgaattttaaagataattgatagataaattgttcaaaattagtatttaactaaaataataaataggcaaaatatgttaggcctcgggtgggcatagaacccacgctcccaccctgtccatgggcagcagctctcccattgagctaccaaatccaagggttttccatgttttaaaccacgcattcagctgcttccttacataaaatttttcaatattcttcgattaaggaaacaagcctgcattggtgccgccttttcagtgccaagcaaaagcaatttgggtgccgatggtcgtgtcactttggttggcatttgggtgctaatttggtgcgacattttgtccaacaaaggtccaagctgaggcgttagaaccattgatgggattggcactggtattcgtcgttgggaagacaatgaaagtgccgcattatcatcatcagcttcctcggatgagcctgaaaattgtcaaccgggatcccatgttaaaaatttagattatttaatccatagatcttattctgtgatttttgtgcatatgaataaattctttctaagaatttaaatggttttagaatcaaaattttttaatcaagtgatcaattttcaaaaattgagcatggcactttttacaggctctctttaaagttaaaattattaagtagcacaaaaaaattccatttgaatttttacccatgcattttccagtggaattgtcgtattcataacataggcaaagataggcaccaggcgtgttctgttaaaggaatcatggaattttgttggaaaatgtacaaaatttatattataataaggcaaataaaattaataaaattcattagttaagttttattaattcgaaataaatttttttgaaattatcaactgcaaaaaatctttaaaaattggaaaatgtgtgatgaaaaaaatcttcgagttttaccatacaatcgggctgttcatttgggcatgacactgattcatcttggcattcatcgatgtcctcgtcacagattggtgcacctttccatccttaaaaaataatataaaatttataaatgttttaatttaattgttaactaagcaatagttaattttccatttttgttttttaggtagtgaaaattctggtaaaatcatgaaatttttacttgccaaacatctgacctaacttcttacagatgagcgaaatttcgtgatcggagaggaaattccccgacaaattaaaatctataaaatattcacaaaaaaagaagaatattaactaatgcagaaaagcgaaattttgtcttaattaatatgaaaaataaaaaaaaaaatcattattgaggaggcaaaaaatttttgactttggccatttttatatgttt

SEQ ID NO: 32369 - DNA, 1177 bp, Heterodera glycines
aaaatgaaaaaaaataattaaaaaaaaaataattgctggtgtgggtaagggggaaggactgtgtttcctccaggcaaaaaatttttaagaaaatttaataagcatttgtagggtttttcagcagtttcccctgcaaaatttggtgagcttctgatcagtctagaacgttgtgtgataaaatgaaaaaaataatttaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgtgtgataaaatgaaaaaaataatttaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaataatgctggtgtggtaagtgtgaagaactgtgttcctccaggcaaaaaattctaagaaaatttataagcatttgaagagttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcatctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcgaaaagggagatgaataaattttaaaaaatttt

SEQ ID NO: 32370 - DNA, 840 bp, Heterodera glycines
cgcgaagcggccgaatgtcccccaaaaatttaaaaaaacgggcgcgaagcgcccgtcctgaggccgcgaagcgtccgaatgttcccacaaaattaaaaaacgggcgcgaagcgcccgtcctgaggacgcgaagcggccgaatgttcccaaaaaattaaaaaacagggcgcgaagcgcccgtcctgaggccgcgaagcggccgaatgttcttaacaaaattaaaaaacgggcgagaagcgcccgtcctgaggcagcgaagcggccgaatgtcaccaaaaaattaaaaaacgggcgcgaagcgcccgtcctgaggccgcgaagcggccgaatgtcccccaaaaaattaaaaaacgggcgcgaagcgcctgtcctgaggccgcgaagcggccgaatgtcccccaaaaattaaaaaacgggcgcgaagcgcccgtcctgaggccgcgaagcggccgaatgtcccccaaaaaattaaaaaacgggcgcgaagcggccgaatgttatcaacaaaattaaaaaacgggcgcgaagcgcccgtcctgaggccgcaaagcggccgaatgttcccacaaaattaaaaacgtgcgcgaagcgcccgtcctgaggccgcgaagcggccgaacgttcccacaaaattaaaaaacgtgcgcgaagcgcccgtcctgaggccgcgaagcggcccaatgtcctcaaaaaaattaaaaaacgggcgcgaagcgcccgtcctgaggccgcgaagcggcccaatgtcctcaacaaaattaaaaaacgggcgcgaagcgcccgtcttgaggccgggcgtgggggggagggggaggcgtgggctgagaggggtgtgggggg

SEQ ID NO: 32371 - DNA, 1262 bp, Heterodera glycines
aattaaaattaattttcttaacctattttctgattctctagcttttttagtcatttgaaaattcaaattttcgaaaaattacgtataggaaaaggcttatgtatagattttaaagagaattgtgaagaaagtcaaaaaatgttatcaatttttcaatttttctaaagacttgcgaatttggaaataattttgttaaaaaaaattccaaatttttcgctgattcattgaaaactaataaatttttctctttcaattctaaataccttatcaattattgttctgggttaaattaatcaaaaaagaaaaatggattataaaaaagactatttaattgctttcaaatggagcactttcgcttacgaccataccacgttgaaagcacgccatcccgtccgatctggcaagttaagcaacgttgggccttcttagtacttggaacggagacgtcctgggaatcgaaggtgttgtaagcttttttcttctttttccatttttattttttgttttgtaagaaaatgaattattttttgtttgtttttgttaaattattcatttgcttgaaattacttcttcctataactttgtggcttgttaaaaagctcttcttatttttaataatatttatttgttgcctatggaagtcgaaaatttaataaaaatttaaatcgctttgagaaagaaaaatagaatttgctgaacaaaaaatgtgaaatgaaaagtgaacaaattttaaaagaattttcttttaccctaagggccaaaagaatctttttaaattcgaaagaacagctataaagtcaggctaaacatttgaatttaactttttttaattcattagattttccaatttaggcccatcatttttaaatgtcattcgctttatgttttttatcgtcataagcttgaaaaaacatttttagtttggttttgaacaattaggatgaatttttcgtcccaattttgcctatttgtgcattttgtgccgaaattgtttttttttggttttttatcggaataaaaaaaatggcaccttaaaaaagagtgacttaaaccactaagaacggaggatacttgtcttaaaaattgacaattaaaattaattttcttaacctattttctgattctctagcttttttagtcatttgaaaattcaaattttcgaaaaattacgtataggaaaaggcttatgtataggtttttaaagagaatttgtgaaagaagtcaaaaaatgttatcaatttttcatttttctaaagacttgc

SEQ ID NO: 32372 - DNA, 1465 bp, Heterodera glycines
tttctgaaaaaatttttaaggaattaattttgcaaaaaataagtaaaaacggaaagctccaaattttcgaaaatttttttgaaccaacttacttggccctcattttcagtgtaagttattccttttcccggggagtttccctgcaaaatttggttcgctttttgctcaattaccaaaaaatatgagtgatggaattttcactaaaaaagttaagcctccatttttggcatttttaaaaagcaattaaaaaattttttaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggccttgttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctgaagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctattaaaaaaataaaatagtgaagttttaaaaattaataaaaatttataaattaagagttactggtgttagcatcatagcggtgcttttccttgtctttttgatgcccttgcaaaatctggtgcgcttctgatcagtttatataaaaaaagttaagcctaaactttttggcatgtttaaaaaggaattaaaaattttttaaatatttattcatctccctttttgataatataagagtcagagtgccttattcaacttgtaaataaattttggtgcgtttcagagcagtttctgtaaaaatacttatgaattaattttgtaaaaaaataaataaataatgaaccctcctccttaataatttttctgcgcccaaggtactcactcggtcgcttcgcggcctcg

SEQ ID NO: 32373 - DNA, 1567 bp, Heterodera glycines
gattagaagaggtacaacagtgattagtagtggtacaacagtgattagaagagtgattagaagaggttcaacagtgattagaagtggtacaacagtgattagaagtggtacaacagtgattagaagagtgattagaagaggtacaactgtgattagaagaggtgcaacagtgattaaaagaggtacaactgtgattaaaagaggtaaaacagtgatcagaagaggtacatatctgattagaagaggtacaacaatgattaaaagaggtaaaacagtgatcagaagaggtacaacagtgattagaagaggtacaacagtgattagaagaggtacaacagagattagaagaggttcaacagtgattagaagaggtacaacagagattagaagagtgattagaagaggttcaacagtgattagaagaggtacaacagagattagaagagtgattagaagaggtacaacagagattagaagaggtacaacagagattagaaagtgggcattcaaatagagcatttatggtaattaaggaattgtttttaatcaaaatagataaaaaatcgatgtgttatatttttcattttttaaaatataatacactttttattaatgaaaaacaaattatgaaatgtataataattgaatagttatttaaattgaaatgaaaaagattttacaattaaattttaaaataatagctgaaattctttaattaaatataataaataatttaaatgaaaatcattattcatcaaaaaataatttaattaaactaaaaaaatttattattaataaaaccaaacatttaagtttattaaaagtaatgaaaattaacccaaaaaatataaagaaaaataatgtacaccgtccggcttcgaactttgcccccccccccaaaaaatgatgcctcagaatccccaatcacacagggattctgaggtcttaacgatgtcaaaagtaaaatctgatcacgtattcgtgatcagcggcccaaataacccctaaagacatgttttggtacaatggtggttagaagaggtacaatggtgattagaagaggtacaatggtgattagaagaggtacaatggtgattagaagaggtacaatggtgattagaagaggtacaatggtgattagaagaggtacaacaatgatgagaagaggtacagcagtgattagaagaggtacaacagtgattaaaagaggtacaacagtgattaaaagaggtacagcattattagaaggggtacaaatctgattagaagaggtacaacaatgatgagaagaggtacagcagtgattagaagaggtacaacagagattaaaagaggtacaacagagattagaaagtgggcattcaaatattgcatttacggtaattaaggaattgtttttattcaaaatagataaaaaatcgatgtgttatatttttcattttttaaaatataatacactttttattaatgaaaaacaaattatgaaatgtataataattgaatagttatttaaattgaaatgaaaaagattttacaattaaattttaaaataatagctgaaattctt

SEQ ID NO: 32374 - DNA, 2093 bp, Heterodera glycines
aaatactaactctgtccgaatccaaaaataatttttatcactcactatctttctgatgatcattaatgcatccttctctccactgctcaattcaactgtttctctcttctctctctctctctcgctttctcttttctccctctctctcttccctctctctctctctctctcttccctctcattatctctcttctctattattagtgcgttgctattttgatttttaaattatccaaaaagtaagaaattaaattcaatatgcaaataacacgcaccggatatcgcgaatttcgtgcctttgggtgaatggcacttttttccaatgtgccaatgtaataaaatttgacaaattttcctacaattttgggttaggaataagaaagcatttcttaaatgagtttgtagttggataccgtaaatgctctaattatccccccggggggattattgttcaacctcctgtaaggattattcgacgcatttccctcatttaattattccttattggccattatcaattcaatcacatttatccattttcacacgtttttccttttctcattgtaatgtttctccgcccattctcttcgcattttctctttccccagtgatcagttagtcagtagtgatggaacagacttcaattattattccgatttctcgcttcgtaaaaatccaacagcgaatgaataaacacatctttaacagtcaatgagtcgtttgggggttcggggcttggtcaaaggcgccttggcttttccccattccctcccaaactccatccgggataaacggtgcattgttggtctgggggcacagtgcgcatccctcactattctaaatcatattcatttatcggagtcaaaaggtggtatttattgtttttaatatctaatatatagttttttgtttgtacaattttgtaccgattttttataatattcttttttcgtgcaaaaaaataatattctcttctctatttattattataatcattttttcatttatattttaaaaataaaaaataattgattatttcatctaaagctttcattatattaacacatagaaaaatgctatattaataaataaaactttcaattttttaatattagcacaagaagctctaattagaattgttgttttaattataaattattgcatctaatcattaatttgtctcaaaatttttctgtggataaaaacgaatttccttcgatatcatagatgttgtgcactttattatcggtcgcgcatatattgattcatttaaaaattaaataaaaataaaatattaccaaatatttttattcatatttaatttgtttgcatttttttgtcgttgtatttccattttttccttaataactcttttacactctttttgctcatttatttttattgtaataattgtttctggttaaattaattttaattaatttacctttttgcaaaaaagttgagagatatcaattaaactaaatcgaaccccgaaaatacacccatcaggtctataaattaaattattttcactatttagaaatttatttatttttttaatatttacattttatattcactgatgctttttaatttgaaaattcaaaaattttacggttattatttaaatgattatattgcatgcatgccatattaatgaattaatatttttaaaaatattataaaatattttttccaaattttaacatttttcataatctttttctgagaaacttttaatttctacgaaaatttgtgaaaaataaaatttccatttttggacttttgtagacataaatttttaattttttattgagaaatacctggaaatgaaggtttttgaaaatatttcggtacttagagagaaaaaaggctactttaacggaggtgaccgatttaatagaggatttttcaaaatgccaaaatatacttaatcgcgaaatatgcaaaaatatgcacaaaaatggtaatacgtcctgaagcttcaaaaagctaaaaatttgcctttcatgcgtttcttgcctcccacattccaggaacaaacattatgcatgtaaagataataaaaaatattttaattataaattcttgat

SEQ ID NO: 32375 - DNA, 1090 bp, Heterodera glycines
  misc_feature (1086)..(1086): n is a, c, g, or t
tatgcgttctttattcttttcattttaacttaaaagagagaaagcatagaacgaaggaaaagaaacagagaaaggagaatcgataagacggggaaaagcatacaaaaagtaaaggacgagggacaccgggtaaaagagagggcggaggggcactcccccccccccccccacgcgccgtccctttgctttggccccacgcaaatagcgaccactgcccaacgaattttgtgccgcttcacaccgcccctttcgcatcgcgtcacaatcccacccacccttttccccatggaatggacaataaggaaaatggcaattaaatggaagggggcgggggattagcgtaagctaaatgagagaaaattttgttacaccaatgaaaccccaaaaggatgccaaaaaatatcacagcaagtcattaaaattttcaattgaaaatatgttctccattttctgctgtattttagaattatgagttccaaaaatatcacaaccaatataaatgctttgaaataaatattgcatgttttttgtgtcttcacacaatacgttccttcttctgtcatcattcgcttcctctctttttggcgattttcttcgttaggacgggggaccaacggattgaaactcggccaatttgagagccttgaatgattttggttggttaatcattggctttggggaggggaaggataggaattgtactaatcgccctttgtggctgctaatcttttctccacctgctccttgcacagcttccgcaaatcctcgttgtcgtacttcacttcctcgatggtttccaggcaaccgccatacatctccaacagattttcaaaacgttcgtgtaattggaaaaggttggagtgggccgaatccaattctgtccgtaaatgttcaatcgaaccgatgtcgagctattaaaatcgttattaagtgggcggggaggggggggggggggtcgttagattctgaccgagtaactgttggtgggactctgctcgccttgcaaagtgtccaacctcatttggctcgaagttgtggaagcgttgccaaactgaacgaaaaagggaacatttgagttgctacaanaaaa

SEQ ID NO: 32376 - DNA, 743 bp, Heterodera glycines
gcacccttaatttccaatgttttttgtgcatattttgcgatttttatgcatatgtatttgatgcatatttcacgactttatttgcatatttatgcgcatattttggccgctttcgtgcatatttttgcagccctgttaataataatttaaaaaatatttattttaatttgggattgaaactccagcaaaatttgataataaatttttcaggcaccgagacttgggagaacttggaattcactatgggtcaagcccaatgttagacaaaattactaaacgcgattagcaatttttaaaaataatacttttaatagagtgtgccgaattttattagatttcttaattaaaatatatttattatgttttctgaattaaatatcattaattacgtaaatatgcaagagcttggtcaatcagagaatatttaggtatctaattttcgtacttatgaaattttgtaaaaaacacagacagacagaatggcacgcattctttggcattccgtgcagcaagttttttttaaatttatttttgatttaagcattggaagttaagggggaaattgaagggaccacacgggaggcaaaaaagcatatttaagaaggaggagggccaatgtgacagtaattcattcattcatttgccggacaaaaagcacctttccaattaagcaaatggaaaatcagacaaatgacagcgaaaattcatttaccgaagcacaattggtaggaaagggaaaggag

SEQ ID NO: 32377 - DNA, 1227 bp, Heterodera glycines
gggtacaccccaaaacgtcgccgccgaaacgtcgccgggacataacgtcgcaacaaaaaaaaatttttttttttcaaaattataagaaaattaaaaattaatttagtttttttttgaaaatctaagtgttaataaaaactaaatttgatgaaaaaaaaaacttgaaaaaaattttttttccttaaatttcttcataaatttttttgaattcttcaagaatttttccgaaccaggctaggtaactaattttttgataattttaaaaaaaaaaatttgtgtgacgttatgtcccggcgacgttttgtcctgctcccaatatatatatattttttttttttttgccacattcaaattgattaatttgttggcaattaaaattaaaaatttccgcatttttttgccattaaaaattcagcccccccccctccgtcctccaccatccaaccaaccttttgcacggcggacacaaatcgtggcccgaccccattgcgcctgtccatgtacgcggcctgctcctcatcactcgtcccctgccaatgtttatcgttatttttttttattggaatgactgatttcacgaatctgacattcatttagactaatttcgaatgccgaacccgaattcgaacaatgccaaaatccgatttttttaaaaattcatatatttttttaaaatttctgcggcgagatttttgacggggacgcagaatgacacattttctatgatttttttcttaaaaaatttctgtttgatttcttttggtttttttttaaatttctgcggcgagattttgtctcggcgagatttttgggtgtatcctttatgacacggcattctttggtttgtgatcgattttttgtattttttaaaatcaatttcagggaaaaaagtgcaaaatttgtaatttgtaattttgattttttttttttttgcttgatcgaacgggagcaggacaaaacgtcgcggccgaaacgtcgccgggacataacgtcgccgcaaaattttttaaaattttataaaaaaattatcaaaaattttttagttacctagcctggttcggaaaaaattctagaaaaattcgaaaaaaattgtttttttaagttttttcgatttttttttcttagaaataaacaaatttagtttttattaacacatagattttcaaaaaagctaaaattactttaaattttattaaaatttttaattttttttttgcggcgacgttt

SEQ ID NO: 32378 - DNA, 946 bp, Heterodera glycines
cgccgccgaagcggcgcatgtggcgaaagagcgtgagattgaagaacgacttcatcagaagaaggaaagagaacacacggtttgcgaccaaactccgacagtccaaagcacagaagttgaggagaaagtatgtttgggtgggattgaccaatgcatagccaattgaatcggtcattgtgtgttatgccaaattcgaagtggtctttatgaagcatttttcacaggaccaaaagactggtggcaatcaagaagtggaaatgattgacgcagcaacagaattaaccgggtcagaaacggatcgaccctcatcgaaagtaggggaagagaaggacaaagaggagacgtcggaagagaagcaacaactcgaggaaacgacggaggagcctctccatcagcaacaacagccgcacagagagccaaggccattattcaaattcaacattgccgacggagggttcactgagctgcactcactttgggtcaacgaagaacgagttgctgtgcctggcaatgaatacgaaatttggcaccgccggcacgattattggctgatgtgcggcatcgtaacgtaagcggatttatttgttcaaattgcgccttgttgttagctattttattgaattccttattttatatgcagtcatggctacagtcgttacaatgaaattcaaaatgatcctcgcttcgcaattgtcaacgaacctttcaaatcagaacagggaaagggcaactttatggagatcaaaaataaattcatccaacgtcgatacaaggtaaaagggcaaaaatattcataaattcattgcctaaattgtaagagcccttttaatttattattttagctattggaacaagcactgataatcgaagaacaattgcgtcgggcggcctatttgcagattactccaaaaagtgaagaacatttgccgcagaaagaaagcggcgg

SEQ ID NO: 32379 - DNA, 1012 bp, Heterodera glycines
  misc_feature (226)..(226): n is a, c, g, or t
  misc_feature (988)..(988): n is a, c, g, or t
  misc_feature (1000)..(1001): n is a, c, g, or t
aaaaaaatatttaaaaaaaaataaaaagaaaattggatattaaatacttttaatttaataacgcccacccgttaaaaatggttttggataaaaaattattatttttgattttgataccagcaacaaatgacatttttaattggctataaattcacgaataaattaaataaaatacctaacaattcttttaaaattaagagagagagaacttaaatttagtcttatntaatttagtaaaaatgatcgcaactttggcccgatttatccgcgtataaatattagaatttaaaaaattatattacattaaaattttaattacaaaattcaacataattaatgtaattcgttaaatatgaaaatgaaacaatggttatacaaataataaaaaagataatctacagcaattttatagaagcaaaaatataacaataaattaaaataaactttcaaaaatgttcgcctaatgcgttaaagcaattaatttacaggaagaataaattagtaaaaacattcagaaaaaataataaattttaaaggtattaatgaatgaattaaatgacaattaatattaaaattaaatagataattatctaaaaataataatccctttgaaagatatagaaattatttttatatatatgtaaaattaaagaaaactaaactaactaaataagaagaagtcctggtcattaagatttgaatagaaacttaagtgaaaattagtcttgaatgatacagaatgtaacattatagccgcaccccgtttttgagttttaatttactttatatatatatatatatatatatatatatatgaaattagtaaatcatttaagataacttacgattaataacttaattttttatggcatatgaacaagttcattttaataaataaatttaatacttatattggcttctttaaaaatagggtattttttaatgtttatttgaagcagcttagagcaagaagcgagagcgtcagatngtcattttgcgnntaatttaaatt

SEQ ID NO: 32380 - DNA, 1323 bp, Heterodera glycines
  misc_feature (174)..(174): n is a, c, g, or t
acaaaaatgtcggaaatttaaattttcgagtttaaatacacggaagggacaaactgaactagtgccaaaatacgttttccttgtaacttatgtattcgaatttttgttcgaattcgggcccgttttcgtaattttgcaaaacaaagatcatattcgtgatcaagtcacatattnaccctagaaatgatttttatttgaaaattcaggaggggtctcaaaacagaaaagtacatgatcattgattgatcagtgaaaattttaccgtaatttcaaataagtttataaactcgaggttaattctatgttctgaatccgaaagtgcccaaaaagtggcttaaaggttttccttgaaaactctaaaataggaaaaaagttttttacttatccgccaatagttttgcttcaaaagttcaactccttggattataaaattttgcaaaaaagaatttttttaaacatatgtgcatacctatttggcaaccttaaaaaagattttcaattccaaattttttcagatttggtgtctcgcaatctctgctcacaattttatataatattattttgcaaactgccgaagaatttaaggaaattgctgaaccaaacataacgcgccgttttttgacctttttaatgaaattatttgccaatatgctccattttttgccacaaaataccaaggcttcattggcggaccataaagttttggcccatggatgggattggactttccattttttgacaactgctggccaacaattggcacagttggaccattatttagcagcaagtgccaaacagagccaaaatgttgccaaaactgatactgaacagagtgccaaaagaggcttttggcataaaaattgtactaatttcgcatcgggcagcggaacaaagcagcaaaactgatcagttgaataaaaaaaagagcggaaaaaaagaatgatttgtaataaatgatcatgatgatgtatgtgtttatataatatatttaaataagaaatgatgtacattatgtaattctgcctaaattagtcgaagtaacacagtaaaacgagttggccaaaatcgattgggtttacgtccttctttcatttttaaaacgaagagaaaatactagagtagtatgggaccgagaattttgggcaaaaccgggacttgccgggacctgagaagccgggaccgggacctcgatttttgtccgggaccaacagggaatttttaaaaattaaaaaaaatcaaattttaatttatttcaagtgaaaaagaaaaatattgacaaaacccccaaatagtgttttcttaggaccgaaagggacttcaatc

SEQ ID NO: 32381 - DNA, 1884 bp, Heterodera glycines
  misc_feature (1739)..(1739): n is a, c, g, or t
  misc_feature (1798)..(1798): n is a, c, g, or t
cctccatttgcctttaactgtgatggccccccatattgtcttctattctttaaccccccggttattgatttttgttctgtggcctcagtgccctccatttcctgtcccatcccggtgcccaattccatttgtgataattccccggtgatggcatttctgtaatcaatttgtgataattcgttcaccatttcaaaattttggtttaattacccaagtttgaggtcatttcccggaataaattttttattaattctgtgtctcgtccctgcctaccccgaccccagtgcccgacctttggccccgaacgcaatcgggacaaattggcgctcctgcagctggatctgtgaaccacggactgactcaacgaatcccgttgacacaggggaagggaaaagcaaattagagagcctagacaaggaccctctgaggcttgtctagtgttcatagtttcgtgtagttattgtcctccgaggcataacttcacgagggacgtagcggacttagtgtttgccctccgaggaaacatttcgtccgagcagagggttgtaaggtgttgtgtagtggacgtagtacttgccctccgaggaagtacttcgtacaaaaagggtgttaagcgcgcactaggccacttacaaataaggaaaaaaggcaaactaacagtcctccgaggctttagtttatccataaggcaaaaggcaaacaccttgtcctccgaggcaggtgtttagtcacagaggtcccatcaaaagccccagggccaagaccagactgatcccggcaaaagacacaaaacaacacacgcacaaccaaactgcacgcaatgtctgggccaatacaaaaagggatcatcaatgcactcaaagctctggacaatgccaaaagcgccacctcactccttctacaccccgacccggacctgtcaaactgggaaagtgccgtcaacttggaggctcaatttgatcgggtcgtcaaggaaatccgcacaatggaaatgcagatggacagtctacgagattcatccaacgcttggattgaacttctcgcccgcctgatcggagacgacaaagacaacggcgaaaaagaatacgtcaaattcgacaagaatgagaaaatcgccggcgatacgacgcagcgattgtttttatctgctgaaaatacaattaataaaatagagtttaaattgtatggactataatcaccaaatatagacataaaatatggattaaaagctcaaaaatggccaaatattgaccaaaatatagactaaaatgccgaaccgaaatataaattttaattctcaaattttccaaaaaaatatgtttatattcaatatttaatatcagcagacgacagctcttgtctctaataactgtacgatgtacgaatgcgtaaatttatgttgttgttgggaaacattccctaaagagatacagacagatccgggattctggagtgttcaaaaaatgaaaagaaatttaaaaagaaaattatatctttttttatttttaataagtaaatcaaacgcatttaacatggtgttggatgtgaaatgacatttaatgtggaaaagaagaacattgttttgaaaaaggtcaataaatgcacgatgtgatggagcaggagatgtgggggagagatgagaatggacaatttttggccaataacaatgactaattggatcgatttttataaaccgaccccaaatcccgatcaaattctcgacaaattaaattttttanaattaattacctaccggaagggtaaaataatgaatttggaattaatactttggccctanaaaacagcgcacaaaacaattgaatgagatatgtttagctccaaaaaatgccatagggatggctggattatggatttccatacggc

SEQ ID NO: 32382 - DNA, 1407 bp, Heterodera glycines
  misc_feature (1378)..(1378): n is a, c, g, or t
cggagcccaatttgaagaaaacaaaatatttttataaaatatttaaggattttagttcaattgcatctctgaattgtattagccatatctcttcccatgttgtcacattcatttcctattcctcattttgccattttttcggttcccatttttaccatattccgtatcgtatccatttttccatgtttccgttccccattttgccattttctttcgcttccgattttgccatgtttccatttcccattttgccattccatttgcttcgatttccgtggccacctgttttccctcccaatgctttttctcccccccccccccctccctcttcaattatcgttatatttttgttgtgtctcttccaacaaaatcaattttatttttgcccaattcttcgaacatttgtccctcttctcttccctccaatgcctttcttcctccatcattttccttctcgaatttgtccttctccgtcatcgcttttccgttgtttccctgcctttgtaaaacttttcattggcaattccttccgaaaaatattaccaatttttgtccatttttcttaaccccccccccccccttttgttcagcttttcctcccttttctccaatgtccgccccctccggcgcccctcccgcccctttaaagcccaccgacgaagcattcctcaactattggctgtacaattcatactcgccgatgtacgcttcgcctcgtgacatggcattcaacagaaacggctcggtgtacagttggctgttgcggaaatcgtaccacagcaacaggtccggcacgtacttctacaggccgtactcgcgacggcacagcaccagcagcagcagcctttacacaccgggaaaatgaaaggatggaccaaacaaagtgccaattaccaaaattgggaatactaattaggcatttttcatcttttgaattgacacagagaaattccaattttcagtaaaatgacgaaggacaaacgacggaaaaaggagatgccaattcccaaatgaatcttaatgttttaaattgctgtgcaatttctcaggaataaatgtggacaaataaacacacacaattaaaaataactcaaaaaaaattgttcgggcatcgattggccaaatgttaaaatcacttttttaaatatatttataaaattgaataggaatgtcattaattattattaatgttgtttattatccccttatggtacaatattccgattaaaagttgaatcattctctctctctctctctttggcccttcatctctttctttttgggcattcgcaaattttgagtccgatcacattaatggccttgatcggagtacctccgaaccgatcactttgcctgatgccaaaatgactccgagcgnggcattgcgtcggtggtgcgatcgctttt

SEQ ID NO: 32383 - DNA, 971 bp, Heterodera glycines
acgggactcccggtcccggtggtttgtccaaaaaacccgggaccgggagtcccggcaaaatcccggcggaatcccattcccgtccggtctctactaaatatactatgtatgttacaaagtattaaataaaactagtgtaaacataagcaattgaaaaattaaagagttgaaataatagacaaatacagatgggatggctcggcaatgagtgtgtgaaatgcgtgaagttttctccatttttttgtttagacatttgtcaatataaataaataattatgaaagttttaagtgtgaaatgtttaatgatggaattggtgaacttggaaattgagtgatcaaataaatgattaaaaattaaatataaaagtttcattattatcaaatttttttttcaaatactaaaaattaataacgattgagaaataactcaaaccgtgaaaaaggagttgacaaataaataggttaaatgaaacgaaattttcaaaacttaccatttaatagaccattcaaaaatacaaaaaatcttaaactaaaataaatattttttccagaagaaaactttttacaaaaaatatactaactaaggacgatttcaagagaataaaaaactaaaattccgcaaaccaaatgaaaacaaaaattaaaaatccgagaatttttttttataaaatataacaaaaaaaaatctaaaaaaacaataaaaaaaaatttcaaatacctttaccttaataaaataattactcaaatgactcaaataataattgttaaatttatttattatgaatgtttgctttataatttttttatgtttatatttattaagttttttattttaatatttactattaacccatagttatatataaactattttagcgtataaatttcaggaattttaatacacgttttgattctttgcaaaaattaaaatgtagtaattattttttattaaatttttttaatattcatta

SEQ ID NO: 32384 - DNA, 1103 bp, Heterodera glycines
aatgaagaaaagaggttgggaaaatatacttccttaaagtgccatgaaaatgggtcatggcattcccgcttcgtactcgagtccgtagtcctccagcagagaagtgtccacgcggaaaaagcctggccatgggagggatcggtgaacagggcattaagactgacaatgccctccaattgccaccaaaattcattcccgatattttcgttccctaatttttggcaaatccgaccgttttcgccccattgctctccgaaactgttcaccgccacccaaaacagatgatcgtcttcgtcatggccccagccgatgagccgcacgacgtgccaataaatgatacggtcgtcaaagtgttggcgggggaaagggtggaaaatgcctgagggaattgggaaatgaaattgaagaaagcacaaatgggaaatgaattcaattccaaatgttccatttatttgtaggcttttgccccggagcagcttgtccccccaccgcgaaagttttttttaatttttcagcgattttttcaaaattttatgttgaattaatatttttaaaaaatattcaaataattttacgtattgcgccccttttgcccacccgagtcgtaatgcaaaaattcttcggtcagcggcagtgccaaagtggtgggcccgtacagaaacagctccttgcggatgatcgtccgaatttgttccatcgtcagagggccggcggacgacgttttgttgaaatggccgaccactgaaggcaaaaggacgcggtcattgcccgcctggtcgacgctcattttgcgggggaacaaagtgtaagcgaaggaaccttaaaaagggtgggggggggggggtaattagtggaaagaggggtaattagggataattaacgaaaaaatgtgaaaagagatgaaatatgatgttctaatagcccccaaattgaccaatgttcagttaggtaattggttggcccaccctttcgcttgtccgccgcgtattcccctccggcactgtttttgtaatatgccgtttggcacttatccttccggcacttccgtttcgtctgttcctccgcgtaaaggttgggcgtacacggcgtctgaatggcggcgt

SEQ ID NO: 32385 - DNA, 1442 bp, Heterodera glycines
catagaaatgtaaattccgtttttctctattaacagagataaagaaaaagtccgccaaaataagagatgtttttttctctgcactctctatttattgacacatgtctctttttttgactcgctgtgtgtacagaatgaccattctttgatattccaatggtttgtgaccaaatttagcatgttttaatcaatttaggaactaaagtgagaattttggagttttagactttttgttcgaattcgggtccgggattcgaaatttgtccaatgaaggtcatattcgtgatcagcgaccctgaaaaccccccataaacatgtttccaagacttttcagaacaaaaaaactcttcgtcacaaggggggggggggggggggtaccatctatagtattacccgcttttcttcttaagaattgattagaaagtatgtgattacgccataaaaaaagttttccttttatttgtagaggctttatttccttttatcaaaacgaaatgcgccacacgcaaagcggcgggccaacgcaaccgccgaacggcacaatgactccgccccacccgcaccatcgacgccagcagcagcaaatgccatcggcacagtctgtcggcagtgccgcccaatttggacgacaaccattcggagccggcggtgggccgataatggcgaacaatgcaatcgcaaatcgaaaaaagcgcagatttgccgacaaaatggtggcaccggaggtaaaaatgggctcggatgcctaataatgtcattatttgcaattgccactgcttattgctcatgttttttcacagattcgttctttgatgcccgaattggatgcttacgtcggccttttgtcctacgagcagaaattggacgcgataatttcgcgtaaaaagatggaaattcaagaggcactgaagagacccatgaaaatcaaacgaaaactgcgcatttacatttcacactcattcattcaagcacgggaacccgaggttggtttaatgaaaaattcaattcgcggaaaatataaatttgtgaaagaaaatcgtttccctacacttatcggcataaaaattttatttaaagtatcttctaaactgcacaagtaccagaaattcttccagaaaatttactcatttttaaaaaacactatttcaagaaaaaaaagccaaagaattttttgcttttcataatattgaaaaggcgctttaattccgtcgggagaaatgtaaatcacatggtttagacactgtcgggaactttatcttttttagtgtcttttggacagattgtgtcgtaaaaatgaccattcaagaaaactggaaaaatacggaattctaatgaactacaaagttcaaatatggtccagtcttcaaagcctgttctcccctttttataattaattctcccttttctcggaacgagtcctccaaaattcttattattttttt

SEQ ID NO: 32386 - DNA, 1076 bp, Heterodera glycines
  misc_feature (1004)..(1004): n is a, c, g, or t
taaccccgatgcttaatcgttccgggagagccttttcaaaatttttccattaccgtaagagctgcggaaattgtgaataattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattntctatctcgtaaccccgatgctaatccgttccggagagcctcttcaaaattttttccattaccctaagagct

SEQ ID NO: 32387 - DNA, 796 bp, Heterodera glycines
  misc_feature (9)..(9): n is a, c, g, or t
tttattatntttgcaaaattaattcataaatattttttagaacgtgctctgaaacgcaccaaatgttaattaaaagttaaataaggctctctgatgctttttctatcaaaaggaagatgaataaaatttttaaaaatttttaatccctttttaaacaggccaaaaagtttaggcttatattttaaaaagtttcatcgaacctagcgcattaaaatcgatataatctctccaaatcttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataacatctttttaaaatattttccttatattttggttatttcgttctactttcggtggggtgcttggaaaattggaatcatgcgtacccgtccgatctgacaagttaagcaacgctggctgactagtcaaaaggatgggggccgtgatgaaacgaaaccagcactgcttaccccgcggcacccggcacggacccccgaaggaatggaattaattaaattctcgccttcggggatttttttccattaggtcgaccgttagctttcgattggtctagtcaaatttttttattaaaaaaaaaaatttgttttttgaagtgttctgatgaagggcgggggggggg

SEQ ID NO: 32388 - DNA, 928 bp, Heterodera glycines
tctttctaccgaaatcctcctcaaatttgcgctgggtgtgcgaaatgcagctgccatggtcactggtggtgaccatgtcggtccagcgacttttcgagtcggagtgccgctgcactgtgtggttaagcgtctacaaaaaaataatgttattttatttaaaattatttgaaaaaaacaccttaaattttccaaactcggccaccaatttggtgttggagcagcggcccttggtgtggccatcctgcaggcagatgaagcagctgttgctgttgtttctgtctgcaacacggttgaagtgcttcttgaaagggccctccaactgaagaaaggcagcggcccattccactgcaaagaaaaaaaaaatgttacaaaaaaaaattaagaaaccccaagcttccaaaatccaacactccgccggcctgtggccgatacccaggcagcacacgcatgccacccgggtaccgccatttggccctgtcgccttgtaggaggggcactctgaaggacggtgccggccttcggtgcagaccgggcacaaattctcgtgcccggtcttccaaatgctgttggcagcggcccaaccgccgttgattatgctgctgttgttgtacataaaaacgaatttacgaaggaggtagagagagtagtagaaatttcgaagttaaaatgttcaaaataaacaaattaaaaaattttaattttaaaaacaaattaaaagacaaaataaatttaaattgttgctcgtttggcattatgttattagataaatttgaaataatttttgtttaatttaatttacttattaaattttgcctgcggctttgtaagccatccgcttatccccccggtatcccttttatcctaaaaccggttttttctgtagaaggagggatttttctaaaattaaagcttaatttcaaatttgtat

SEQ ID NO: 32389 - DNA, 981 bp, Heterodera glycines
aaagacaggccaaataaaacaaatttaattctttaatttaaatttattttagcaaattttctgacgccgccgttgcccaaaatggcgacgatgagccgcaacagtcgccggctgacccggaacaagcggacggcgagtcggagcaggcacagcagcacaacccgctgcagtaccggccgcgaacgcatcgccgacgcattcgaatggcggcgatggctgccggcgccgggggcaatgaatgaaacgctaattaaccgacagattaattaccaatattgactaattaataaaagcagatggtgtggggacccgagggtatgagctcctatatttttctttttgagtgaaaattcaaaaaatgctgccatttttgatttgatattatttaaaaaaatatatttttgaatatttaatgacatcgggcacccattagcttaacatataaatatttttattaaaaatatgagtctgtaataatttcaactaattaattagtgattttattgcttcacccatattttttgatttgtttttgaaatatttaaagaaaataaaacattatttaattctcatcaaattaagaatgatcactgatttttgcataatttacagaaaattattacaatttgaattttcgattcacaaataattaacaaatattttttatatagttttcaatttttattttattttataatatcataattataaattggtcaaattaacaaattctgcttatgaatctatttttaacatcatcattgtttctatcacttgaccaaactgagaaaattgtagcacatttattgctaaaaatattacgttattatttttcatttacaataattcaattcaattattattcgtttgaataatttaatcgaaatgttcttttaatttttgaaagaaaaaagtcaaaaaactataatattcctttatatatattatttgaatttaatatccgaataattttcatagccc

SEQ ID NO: 32390 - DNA, 1243 bp, Heterodera glycines
  misc_feature (87)..(87): n is a, c, g, or t
  misc_feature (191)..(191): n is a, c, g, or t
  misc_feature (1114)..(1114): n is a, c, g, or t
  misc_feature (1152)..(1152): n is a, c, g, or t
  misc_feature (1157)..(1157): n is a, c, g, or t
  misc_feature (1172)..(1172): n is a, c, g, or t
  misc_feature (1191)..(1191): n is a, c, g, or t
cagcgtcatcggtgtagtcgctgtcgtcgtcggaagactgactctcactctcgactcactctcgaccaccgcacattggcccatacnacacacagaaacagtcagcggtcgatggatgtgtgtgctgcttggcccccgctgtgtttgcgcacgacatcgacggatggggcggcggtggcggcggcgactcnccgccgacggggatttcttcagagtccacccccaacttcatcgatctgctgctgctgtccgattgtctgtttgttgttcgcgacattcgacctcatctgcagcaggagttattctcaatagccttctcaatctgctgaatgttgcttcctcattggttcaacaaatttcttggaaaattccaatggggggcaattagtgacaaatttgttgctcaataaatatttgtcatcaaaatggccaaaactgtgtcaaattctggcaaattcaaaagaagaaaagagattgtgcaattaaattaaatttggcaaatggatttggcattacaaaggttgagaagcattgtgaaaaaacaaacgtatctttttaaattaaaaataatccaatgtacattaaactccgattttcctgggcctatttcaattcagaccatatctcagatacgacgtgtcatatatcatatgtacgtttcaattatgaactgacgtgccataaggtcatatcgtatgcggaacttacatatgacggccacatatgacatgaaatcatatgtgagtgtcatatcagttttgggctgtttcaattaaaattgctacatatgatgtatttctatatatgatgcctacatatgataccaaacactgggataaatataagctcattaatgagatctaggccgtttaaatgcaaataaattaacaaaaatgaataaaatgttaacttttttttatttacgtaaaaatatttttaattttaaaatatttttaaagtgaagaaattaagggcacataccaaatatgtttttctgatataaaaataaagtctaaaataggcattgaaagtcgaaaaatagcttaacagctgcttaaaaagtttttcacttttggggtacataggagaaggaaaatttagggataaattctanatatctgaacaaatgaacaaatttttgttggaaaatanagtanatctggaaataatanacttttataatttaagggncgtgtctgaaatagtgattttgaacaaacaagattgaaaaagttaaacgaaa

SEQ ID NO: 32391 - DNA, 1532 bp, Heterodera glycines
ttgagtcggcaacgccacacagaaaacggacgggccccccacgaaggaccagcaacagggccaatttgtagaaaattttcttggggaacgaagtctaagggggggggacaaagcatcaaaatggacaaatgactaaaagaggaaggaaaaaaataagcggagggacaaagcataaaaatggacaaatgactaaaagaggaaggaaaaaataagaggagggacaaagcataaaaatgaataaattatcaaaagaggaaggaaaaaataagaggagggacaaagcataaaaatgaataaattatcaaaagaatgggggggggtaaagcaacaaaagaagaagcgatcagataaataaagaaaaacagcaatgagaagagaccagagcggaaaagcgaatcgaataaaagaaaaatcagccaccaaaatgtgaagccatcggcgacgaccgatgttacgaatgtcgagcaactcgctgatcacctgatccaacaaatgatcaaacactcccaattatgccaaaaattggagtttgaattttcgttaaaaagagacctgaaaaagtgccattccgtagaccaacggctcggaaatcattcgaagctaaaaacaaatgagcaattcgcatttttgtttttttttattcttgggttaactgtgccctcaacgccgaacatgccgtacttccacagatgacacctcggctggtcaaagtacaaattgtctaagcaataagaaccaattagctgacaaattgcaagattagcccattttacgcttaaacaatcaaattaaatatttcataccggtcatagtttgtatttaattcaagaaaggatgaagccactagcaaagccttaaatttaacaaaacctactgaaaattccgaatgatccatcattttgggtgatcattctgtcgctgatcagagtcaacgcatttgtgctggcatcaaccgccttgtgattatcaaatgctaatttgctaattgggtgctcattactcacttggcccgtccacgaaacatttccttcagtgattacccaagtggtggcggaaaagggacgactcataaaagcgacgaaagagacgatgtagaaaatgcaaaagccgaacagagaaatgaaccaactgatcagagacaaagggagaggggaagggtacggtaatggaccaacagaggaagagtacggtaatattggcgcaccgttttttagcgaaagctgaaagaagtgaaatgaggtttatttatacatttgactatccgatcagaatgaccgatcggtgggcaatgagtaggggggggggtgggagaatctcgactcgactttcgacatttttcggctttttgggtctctgtaaaactcttttctcgcacacccctagcagtgagtgagtaattaatgaacaaatgatttagtgaccttcccattttgcctcaagcaaatcctccaacagtccgtccaacagttccaaatgtttcgtgctctcaaatgaattgcgcattgtcaggccatcatcattttccgtgttgt

SEQ ID NO: 32392 - DNA, 1457 bp, Heterodera glycines
  misc_feature (26)..(26): n is a, c, g, or t
  misc_feature (118)..(118): n is a, c, g, or t
  misc_feature (185)..(185): n is a, c, g, or t
cccccccccccccccccgcccccccncattgactcatcatttcttatccctctttttgtgcacttttattctttgacattttatgtatgtcggaattgtttattgtgagtgaacaatntagtaaaatgcttgaaaagatcaaagagtgatggcgaagaatgcgtcagaaacagaaacgttattgnaaaggattttaaaatttgtattgtataaatcttttgttttttatcggaacaggacggttcggtgcagcccaagttttggactacaacttttgtcgttgttggccaaatctaacaatcttggtatcattcgaaagcgtggtgagtcattccacaaaaaagctcagtgtgggcgatccacaaaaaagctcagtgattgattggtcattttccggaagcctatcgcaccactttcggggcaccaaaagtgcctgatccggaacccggaccggcccggttaagaacaattttctcccaggccgggtccggttcttgatccattcacttgaagcccgtcatgggtcgggcacatctgccggaggaccctcagcctcgcccccgaccctgtcgatggccaacccaagctaagcttgccggtaccagcgccttttttgtacagctcgatgagctctacaaaatggtatcaatggcgtcaggctatgtctactacaaatggagaaaattggcgagaagtgatgtcaaaaattaaaaaatttgaaaatgacttgcgtcccgccgtacattagtattaaccggacggcaccgtgttttgtgaattgaataattaaatttatttatttaattttatcgatcactgagcttttttgtggaacgacctagcaccattcgaaagcccttcacaagctctattagccttacaaaaaaacaaaaaattttagcttgtaaaaaagttattaagaaaaaactttcaaaattttgttttttttgttatttcactaagcaataggttagaaaaagcttcgaaacatataaagctttcgaatgataccaagattgttagatttggtcaacaatgaaaaaagtgttgtccaaaacttgggctggcaccgaaacggcgggcaccaaaccggttttttattaatctcaaaaatgcttttagttttcgtaggtttaatcttttgctgttgtaactaattgctcttgatttttgcattttttccggttcgttaagaaaggaactacttcgttttgggtcagtgtgccgtttttatttgctttcgtcgtttaaagtccaatgaaatcatgttcctcatcggcaagtacttgttcgacaggtgacacaagcagtaacacagaggcagcagaaggcacgtttttttcaccaattttgatttacgctattttttgaggtaataatagtatggtttacagctcccacaaaaaaagaggcaaaaagggggttttatgcaattcttcaaagtcctttatggttct

SEQ ID NO: 32393 - DNA, 1321 bp, Heterodera glycines
taggtttaaaagtttgacccggaataggtttaaaatctttgacccggaatttgtttaaaaagttggacccggaataggtttaaaaagttggacccggaataggtttaaaaagttggacccagaataggtttaaaaaggtggacccggaataggtttataaagttggatccggaataggtttaaaaagtttgacccggaatagggttccttgtttgacccggaataggtgtaagaagttggacccggaacaggcttaaatagttggacgcggaataggattaaaaagttggacacgaaaatacgctaaaaatgtgtgaccaaatccggacttttacgagttgcccatataaagatttttgattatatctgcgaaacaaatcgaattatttaagtgataaattatgtatcatatcgcaaccattaactatttatatatgagataaaatgcgataataataagcattattcaaaactaccttataacttagctaaaattaaatatggcctaatctgttttatgaaaatcctagttgcgttttccatcggtaaattgcgctatgactatcacccaattttcgcgtaatcattttttgaagtggtctggtgggcttctggtagaatgtgctcgtgaatttttctattattatttcacattttgcaattaccgtattttctctttttataaacaaagtgggataaatggagaaggggggattatttttcgacagatttattttgtataaaatttttgatattttttagaacatgtcgccaaaaaatgtcatcgagtcaaagaaaaatcatttttaattgcattttttaaaataaattctgctttttctattttttaactatctataatgcacaaaaaatacattctttttcaaaaaattttgttttagcgccactttcatcactgggaagggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgaagagctatcgaatgatatcaaaaatttttaatttggttgatcaggaaaaaagttatttgaatcggcgccgaaatggccggcaccgaagtgggcggttcccactgggaatcggt

SEQ ID NO: 32394 - DNA, 1339 bp, Heterodera glycines
aaacgaaacaccataataaaactaaataaaatagaaccacataatgtggagaagtggactcatttcttggggaattgaggattggaaaaggcttttatcgcttgtcaattgaacatttcaaatgcacattctttcgctttcccgtcttttggccctccgttcgtccgatcagtttggtggcaatgcattggcgattagttcccgcgcggcaggcgctatcgaatcggggaagcgcacgtcaaactccaccaccaagtcgccgcgtttgcccgtcttagggttcggaatgccacgatcgtggattctggaaaaaggaaataatgataagggaaagtatacgtgtcctttttaaaaacaaaagaaatttttcgaaaaatggggggggggaaaactccactattaattgtattcatctcataagggcgctgcaaagtaaacaaaatttgtccacctttttacatttacctaagtccataaattcagtaaaatttatcaaaacgcttgtttgtcagttaattacctgggccgtctacattttcaatttaaacttttttatgtcgatacataattttttccaagattccttttttcaacacttttaaagaagttacctttaaaaaacttgagaaacctataaatgtatttttatttttttggtctgttttttgtttgtttttgggagtttttgttattttgaaatgataggaaattaagttcacatacatcgagctcgaaattagccaaattccttgatagaaatccaaatgaaacccaccgttgtgtgctgccaggtttggtcacgtgcttgatgttcaacggaatgatgtcaccctccaaagttggcacttttatggacatgccgcaaagtgcgtctcgcaatggaaccacttgtttatacctttttaatgatacaaattaatcttgggaatgttcctccaaaatgctaccgaatgtctgagccatcccttctgaatttggggtgcggtttgtctttgatgacaaaagtgatgtctgctggcatacggttggggaacacgtcgccctctttggggaaagtgatgcgggtgccgctcttccagcccggcttcacatttatcgtcaaaactttgtcctccgtccgcgacgtgccgtcaggattcacaattttcctggaattttagtaaattaagggacaggcattcagtggagccaataataggtataaaattaatgttaaaagtatttcacaattttcttgtaaaccttagttcttgtatggttttttggcatttatttatggccctctctgctatggcaaatgccttcaaaaatattttgctaaactcctaactgtgagtaa

SEQ ID NO: 32395 - DNA, 1447 bp, Heterodera glycines
tcagaaaaaaatttttgtttattgcgcaccattttatccttcctacgaaaaatatttgtttaaaaaaccgaaattagaaccttggtacgtttttaataatttgtgaataagaatgtaaaaaagagggctgcaaaaaatatgcacgaaaaataatctaaatattcgcatagatatgcaaatagtcgtgaaacatccaccaaatatgcacaaaacttgaaaattaggaatgcaaattaattcaaaaaaattttccgcattattttatcggttgtttttttttcttaaggattttcaaatcggaaaatatttgactaaagtggtaaaaaatgtaaaaatctgaaaatatgcacaaaaaatggcaaaatatgcagaaaatccaaaaatatacaaaatatgcataaaacccaaaatatgcaaataaaaatcccatccttatacgcaaacataaaaaagaagtgtttttcctactatttagagcattgagaagccaggaaaaaaatcaataagtatacttttacagtcctgctaataaataaagaaaggggagggagtaaacaaaacaacaaaatcgacaaaaaaatcattgcagtaaagaaaaaaaattgtttttacgggacaaatcaaatttttcacgaattgtctgaaccgagcgaatcctagtagggcatcaattaaattaaaaaaatgtgacttaatattaaaaaaatgaactattaaataaccactaaaattactatttaaatgattttgaataaattggaaatcattacaataattgaaaaatcaaaccggtgtaaaccccttccatcacaaagaaaatttggcagcaaacctagcaaactgatcaagaaataaatatttcagagtgatttaaacaataagaaacagaaaaattagtttttttttggttattcgtgacaattatcgttttgccaaatttttggttaaaatgatgccaaatcgagaaaagcttttgtttgatcgcataaattatgattaacgcgtaaaagttgattgaagacaaaaccgtaggagaaacacaaaccatcctaataaaatccaaattaatcagaaaaagctttttaaatatatttgtgattagaatttaaaaaaatctttttagtgtacacaaataatgaatttttttatttatacacacttgaaagatcattaaaaatttgcaaataattttgttaaagcaagcggaatatacacctaatttaattgctttatttttgtcattcggaataataagaaagaacgtaaaaaaataaagaaatcgaatttacgggattgattatttcataactgttattgcttttttgtttgtcaaaactaataacaacaacaattctcttttcccccctttaattctcaagttttcgcttcaaaaaataatccatttaaaatgtgatatacggagtcacacatcaaattagtatagtta

SEQ ID NO: 32396 - DNA, 1480 bp, Heterodera glycines
gtaggcgccgttcggtcgattacgacacgacagagacgggggcggatggtcgccttttgattaatgcgggaaagcccgactcggacccggaagtatttgtggcagaacatctcacaaatgttcttcagcctcatcaaattggcggtgtcaagtttatgtaaggggttgagagaaaaggcacagaaatatgtggcatttaaagcgagtcagcttttgctttcttaaccaataccaaggtttaccaaaaaatcgttactcgattcggcacttttgctgtttagggccccaaaaaaagttcaaaggagcgacccttttgtagagatttggaattggttgaaatagcggtatttatcccttttgtgacaccctctaaattttttttctacgataattataggctctgaaaaggaatctgatccatgcattttacgtgagaacatgaaaatgcgtgttaatttaaaataaatttcttgttcgttttcagcgcaaaaaattaccctaaaaaaatttaaaaaaacttccgaaagggattcttgtttttatttttgttcttagaagcaaaggcttttctgaaattggctctcgttaaggtacgacaacatcatcgaatcgcttgaaacgttccacaagtctgcagggttcggatgcattttggcccatagtatgggtcttggcaaatcaatccaagcgatcacttttctcgaaattttgtttgttgaaggacctaaaccttcgatatatattttttgttttagcattcgaattaccggcaaaaggcacgtgttgcttatttgtccagtgaacgttctgcaaaattggcacaacgaattcaaccgatggatgccagaaactgacgcggagacggcgcggcccattcggcactttgaactgtttgtcattggtgactcagtgaaaacattggaaaacagagcgcaaatgatcggtgcgtaggaaaataaataacattcattttaaaattatttattcagagaattggtatcagtcggggggcgtccttctgctgggctatgaaatgtttcgtcttctcgtccaccaatgtgaacttttgggcgaaaagagtgcgcaacggaaaaaggcatccaaaaagcaaccgttgcggacgatgtacgatttggcggacgatttgggcaaaaccaacgagcaggaaaaggcacaaatgacgcagaaggacgaattgcagaggaacatccgccaggctttgttaagcccgggccccgacttggtcatttgcgacgagggacaccgtatcaaaaacctgaacactgaagtgtcatgtgcactctccgcaatcaacacaaagtaccaggaaagggcatttttgaggaatttaaaccaaacacaaaaggcgccgcattgtgctgacgggctacccaatccaaaacaatctgacggaatacttttgcatggtcgaattcgtccgtccatgctatttgggaagcaaaaaggactttcaactgat

SEQ ID NO: 32397 - DNA, 2121 bp, Heterodera glycines
  misc_feature (51)..(52): n is a, c, g, or t
  misc_feature (100)..(100): n is a, c, g, or t
  misc_feature (105)..(105): n is a, c, g, or t
  misc_feature (114)..(114): n is a, c, g, or t
  misc_feature (130)..(130): n is a, c, g, or t
  misc_feature (167)..(167): n is a, c, g, or t
  misc_feature (2021)..(2021): n is a, c, g, or t
  misc_feature (2043)..(2043): n is a, c, g, or t
tttatatgatattaatataattatatctaaatgtgttatgggattatgcgnntaataatgattttttaaataaaaggattaaataaataattatacagtntaatntaacatatnttataaaaatgtattntaaccatttatttttttatttattggtttgctatatntcataaaaatttggcccaaagaggaaaaattgtcagtataatattatttgttgtttttataaatccatattcattaattattttgttagtagtttttttttcctattttttaacatgcaaaaataattataaaggtatttttccgaaattgtttattttcttctttgtcttttaattgctccattcaaattttttattaaaattactaatgattattatgttgctttagtttatgctaattaaaaataaaatcggtttattaaaaattaaaaattaaattttttaaagtttggtttttttttgtttatgaattctttggcattcgttatttttcatcttttaaatctcatgattccgagcctcatgaagatttacaaaataattaattttttgaatttttatggcataatgtcattattttatcaaggaaaaataaggtttgtggcaaagttgtcatttttttacagaaatctgttaacaattcgcattaacaattacaatgtttttccggtggagcctaacggcaccgccggaccctatcccctcgcccatttcccaagtttcttaaaaaatgcgccgcaaaaaaattgttaaaattttaatttgttgaatgcactaaaatttacgatttactaatttcctcccaaatcggaagcaaaaaatataatatttaaacagctttattataaataactcatgcttttttgttgtacgtaagctatttatattcttaaatatttaaattatttgtgttttttttttgtttagcataataaataacactctcgaatttattacaatatattatattcgtttattaagtttttttatactgaatttataataataaaattaaaatttctatttttgggtaaatatgttaataaatttatattaatatttttaaattccagtgccaaattatttttattttttatctctaagaaaacacttaaacataactaataattgagttttttaataatataacttaaatctgtccagagtttatgaacacattttgaataacttttaaatttttcatattatttcaaaccaaaaattaatcatttttaatatttaattattataagaaataataaaatatccttttatttttatttttgaatgaaaaattttctctatttttctttttttaataacataactcatgcttccattttcactatttgttttgattaagttttttcatataaatttgattagtttttttatattattttcattttttttaatgttttagttattttgactcactttcggtataattttaaattcatttcaatcatttttagattatttaagttgaaatttgtgcataattctataaaaaataattcacatcttttgattgagttttttttaaactcctttttggctcgattaatatctcagttttattttctctaatttcgagtattgaatttttaaaataatggtttttatgaagatataaaaagaaaaatagtcaaattaatttttggccaattactatttttaataaaaataatattcaaaataagttttaatttatgtattattctttttttattaaatctcattttttattgtagtattttaatgtattaataaatgttaagaatattttcttagatgttgaaaataataattaattaattttaaaatttgtttttatttttaaattctgtagttcatccccaatgcgaacaacattttcattttttctatattattttgaaataaaataaataaatctcaaatattttatctgttcaatccctctttactggtatgaaatttactttattatttgttaaattttcaaaagagcataataaatattttttttanataattaattatttttcattanattgatgattggatttgttaactaatttggcctaaataataatttttgcagttttgcaccaattcttacgaaaaatat

SEQ ID NO: 32398 - DNA, 1703 bp, Heterodera glycines
  misc_feature (28)..(28): n is a, c, g, or t
  misc_feature (75)..(75): n is a, c, g, or t
  misc_feature (85)..(85): n is a, c, g, or t
aaaaatttgggagtcccgacatcgagcngattaaattcatagatttctgcacttatggggggcgacgttttaaanatcattcccnggtgtgattggtctttctgaaccgggtctacaaaaattcttcatacccagattatgaaaacggagatgcttggataaaacgtcaggttctgcaccatcaaaagccgagtcaagaacgcaagtacatgaccgaggtataataattattcacttgtgctactatctaatcaataggttgaagtaaattatggcgtaaattaattaggtatatttcagatcatggaaacgagacatgcctacccattaccatgtgatttgttggcgagcactcacctggtcgagttttacaatgcacacacaccatctgacggattctttttgcgtttattagaacacgaaagtcaattgaaacacgtggaatcagaattgaggctagtaaaggctaatgaactttgaacagagtttacactacacttctgtccatttcacatctttcctctttttcaggcgatttgcccgatttccccgggaagaaagagaacgctatcgacttcacaagaatttcatctttgagggcacttgctgtttggtggttttcgaccacaatgtgttttcaacggacagaaacggtgaacataaattaatggaacgaacaaacgatttggtggtgtgcaaccgatgggtccgtcgttgtcaaattgttggccaaagtaacggaatggcaatggtaagtcaatgtacaagaacaagtaccggtcttaagttgctttaaatttttttcctgaattcagatttctttttgttcaggtccaatgcgtggattacccatacatcggacttgtcgatttgaagaatattttccaggtgacaattaaggtatgttccattaaactctgttttaatctcagattccgccttctctgctgggcatttaccaaaccggggtttatgccgttctcaaagactgtcaaatggcttctcaaattgaggtagcaagacatttatcacagtttcttttcacaacagtaatttgttagtgcgagcattggaggagagcggttgaggaattggggtcggaagattttcggttggtagcacgcttttttgagaaagcagcgcgaattgactacagcggacgcaaaagatttggaatttttaccgcgactgtttcggtaaataaatttggcgacgtctgccccgtcaggatgatcccggattggtgttgatccgaacttttttttgaattgttttcatgattcctcttttcatttgctcattttgataaatttatttttataaagccgtttttgcaaacttaggtgtcaataattgcttgctcgtaccattacgatgtttatttaacgatcatacgatctaataccatacaaccataccagacctctataattatattttgattcttagaatttccgcgcaaatgtcattttgttttagagatcgctgaaaaaaaaaactccgtgagcccggaaccgggattccccgtaaaaatcccataaatttttgacggggctccagatcccgccgtttctagtttaatttggagccccgacatttgcggcccagacatttgcggtccgacttttgcggtcccgacatttgcgcctatgtcccaaaatcggactcaaagttgaatttttgtctccccctgatagcctaat

SEQ ID NO: 32399 - DNA, 1051 bp, Heterodera glycines
aaaaaatggtgtaagtaaaaatcgtaattacgctcaaaaagcttctcaaacaatttaagcgcttccaattccttctacaatcgcctttataaactattgctccattttatacatcccattatgagcgctaaaattatcagagtgccgaaaatcgcatgtgatctaagcctagaaaaaaatgggtcaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaaaggtctaagtaaaaatcgtaattacgctcaaaaagcttctcaaacaattttagcgcttccaattcctttaaaagtcgccattatacatccccattatgagcgcctaaa

SEQ ID NO: 32400 - DNA, 991 bp, Heterodera glycines
gagcatgcacaaaattaggatattatggcatggcacttttgggtgacggaaaaaagggggacgggaccaaatttcgccgagacaaagtatcgccacagaaaatttttttttaatttcaaatttagaaatttttttaaatttctgaggcaagatttaaatacaaaaaaaaattggagaaataaaaacaaacctcgggtgatgccacctgggcccggtccgacctccacaacaaacgcatccgtcagatcaccggctctcctaaccatctgtttaataagaaaattgggaaaaagtcggaagaaacgcccgacagaataacaggcaacggtgggaaatgaggcacgacggaacgcattttaagcattttgcagatccattcgaagagatattaactcaaattgtggtatttatgcctccaaataattttggcgcgtagctttagcaattctacgcgcccgctgttgatttaaatttttttttaactttggccccaaaacggaaaagtaccgcaatttttaatgttgtatagaaaagacctctcacgacatatgcgcactttttcaatttccatacatttccatttagggtaataaaataatgtgatttctttgtttgctatttcgcatagacattgagttttaatgactatgtactgtatttgttgttttttttttgggttagacgagcaaatgttcaaaacttttatagtacgtttgatcgaaaaatcccaaaattcattttcaaaaatctgggccaatgtgattgactggcctagatcgcaatcatgttcatatgtgcatgtcccgagattttgaacttgttttttgagggaatcaagaataacaaaaaaaaaaaaatttggagcgcaatgccaagactatccgaatcccggatccgaatttgaacaaaaagttatttttttccaaaaatacatttaatcggtaaaaaaaacgaatccaggtttttatttttgtttgtttattattgtcgg

SEQ ID NO: 32401 - DNA, 2115 bp, Heterodera glycines
  misc_feature (1891)..(1891): n is a, c, g, or t
  misc_feature (1919)..(1919): n is a, c, g, or t
  misc_feature (2032)..(2032): n is a, c, g, or t
gttgttaattttcattgtcagaaattttattatatcttttataaacctcaatgttttttaatttataatatgattttacataaattattttcaaattcttataaattttttatgcattcagaacactataaataaattatttttgaccttacatttctttcttcaataaatgaaatagtatagtatttgtaataatttgcagttattaaaaacaactatcttcatttattttaaataattaaatgatttaattaaaattaagggctaagttggaatcatttcattgttaagtgtttcatgtatatcattaaagcaactctatatgtttttctcatataatttccaccaaatgacgtcacattcattaaatttgtgaacatattgatgaattctcggcgatggtattaaaagatattctggtgtttttgtgtttgatatcttcataaacattatttttattcattcttttgttttataatagggcttctggaattcaataatttttcgtaacaaaatgcattgtgccataaattatttacttaataaattttagttgatagatgaatgaatcgttagattagagaaaattcaaattattaattgatgcgttctttggagtttttcccacttgattaattgttattttgttctttatggagcatattttaagcatattacttatttttgtaaattcgtatttggtggtagtctacagtgtgctagtcatagaagtaaaatagtttagaaattaaaatttttaattacattcatgtataccacctataagaaattgatggagaatttattttattttttactgaacaatattgatcatttttccatttgaatttgattttttccttgtttattccattaaatttttaaagaaatcataattgtataaaaggaataatatgtaaatgcaaaataatgttttattaaatcttttcagatatgaattaaagaacatagtgttttaaatttataaacaacttaattttatttcaaaacaaaatttaaaaaagttacgaaccggttgaaagatgtatgtataggcaggcatgcagcgaattgttgaaaaaacttcaacatggcgagatgcaaatattataaagaattaatttaaataatgttttttaattaataatttaaaaatgtagaaaaagtagaatataataaaaaataaatgacgaaaaattaaaacaaaaaataaaataaataaacagaaaaaataatagcatgttaaaactaaaaataagcgtttaaaaacaaatattgaattttttttaaattttatctataattatatataataattaacttcaattacaattactataaatatttctaaaagcacaatcattaaataattgaagcaaccacaaaacataaatcagcccttttatatattaataaaataatctttgaatacattgcatattgaagcatgaagaaatgtatacaaatgatattaaaatataaaattaaatattattaattaaaattatacaaattttacgatcgaagttgtactaaatataaaacaaagtcaatccaaataagtttcaaaatacttacaaaaaaaatataatttatttaaatgttttaaaataaaatatttaaatgaagcatttctcattttaagtattttctgcaatgttcgtgtgcgcgagtgcaaaatttgaaaaaaaaattttaagttctttttaatattacgaaaaaatcactttaaaaaagaaaaaaaagcaaaatgtattcatatatgattttttgaaattttcaatcaactgcccataacttttgttaaagtcaacagaattaaatattcttggtatcattcgataggactaggagttctctaggactaagatttctttattagctcacctanattcaaaaaatgtggtcaagtttgagcnaagttatggccaaaagtacacatgtggccaggttttcgaatattttgggcataactttttgaacctaacgaaattttttgaaatttgcagactaatagagggaggacacatangagtatcaactaatagcaagaaaataaaaaataaaataattttgccaaatgggccaaatatggactaaaaacacaaaaagggc

SEQ ID NO: 32402 - DNA, 1557 bp, Heterodera glycines
  misc_feature (1299)..(1299): n is a, c, g, or t
  misc_feature (1385)..(1386): n is a, c, g, or t
  misc_feature (1408)..(1408): n is a, c, g, or t
  misc_feature (1486)..(1486): n is a, c, g, or t
gagagatagcgcaatagagagaaagagggcgaggggcggagaggggagggagagagagagagagggacgagtcggagagagaggagagagagagatagagaaagagagagagagagattcaaaaaaagaaaatttcaaatacgaaaagtaaaaattaaaataaacaaaaaactttttaattcggtctttaaatttaattttaaacagatttatatctgttttaaaatttaaaatttgtttattttctcgtatttctctttctcgcgaagtccaaaagtattgaaaaattttcgcctgcttcttttattttacattttaatgttggaaataacctttttaagttaatcatttgaataaaaattttttttatgtttataaattttaaagaaatttatattgtacaaataatttataatttcttttatacaattcgtttttataaaataatattaatttattttccaattttgaaaaatattttattttctattatatgtattcatatattcagctgttctcagtttataataaattgcttttttattattcgattttctatgttatgccatattctccacatgaattaatttcgtgttttacaattttctctaaaattattctaactttattaaaatattcatattttaaatattgtttatttatatttataagttggaatttcgctatttttaatttatattaaactcttgcccttatcttttgactcatacggcctcgaatttttagcccgccactttaatgtgttttttatttgtaaattattttgaaaaatttattaatgggtataatttttattttagccttttcgcaaattgtgagtaatctgtttttctttatttttattatacgaatttaaatttattttatttctcgctttcattttatatttgtttttagtagtgttctcgctgatcgagtgtgatttattttcttgaataacgaatgtttgaataataaaattaaataaaattgagtaaaagaaaaaaaagtaatggaaatacgcccttgaatttagccaaaaaatgattatgttaattttgtcgaaaatgacagatcctgatagatttttcaaaattctccaaaaaaaaaaaattctcattcactcttgaaatttttttcttgttgttcatttcgggggaagaactacctggttagtaaaccaaaaatgaaaaagagaatttgtctgagctcaatgtcgggatttccaaaatattttatagggatttggccaatttggttggatcagtaaaaagaatttgttgaaaaccagttaataanactgaaacaggggtataataatggcattgctttaaactatccttaccaccccacatctatatataaattttcgtaatgtatgtcanncaagtaacaaaaatttaaatanagtattgacgcttgttttatttggatagaaagaataaaaaattaaaagacaagataatagaggagagagagatggaangagagagaagaggatgagagagagaaaaagaggagagagagaaagaggacagagagagaaaagagacagag

SEQ ID NO: 32403 - DNA, 1281 bp, Heterodera glycines
agagagagagagagagagaggaatagaaacaagagcccccgagaatgagagagagagagagagatagagaaatggtcagttttcgcacatttgctttttgtggccctaatgaggaccgtttggattatattgatccaaataaaaaaaaaaacaaacatatttggtcattcattcattccttctttcttttctttgcgtcactctgggccaattttttcaaattgtcgcggcgcacaaaaacacaaacttaacttttttttattcattaatattttcgattgtaaaaattaataaatttttacgaaatttattttttagatttttatttttaaatatctaattaatttttattttaacctttctttttccccataaattgctcaataattttcttctcttttttctctctttcctttttttcttttctcgcatttttttatcggcgagaattacgcgttgcacatccttctcataaatttgccgccttcgtccccctttcgcgcactttgtttgtgccaatttggcacaacctccaatcggggcattttctttgtccccttcctccaactcttcctccttttccttctcctttatactatccatccaaatgtcagaggtgtagtcgaaaaaaggtgtgaaatcggctaaaacgccatttattattatttttcaattgttattttaaattaatttaaattatttttaatatttatttaaatttatattttaatttaattatttgtatttaatggttttttatttttattttcttaataattatatacatttttgtaaatatttatttatttatttattttttactttttataaaagcgtttaaaacttcggatgaaagtctggggattttttccattttttgggatgcaacaggttgcgtagattcaacagaaacagtttgttgtgggagcgcattgccagtctgcacatgggcgctctcaagctggaacgggtgtgggtccggatcattatgtgcagcatgacgacggtgcgcggcgtccaccacctcgttgggagatgctgaacaatttattaattgtatacacgtaacatttgaaattgttggagaatacaaaaatagaaagcactataatgtttaatttttagtaaattattaggaggtcaatgtccagttattaatgacacatttcgaaatgctggcgaaacagggtcagacaccgaagcaagcggccctcggttcatgcactcttctgaatatcaaaaagtttaaacgtgtttttgtggatggaaagcttaccaaga

SEQ ID NO: 32404 - DNA, 1565 bp, Heterodera glycines
ttcagaacaccaacactttcaacaatccgcaattatttgaactcgaacaagcggccgccctcggcgttagtcgtgcgaaagacgtcgccaaaatattctctctgatgctttccggcgaactgatctcgccgaaatcgctgacgcggctgttaaaacctcaatttgttgaccggattgattacgtcatgatgatccccgtcagtcgtggcttcggctttatgtatgaaaagcacccgagaaaatcggtaaggaaaaaggagagggcatacgattggaagagaattttatattggacgctttctgtttatgcttaagggcaaatggctgtttggacacccgggatttggaggatcgacgctaatggtggacccggaggaggaattagtcatcgcttatgtgtgcaacgggatgaagacaggcaaatgacattccgttaaatagcactagctaattgagtggctattaaggcatgggcgaactgaccggcacttaccgacgactgcgcaacgcggcaatcgatgccgtcatggccatttccgaccaacgaccttcttaagccgaagagggcattcgcgcccattttcttcctacgatcgaaattcttaaagtcgaccggggacggcttttcataattcattttacgattacttttttgtatttgctaaacttttttcatttaatttctttacccatttatctgtcatcaaagcgttcgtttctcttttgtattaattctttttgtactgtgaaacatttatccgaacgataaaattttccaacattcatttgcctcctttttgatcactcctctcctccgttctgtcactccctttgcatctgtcgaaacgctcttccatgcgatcactcttctctcctccggttactcttccgtcctgtcacttttccatgcgatcactctcctctctctctctctctcttcacttccctttgtctctccaacttttgtttcctctcttcctttctctcctttcaccacatttgttggtgcccattgttcagtttgcgtttgtttttgcgtgccttcagcttttgcttgtccttcttctgcttgtaattcttcttcttctccctgtactgctcgtcatcgatgtgtccctgcgctctctgtgttttcagtcttctcagtttgtccttttgcttttgcttcttctgcttcgccttttgcattttgtcgctgtacctttgactctttccgtttactcttccgccgcttctacggctcctccgacaacaaaaacgcatattattgcccgaattccgttggaatagtttgcagtagaaaccagtgccacaatacgtcgaacttctcgaacattctgaaaatgtcggtttggcatttgggggaattctccccgccgatcggtccgttcgccacggcacggctcactttgagttgggctatcgcccgcggggcattgctccccctggtggagttgggcgcgtcctccctcctcctccccgtttctcttttcctccgctgtttcgtcttcgttttgcccgtggcattggctgatgaaaaaggcggcaaagacaatcagcaacag

SEQ ID NO: 32405 - DNA, 1156 bp, Heterodera glycines
catgtcctcactcttctttgacttggccggtgcactgcttttcattcgactcagcacgtcgatgcagaccaataaatatttataaccgtcgttatgctttttcaactggtcaaatatgcacaaatcgcactgccaattggtatggaagccacttggtatcgtctttagtctcgggaatcttttcctgatgggcttgtgaatcgtgtatgttttctgcttttttaggaatttattaacgtcatcggttgtaattttcgggtcaatctttttggcctcattaaaaattttttgaattccagcaaaacttgccggagattttaaattaaaataaattttcgataaaattttctctacagtcttgcccatattagtggtttgaagggtttcttctctcgcactatgccgggtgtttttatagattttattgcctttttccttccacgtccccacatgacttttgatttatcaaccatgtcttttactgttggatccttcagtaacctatctttgagaaattttgcaccccggggtgtttcatctttcttccctgcgagatacaacaaaacatctctataattactgttttcaatcggcaaattcatgttcgactgtacctttccggccgccgtaattttaaataaatctttgttttcctttacgtacctaaaaggaccgtttaaaagggtcgggtgtataatagttttgatcggaatgggtgtttttaatgtggatgttgtttggggctccggagttaactcatttattgtatcattatccgattccggatcaggagttttctcttcaagtcttttcccaggaataattattttccggggttcatcggtctcctgtagtttggattggttattgaggcccagatatggtgcaacgttcggaccgggtacatgattctcaatcactaccttctgtggtctattttcaagtatcccctttaccgtacgcctttctttatagagccaatcatgtctcttcgccttgatgtcctcgcttatgccggggtcttgtaaattctgagaaatttttgcgtctaaactcgctttttcattttggagataatcaccactattcatcgcactccgtagagccaaatattccgcctcgggaatcattaacattttctttacaaatttcatga

SEQ ID NO: 32406 - DNA, 1361 bp, Heterodera glycines
ctttaaatgaacgagttcgtgaactttgcagcaacccactgttgcgagtcgcaatgctacttgatcctcgatttgcttacacagaactgttttctcagcaaaattggagggttttcgaacagcaattaatcgaatttgcaaaagagagttggttgaattattagaatatttggtaattaaaatatgaatccctttagaattggtctgcccaacgatagaaatggacgataattttgatgtgaacaactttggtcaggttgaatcaggaattgaccgtacatttgctgatcaagaattgagtccaagcagcaacgagagcatagagaaatgtattgacgattgcatcacataaatactttattttctttttagatgatatctgggcccaacgaaaatcaccatgtggtatttctattccctcaacaatttccggagatcctgactctgattttttatcaaaaattgaggctgaacttgcttgttttaaggcaggccaaaggatggaagtgaacggagacttattttcctggtggaatgaaaacactggccgtcttcccgaattgtcaaaacttgcaagaatggtccacagcattcctgctacatcagtcagttctgaaagactgttctcaaaagctggacttatttttgccaattcacttcgaaataggtcagaaatcaataatgtattaatttattttataatttaaggctttccggcaatactgtgcgccaaattttgattgtgaaggccaatttggacgcacttttactggcaccaacaaatgaatatgaatcagatgaggaaagtaaagaaaaagacgatttttgagttttgaagactttatttactagcattgaaaaagaaaaattattattttttggttaaaatataaatttgatcatcccccgaccggggtccccgacccccgacaattgagctcccccccgacccgacccccgacatgtcgccccccgaggtccccgacccccgactttttgccccccgagggctcggggcttaaccctagtttattcaaaaacttacaaattttcatttttatgagctttttaaaaaatgaggttttaaggagtcgaaacaaagattttttccattatttaattattttaataatttatttcattttttaaattagttaattttacattttatttcttttttttctaattttttatgttattttaaacaattaaataattattttaattaaattaataaagtaccaaattaattaaagtgcttaattttattcatcattttggctcgaattttaatgattagcaattaaaatttcattattatatttcatagcaaatagataaaaaaaacagctaatcaacaa

SEQ ID NO: 32407 - DNA, 1184 bp, Heterodera glycines
  misc_feature (1174)..(1175): n is a, c, g, or t
aaatttgtttttggggtaaagtaaaaatgtacatgtggacgagatattcggcatcaaaacggttcaaattgattgaatttgtctgaccatcccgccatttggccttttgtttgtccgtccgtcgtccaattacgaagtggccggacagaatatataaaacaaatggggggggggggggggggtggagatggctaagcaaataatttttcttttaaattctcaatttcccttccgaaaaagttaaataaaaataaaaatatttactcaaagtctttccaagtctatgttttcgaaaatcgaccatataaaactacaaatgagaaaactagcttaaaagcagggttccaagatctgaggctttagcctcattttgtggttttttgataggtcaatgaggttaaattttcaaaatgaggctttttgtggttttttgagaaattttgataaattggcataatgtttttggccatatttgtcgacaaatctgttaacaaatcgtattaaaaatcacaaaatttttcccggcggcgcctatcggcaccgccggccccccttgttccccaaaagtttttttgaaaaaagcgccgcaaaaaaatcaacttcggtttttcatgcttagaatttcacaaaatgtttatttcgaacaaaaaattgcttaaattgatcatggatagggttgtaaattatatggactaaaaaacgcgaaatatggacattaaatatggactaaaaaagcccgaaatatggactaaaaaggacaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaagaagttgatctttaggggtgtatttttcattttttttttcatttttcttgtgaaaatttccaaaaaanntggcgacct

SEQ ID NO: 32408 - DNA, 1255 bp, Heterodera glycines
gacggaagggatgccgacgccgaaacgattggccgattggcatttcgggtcggtttgacaagtttttgtgcgagcgtgggtttatttttgccggattttatgcgatttccaataaaaatgcatttaaaaatgtatgactgaattaatatttgaattttgcttattgtagttactcttttaaaataaccaatttttagtggcattatgacatcactctgtccgcattatccaatcggaattatttgggctttttcgggcgagtgatcaatcggacgcgcggttggcccttttattgccccgagtcggactgtggaaatgttgcgaatgtgctttgaatatatattttttttttgctccaaattgttcattctgtcgccttctaattacccatttaggggtccatctattcgcttctgttgtacgacgcaatttacaattacggaatggcactgaacgaatctttccgccaatttggcattcgtcccgaagtgtatcgaaacggcactctgttggcgcagaacaacaggaagccattcatgggcaagaaataaaataaagccgcattttcattccatttgcttaaggtttgacgggctttgtgacggtggaaactagtcagaacacgcgggtgttcgttttgtccaatcggaagtcgagcgacaaaggaaatgcgctacgcattttaatgcaattcgcatgggtcgaggggaaattggtgagaaataaagaaaaacaacaataaaaaataagaaatgttaaaataaaacaaatgttttatgatgccatttattctccgccccgccgaattccttcgaatttttaaaaattgccgcgttaatgggaaatgaaaaaaagcgataattaaaactgttaccagtcaaaacagcttttatttttcaaatatgtaaaattctgtgctcagcaaatatcgttgcgaaatggcagcttgtccatgtggtcctcccgcggtggaagcattcctccggcggtgccaatctgcggcttcgacggcaaagggtgtgccgcgtcggtgttcgaaatgtataaagtacgaaatgttaaaaaattttttgatgataaattcttttttcagggctatttattgcttggaattgctctttttgtagtgacaataagcggtagcacttttactgtcggctttttgatacagtaaaacggaattaataaaataaacaaaaaaataaaaataaaattcagcgctaaatttgtggaaggtcggagaagcaacatgagt

SEQ ID NO: 32409 - DNA, 841 bp, Heterodera glycines
atctgatcgatggtgtgcaattatggcagtctaatagacgttcaaaaatctgaaaaaacaactaatttttggtaattttcttttattcattcgcttaaaaacactaaaatacagccgtaacatatggggggggggtttgaacccaactccattttgttgaccatctcacaggcaactgagacacataagcaatttttttttgtataccgaatggtatgttcagtaagcctccttgatgaaaaacggcttcaactcagcttcagtccatcgggattcgcggacgaaatcgtagagcttctcctgtaattatttaacatcagaaacaataaataaaagcatcagaataattggtccatttcaaatgtttggataaacacaaaacatgcctcgccaaataaggtgaccaacagcgcctgaattgaaacagattataacgcacaacaatttgttggaatacgtacccaactagccaagaaacggccaggattcgcgacgcagatctaaatagtaagacaattctttgtcgtccgacacatttcccattcattgtcagtcgacctgaatttgctccgcatagtacgcgggctgtaccggaccaattgcctcgttgaagcgccgcacgacctaagaaaataattagggaaaaacaaaaggatgttgcaccgaagtgggctgcggactcgtgggtaagctctctccacgcaaaagtttggccaccagtggattcatttgctggtcgtcactcgaagtcggcgggtccgttcgccttccatcacgtttgtcccagcgtttctgcattgattgtctcccgtaaagcttgttgcgcgatatctttcttctt

SEQ ID NO: 32410 - DNA, 974 bp, Heterodera glycines
cccccccccccccccccgcatcgtttctcctccgagaaattaaagaaaaaacttttatttgagaaaccaagaaaaaatcataaaattttatcttgagttactaagattttcaaaaaaaaattttccagaaaatcgctgaaggttttcgaaatttttttttggaattattttataaaaaaattttttctaacattaagatagttttcttgaagaatttaagttttaaaccttggctcgatcggttctgggttcgcttcccattggctgcgcaatgtttttacatgatttttttatgcccgtcaaaaatacaaaataaaaggaatttattttttggccctcttgggcattaattaatttacattttgaaaaccttattaaccatccattcaaccaacagcagtgacagcgagcggtgccgtcgtctccgctggcggtggcacgccgcgcatcgttgtgccgaccagtctgagaggcgctgtttggtagacggggggatgccgtgtccatccgacggacagactgactgatcaatcaattctcctctgatcgatcggttgattgatggatggcattggcacttcatccctccttcccccatcctacaccaccatcacactataaacattaatgaccgcagcaccaccaccaccgttccgttaatcactgttgtttttgctgtttttttttgtgaatttttgacacatcgccacaccaaagaatatttgaacggacaaatcgcccgccaatctctcccccatttaaatgtgccgttgttgttttgttttgttgttgttgttccattattgttgttgttgttgttttgtttttcaccttaaatttgttgttttaagcccttttgccataattcccatggacattttatttttcacacaattttgttggaattaggaaaaaaattataattttccttggaatttggcatatatttaaaagcaaaaaaataaaataaaaaa

SEQ ID NO: 32411 - DNA, 1712 bp, Heterodera glycines
  misc_feature (1689)..(1689): n is a, c, g, or t
  misc_feature (1696)..(1696): n is a, c, g, or t
gtctctcccccttcattctctcccctcctctctagccatctctcccccccttttccccccaattccccgcccccggggggttaagatgaaatggtcgagaatgactgagcaaattgtgcatgcattttttggccgtttgattgtttatttttgtttgttattttctgttgtcgttgcgttgccctttccctttttgggagagaaaacgcgcaaagggaccaaacaccgaagaaaaggccccccagggcagaaaagttaattgccaaatcgctctcccatgcccccccccctccccccattttcgcattccctgcgcattttccaattttatttggtctcgtcccaatcgatttgattccccaacattttgccatgacaaataaataaataaaataatcaaacaataatttggcattggacacaaaaatattaggctaataggattatcataaaataatataataattttcattagtccaatagattaaacacaaaactctctcttccgttttcaatgtggggaggttacggtggtggttactacgacggctatggctacggtgggtactacggttcacaggcgagtgacattggcatttttgaagataaaaattagggaaaagtgccatttcgataataattaaataacatttaaataatttgataagtaattagaagtgttcgttttttcattccccaatttccattttcagatcattttggtcgtcgttctgctgatcgtcggctgtctctttctcacttgcgttgtcgccggcctttggctgctttattcagttcgaataaaatattttatcaaaaaaataattttaaattaaatttaaatttaaaaaatattttcgcgcagagacaacagaaagaaaggggcgaagtgcggcaacaacagcagtattacccccaatattacactcgcaacggcggaccatacgcaaccaaagaattgagcacagaatttccctaaaaatggcattgatcagtcgccacaattggcattttaatcggacaaatgaaggcgcaaaaaaattgaaaattcaaaaaaaaattagcaagaaatgcgcatttattgaacgacaatgaatttagcatatcattaatatgtacatacatataattttatctgatcaacaaccctcgtcaactaacggatcacttgccttttaattttaacagtttataattgcccaagccggtgctaacagaaaatcgacagttttggcttgacacaaaaatttaaaattatgaaagttgaattttagtgaatttctgtaaggacgaaaacttaacgtcggatgtcatggcctactaaattcttttaaatatgattttgattttttgatggctgagttggaattggacctgaattcctatttatcctgaacctgtattttctggacaaaattttggtaaagagagaaacgaagaattcctgggccagaccctgtctcagacccaaatcgatcaaattaaacgagaaaaacaaatgaaacgggaatgatttccttcagagttaatctcccataacaatcggatgatttcatccgtaatataagcatcgattgctatcagattattattcatgtccaaaaaagaagcattttaagtcccgcagaagttcttttgccccgcattttgtcgccgtcaaatggtttcagtgctgtctgtcgcccatcncgtccanagaccgccgaattgac

SEQ ID NO: 32412 - DNA, 964 bp, Heterodera glycines
ctagtcagcaatcgttgcttaactgtccagatcggacgggttagagcactttctgaaaaaaatatttatgaaacaaaaaaatcgatttttcaagtgtccgtttggggtactcaaacattatcggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaatcgattttttctagtgtccgtttggggtactcaaacaattatggggagcagaaatccaacgcaga

SEQ ID NO: 32413 - DNA, 926 bp, Heterodera glycines
ctttgtataagtctcacactttcagctccttatcctcttaaaataaactgtatcagtgttgcggaaggatcgagttgattgatggaatcgagtccaatttaaaaattaccatttgcaagtggatatagatatatttagaggataatagctgaaattttgaaaatgacaaaaaggagaatataaaaataatattaaggatatgattagcgctatcaactcaatgatttccacaacactgatgcagtttatatttagatgataacgagctgaaattttctgaatttcacaagggtgatagagaaaataataaatctgagaatattattaacaagccccttctacaacactgatgcagtttatatttagagattaagtagcggaaattgtgagattctctatttactattttcatggcaatttcagaactttatggcataaatataaattgaatcggcgttgcagaaggatagagttataagcgctaattatctttcatttaattatttctaatagcaactttgtataagtctcacactttcagctccttatcctcttaaaataaactgtatcagtgttgcggaaggatcgagttgatacacgctaataatctccgatttacaatttctttaagcaaatttatatagatatatttagaggataatagctgaaattttgagaatttcaaaagggagatcgtgaaaataataaaccgggtatgattagcgctatcaactcgatatttccacaacactgatgcagtttatatttagatgataacgagctgaaattttctgaatttcacaagggtgatagagaaaataataaatctgagaatattattaacaagccccttctacaatactgatgcattttatatttagagattaagtagcggaaattgtgagattctctatttactattttca

SEQ ID NO: 32414 - DNA, 651 bp, Heterodera glycines
tctagatgtcttttcaaaatggtctgttgcgtccaagtagtaccgggctaacctcacccccgaaccctgaaaatttcctgcgctcaaacgtggaagtgctgaaggcggaagccgaacgaaacggccgatgagtgccgtaggcggcggcgtccattacggaaagtctgcgctggtgttcccgatggtgatgaccaaaatggggtgggaggatttacgggattcggtcaattaattcgccctcccctccgccaatgctttgttatttgtacatggctgacaacaacggattgttcatccgccgattgcttttggccatcgtcgacgattccttccgcgcggcccaattgaccaaagagaattccaaaagagcggctaacaaaagcggagactggtcaaaataaaggcaccaaaaagaaaccgaagatgaagccggtgcaaacgccgatccaaatgtcaacactctgagggggagaagaagcattggcacaattgggggcaaaatgaaagaagggcaaaaccaaaggatgtctcactttggtgtaactgacgggcggaagtttggcatttatgccggaggcctaaaaaagtcggaggaatgaaagaaagaaaagaaaaaacgccaaaaaaaagaagaagagaaaccatcgtagt

SEQ ID NO: 32415 - DNA, 1235 bp, Heterodera glycines
tcagtcgcgcgactgcggacgacgccaatttttgtgctgtgcgaacgggtggtgcgattgggcgggagagtgcggggtaaaaaatgaaaaagaaaagccgaaaatggggggggggtaaggacaaatgagcacaattcggacattttctgcgcttcacagatggccaaattctgtttgccgagctgtgagatgaccaaactcgcccatttgtccgagctcagccccgagggaatgccgcgcatcgatttgctatacgactgacaaatgagcagcaaatggggggggggcgaggagacggcacttcgagagtcaataattcattcgcccactctcgacctcattaacggcgcggctttgcttttgttcttcgaatgtcaaaagaatgaacgaaaaaagcgatggcataaaacttaaaagacaaattaaaaaattcgttgttttaatttttattcctcattttaatgaaattggtgtacatttttcgcattttcaaatttcctcctcccattcgtccccctcttcttcttcctcctcttttcccttctcctcgtcgtccatttgctcctcaatttcgttgttcgtttcctcacggccaccggcggacggagagccttaaaaaattcaaattttcaaaaagattataattttgacgaatggaaactcgattatgttggacaataatgacttcatttgcacttacgtcccaagtccggcactccgccgaccgcgccactttcaatgccgcactcgtcggagccacgcaaaatgcggaagaatccgtcctcgccccagtccgtgttctttaatttcagtatttgcgatcaaataatcggccaatagtggctttggcatcctcatcctccccctttgctcggcactttcggcattccatggcatttttatacccaaaattttttgattacaaaatgcgttggcattggcaccgctaaaagtgtaggggtcctatttttccacatgccctaccccaaagtgatggcattggcaccccctcccgtccccctttccccggtcccttctctacccatgagttggcaaccagccaatacggaatgccattgtccgcgccccatccgagcagtttcaccgcgtggcccccgcccaattttccggcgacatgctgagaaagacggaaattacagaaaggtggcaaaataaatcacgtagtaaacgccgcccttgtagttcagaaagtcctcatacacttcgaatgccac

SEQ ID NO: 32416 - DNA, 638 bp, Heterodera glycines
gtttcgtacgaaaaacctttatttcgttttcgtgtttcgttcgccaaaattttttcaatgtcatccatggtgaacgacgcctacgttccgcaatcaacgtggtttctgctcatcacatcccatccggtcgcattccctgaatttgacccgctttttccgaacaaaaaaccaaatccaaacaaacatgattccttccatctttaaaggccaaaccgccaggagtacaggttttaaaaatgtacaaatttatgattattttaaaaaatgacaattcttttccgcatatttagaaaactctgatttttgaaagtatttcgaaatttataattttaaaattgaccaaatacagttaaaaaggtgctaaccatttgaaaaccattcccaaaaatccggtctgggtcgttttcgccttgtcattttcgcgtggggacgttttcgcgtggctggggcacgttttctcgtggccgttttcgcgtggggtaccttttcgcgtgagtacctgattaggactgaaattgggcgaatttgtgctaaacatccatgtttcgaatcccgaatctgaatgcggacaattttcttgactttttatattctgtatttaatgcagctagtatctactagaataattagtgagtttg

SEQ ID NO: 32417 - DNA, 901 bp, Heterodera glycines
ttttgacttagagaataagtgcaaaaataacaagaacccccctactttaatccctttttagtgcatatttaaattaatatactgaaaactgttaattagataataatttaaatatgagcaaatttatttgattattttactaaataagtcgcaaacataagcttcggaacaataatctttatatttctttaaaaaatatatctcagttacttattttttttaatttatttatttaattaattattatttttgtattgcttttttaaattaattaatttatgagaataaaaaatgttttactttgtttttttggtctcataatctcatggccattgggactattaccattaaaatttttttaacgatttaataaattaagttttatctattggcaattttaatgcttttcttactatttaatgttgctcaacttatgatttatttttccatttttaaatattattgtaagaaataagttttggtttgaagcttaagcggatattaccttttctttgtaaaacttatttgacattttttgaatccaattttttgtcgtttatctatcattttagttgttttttataaaaatttattgggaattcttaaagaaatttccgttgtatctctgtttataaaaatatacttaaaaaaaaattaatgataaaaataatgattttaatgtttgaattattattatttttctttttaaaattaaagaaatcttttataaatatttaatcattactttaaattagagtgccacgggaccaggacctggtagcggacaactgagtacaactgagtaccaaggtcccggttttgaccgggaccgggactagtcccggttttttcccggttttcccagctaaaaattcccggttttttcacccgaaaaggtccc

SEQ ID NO: 32418 - DNA, 1327 bp, Heterodera glycines
  misc_feature (45)..(45): n is a, c, g, or t
  misc_feature (69)..(69): n is a, c, g, or t
atttgatcgctgttttaatgccgcttacatgacatcggctcccanttggggtttgtgcaaccatattgnaccggtcaaatgaggccgatgttgttgctgacttcagtgggaatggtcattgtcatgcttctgatgggtccgtcgccgctgctcggcttgcccaagttggttgtgaaattataattttaatgaagatacggataacgacggacttgtcgagattcccgagctagacaggacctaattacggatttggtcaggaaacccatagagacgccggctcaatagattattcgcaattgaaacctaatcaaattacagtttaatgataaccgccgtagcctttgcattgcttggcattgttgctggtgctgcctatgtgcccttgtttaaatggtgcgtcgacgctgcaaagtctgtgccgtgttggacggagtgaatcatatagcgtaattgtcccaattaagcaacgcgggattggacggcacatcgtctgccatttgcgggtgtatctccggattcatacagtcggcacttgccctcaggtgtgacgacgggaaatttttgctttcattatctttaatgacaagtcaaagatgctgaccccagtctttatctccaactgtttagtgctttcttggccacaagtgtcgggggactgagtgcccagcatttgggcctcccgtggacggcgacactcgtggcagccattcaattggcattcgtaagtcgtgccaatttcgggttgaactcggattacactagcctgggatttcggaagtctgaagagactggcctcggtttgaaatcaccctattttccaaaaaaacccatgcccctcggtaactcttaggttaggttgtaatattctaaaaagttttttcattatttgcttcgtcagatcgccgtccaaattttctattggcttctaatgagagttcggcgcgaaaggattcattacatccaattgcttaattagtccattaattatcatctttcattagtttttttcgcacaaagagatataattgaataaatattgtttgcagacttttacggggtattcatatagtacaacctggaccttgatccaccaggtccagacatgaacaaactggatttcctgaattatattttagaatttgttattttgaatgactatcttttaagttaaccaaatgattaaatagcttttaaaacattaaataggttttaaaacatattattattgtcaattagcaattagatgtttttaggtgttcctaagtaattaattgatttttcaaacatttgtttgctattttaaacaaatttcaaaaaaatccag

SEQ ID NO: 32419 - DNA, 1442 bp, Heterodera glycines
ttttttttgtaatgttttataagaacaattgcactgttcatcgtcacaatatgctttgagctgtgcctgaattttctgcccgctttggtcagcattggcttcaaatatgtgagtactataagggttgagcgccagcggcggacggttaaaacgcttcaaagcggaggcataacggctctaggaaaatccgacaccggaaaattcgacactggaaaatccgacacaacaccaactttaaatttaaaaaatattttttgattattgagttaatatctggctatgtttatcaagttttcgaattgaatttaaaaaaaaaaacggttgcgccattcgatgggatattgctggcaaataataaaagagttgtcgattgttgcgagtcgcataaatctctgtgagattcatgtcttgcaccacgtacactttcttatgcttcatgccctttcctctgattcgatttgccgcattttttacaatttattgagatgatcaaaaaagggcattgaaataaatataattattatatgcctaccctaaatagattttatagcaataaaatatttattttaaagaaatagtttttatagcaataaaaatattaattttaaagaacttaagtgtgttactattatcacatgttttttaaatattctttgcatccaccaatcattaaatattttttaaatttaaagtgggcgtcgtgtcgggttttccagtgtcagacttgccgatagtgtcggattttccggctcccggggggggggggggggggtaaacgtttaagtccactaaaaatcagtcaaatggataaaacaagtgtgcgtgcgcaagaaaagtgataattgaccatcattgagaacactcagccatttcggttgtgataggatttcgtcgttgccactttttgtcacattgccattgttgctaccggtcttcgtttgctcttccgaccgctgcgcgtttgtgttatttgtcagtgttgctgtgccgatggaattaattcccgtgtttagatgacgcaaaagtgccaattcagtgcgcaacctttagaaaaatatcattcacacatataaaaaaatatttgcattttttaacccattgataaaaggcaaaatgataactgacaacgggaagatattattattagagatcgacattttgaaaaaagcctgggtccaggacgatctctagatattactatactatcggtttatataaaaagtacgtacctttcaacagtttgcgtcagattggcgacttggccggcaaactttcgtttctgttcaaactgaatataaatttgggcacttttgctgtttatccaccctgaaaaaattcctaagggggattacacttttttaattattatttttttatcaaaagctgtaaactcttgttcatggggtttttggggtccctttcaaccaattccaaagcgtcca

SEQ ID NO: 32420 - DNA, 1129 bp, Heterodera glycines
tcattagccgagaaatgaaagaaaagccgagactgcctctagggcttggtcaacggatctgatcatgataatctgcctttatacatacgaacacctctgaccaatgtcagttatttattgctcattctccaaatattttttagttcccaatttcaatagagcccttttaatcataaattacattatgaggaaatacttttttggattcgttgcccttgaaagaaaaaagcagtatttattttacaatcattaaaaaacaagaacattaaatgcaaatttgtctatttttgagtgaagtgcgcaattagcagctcaaccctttgcttctgagtgtccgcctcggagtccaaataacggtgaaactcgcgcaaaatctgaaaatccaaaaccgcgtcacaaatgaaaaaaaaattgtagcgtcgaaataagtcagagaaggaggcaactgaccggctccaactgtttgccgaccgatccgtcgccgagtcgcaacctgaacagtttctccacccgttcgtggcacccgggcgctcctttgctgcaaatttcggctaaaatcagcgccgccctctgcaaagtgtacaatccgttgttcaacttctccaaataaagctgaaatcacagattataaacaaggacgaacaagagactaattataaggacattcgaaacccgaagagtgaaaaactgtacttgttcaattcgtcttttgaatattatcattatttacctcctcagtgtccggcttttcttcctcagccaatgaagccattcgacgctccatttttgtctcaaaccgtcgcactttctcactgaaatgtttttcttttcttattaattaaaattggatagaaaagtgcctgtatttgagaaacaattccacggctcggtcgatcttctcgaaacaatggtccacaaatttctgcaaaacgcgttggcaattcgtcggattgcacgaaaagagcaaagcgtccacgacggagcagcaaaactcctcatggtcttcatgcaaaattcaattttgccatcaatgatttacttttaccctctggcgatgtgtctttgcgcttcatttttggcggagttcacataaacagcggaaaaagcgtagaaagacctttgttaaaaa

SEQ ID NO: 32421 - DNA, 1230 bp, Heterodera glycines
ccataatatctttccataaggctgaaagcagaatttgaatgggcagtcgatattacactgagcacccgttgaagcgggtgatgggaaggcatagcaaactgtattttaaaattctggcagcaattctaccaaaaacggtgtttagaccgcagtaactcggctcagagtgaagattaagggacgcaaaagagacgatttaaagcgattcgaaaattctatcgactgatataataacgatgcagtcgcggcgttgacaactgagatggaaccaaaagttccataatatctttccataaggctggaaagccagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatgaccagtcgatatttacactgagcacccgttgaagcgggtgatgcgaagccatagcaaactgtatttttaaattctggccgcaattctaccaaaaacgtgtttagaccgcgagtaactcggctcagagtgaagattaagggacgcgaaaagagacgatttaaaagcgattcgaaaattctatcgactgatataataacgatgcggtcgcggtgttgacaactgagatggaaccgaaagttccgataatatctttccgtaaggctggaaaggcggaatttgaatggccggtcgatatttacactgagcacccgttgaagcgggtgatgcgaagccatagcaaactgtatttt

SEQ ID NO: 32422 - DNA, 1301 bp, Heterodera glycines
tcattcatttgggagtcgttcgcacggaaggccaaccttttgggaaacattgacgttccgattgtcagacaatttccgtgccggcttttcgaggtggcaaattgcttggctggtgagtgggtgccaaaaatttacacaatgccaaattgccacttttttacattttttgtaatcgttgccccaaaagtgcgtcaataaatcagaatttcttatatttttaaatttttaaatggaatttattttcttaatttatataatttttaaaattaaaagatatatatatatcaggggtgggataaattttcatgttttgaagggtaaacgatgctcaaattcgtattgatgagctcaatctgcattttgtgtaccgtttgggggtgatgccggataagcatttgctgatgtaagtctggcgtattgtttttattttcaaattaaattcaattaattaataaatgcccttttttatttaaacatttttttaattttaaggtattgccagaagaagttcgacatgctgtatgtttaaagagcaatgaatttttattttcccaatttataggaaattgaacatttgtaaattcaagccctcaaaaattttctttttaaaattttccaaaattattggcttaatcggtaaaagtttttgtcccaatttttaaacacagccttggggccaacttgctgtttgcccttaaattgaccatcgaatatggcgaacgaggaatcacccgcaggggcaaaattgccaaatttttaaccgaagaagaaattcggcgcgaaatggaggacacctactgaacaaacgaaagaaagaatgaataaatggacaaaagtgatcgatcagagtgtgtgaagagaaacagaaatcaaacaaataaacacatttggtgcaatttggaaataaatttgtccttattttttgaaaatattagaatttttctacaaatttgccggtgtgtctaacagttcatacaatggcgacaatttttttaaattttaattaaaaactagaaatttttcgtccagaatcagttttttttttctaaaaaaacgaaaatattttttgctaattttattgtttatttggtgattccctcctaaataaattgatcagcaacaaatatctgagtgaatttataccaccaggcatacatatacaatatacatctactaatataatggaatacacattgtatgaagaaatagaaaaaattatctaattttgcgattttggccatttttctattataaataggagtttttggggtccggcggtgcagataggcgacgtcggagaa

SEQ ID NO: 32423 - DNA, 1012 bp, Heterodera glycines
  misc_feature (12)..(12): n is a, c, g, or t
cagtgtccgttntggggtactcaaacaattaatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactagcatgtaaataaaatttggtgcgtttcagagcattttctgaaaaaaatatttatgaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaatatgagtgatcgaatttcactaaaaaagttaagcctacattttttggcatatttaaaagcaattaaaaattttttaaatttataatttcct

SEQ ID NO: 32424 - DNA, 1054 bp, Heterodera glycines
acggtaggggtcaactccgtctcgccaactccgtctgggccaactccgtcttggggccaactctgtctcagccaactccgtctggccaactccgtctggccaactccgtctcgccaactccgtcttggggccaactccgtctggccaactccatcttagtgcataaggggccaactccgtctcagacaaaaaaaaatatttaaaaatttttttcgacgaatttttcaaaaaatatacccctaagaaattaaaaattttctcaaaaattcatctgcaaatctatttatttattttcatgttctgatttttaaaattattcatcaaaatatcgctttggcttaattttgttacttttaaaaataaatttaccgttatcatttattagtatatacttacctaacagtttaaagtaccattaattttttagccttgcgaaaatggaaaatgctgaaattaaatctcaacgaaaaaataaaaaactcgaacatgaaggctgcctgtatgtcttccatttgttgaacgccgatggtgacgtaaaattttggcgctgtgaacatcagcacggcgaattcaaatgtcgagggcgcattcacacaacgctcaatgacgtcgttctgaagacaattggtatacacacgtgcaaccacagcgcggcaaatgtcgtcgcacaaaaaatcaccaccggcattaaactcacgtgagaattttttaaaattaatttttaaattctcaagacggccaaggcgatacaagctcgcctggccaagaaaagtgagttttttcaccatttttactcaaaattttttttttaatttcagccgctccacagctgaatcccaatgccgaaatgccaccgcaggacgaagcagggccgtcaacatctgctgcatcggccgaagaagcgatggagccaccaccaccaactccagcaccagtgccaacgccggagatggacgaggaaattttggaatttggcttttcgctgccatcgacatctgtcacacctatcggcgatttggtgccgttttcgacaacaccaactgcgccaatggac

SEQ ID NO: 32425 - DNA, 1231 bp, Heterodera glycines
ctgatcgccgtccaatacatcgaattgcaaaatattcaccttcctgaccaaagtcacggggtttgctgtgcccacaatccgatcactcactgtttttgttcctttggcagatttgcactcgccgtttcctcctttggtgggcatttcgacaaatttatgccatttccaccgaagattattgtgttcattagtgaaaatgccatgcctaatccttcggtagaataactgtttgatctgtcccccctccccacccaaaggtcggacattaatgttctccaattggtgtcctccgttaatctgatggtttggtacattctcccgttgactttgctctttacaatttacgcgagcattgggtaattttttacgttttttttggtcttttcgattattatttgattttttcgtctcctcggccggacctgtccttgaaaaacggctgccaaattcggcctgcccgtttctcatttgtcagcccccctccccctccgtcctctttctctattagtacttttctcccccaagtttggtactgattcggacaactgacgatgattcggtggtgcgcacttcgcatttgaccaggccaacaaaaaatgccaatttggggacgaacccaaaaagttggcagagtgccaattttgtctccgaattgttagcttttagagagttctctgctgctgctcaatggttctgtgttcggtcggcgccactcctcgcgcgacagtcccacccaaaaactttcgatggtttccgccggcggaggacgaaaaagttcgcaattgagccaacggaagttgtcgcagctgaacagtttgggcatcgaagcggggggaggagggcatttgcgaagactgccgaagattgaggtggcacgacatttaacggcacgaccaatcctagcggagcattcattttcattttttagttggtggacagccgtcgccgtgtcattcgcctttgtgctgtcattgtgctcgcattcgctgttctttctttgcctcgatacgtataaatatccgaaatgaataattgtcgttaattgctcacaattgaacagatttacttcacttggtctgtttggagggaagttaatggtgggtatgcttattggaaaataattgcaattacctttttaatgaacaacattcgtttctactttcctctctcttcttcctcctcccccatctccctctctcactcttcttcttcctctcccctctctctctct

SEQ ID NO: 32426 - DNA, 992 bp, Heterodera glycines
  misc_feature (936)..(937): n is a, c, g, or t
agttggagcagcagcaactggccccccatttaggctaattagattttcaattttctgcaagctttttctattttaggcgctcttttgtaggtttttaaaacctaaattatgtatcgcgcccttcaattagttaatgatgtgacaaattatgatggcataataaactttcgggggaccttcgtcagtagcggcggatgatggcactttccctcctccaccaccaacaatgacagcagatgccgaagtcgtcgcagaagcgatcaccgtatgtgtgctgttcccgctgctgctgcccccgccgctgctgcttccgctgctcatcgacgcggcgatcaccgaacgtgaggagcacgcggcggaagcggtggtcgccggctgctcaaccgaccgctgctgctgcaattgatgcggcgccgccgccgcttgctgcgtcagagtcagcgaggtggcagccacgccgtcgccaccgctcacaaagggtgccgagtaacgccgcgcctgcggcgaagtcgacgatgccattgtctctaccagctcgggcagtgcctgcagcccgccctcctgctcaccgctgccgaaaaaacgctgacgcccgccaccggcgccgcttttgcacgcatcggtggggccagctgttgccgacggcgtcacctgtacaaaaggcacattgatgatgctttttgatttatttgagtaaaaacaagacaaatgaagaaatttctcaattttcggtggtttgtggtctcggttaggtcaaggctggcattggaaaaactcgctttccaaggacgggtaggtatactgatttccaagaacccaatagaaaaaattcgtgaatttcaaggacacttgaattcaaggatattcgtaattttcaagtgagagggtccaatttcagcgacgtccttgccattcaaagactaatggcagccctgnngtcaggtatgctggcatttgctgtgccaacaattctccacacctgtgtgcttggt

SEQ ID NO: 32427 - DNA, 929 bp, Heterodera glycines
acttataataaataaataaatgcaatacgtaccaatgcttcttgtttgtgttcccactgagcttgtgctgcaacttgtttgtggtttgtcgttggatttgttcaaatttcccaagggttggcttttccctcctgcactcaaagcagaaacgacttcatctttcgcatttcttaaatccaattaaatttttaactggcatctaattcctcttcatttttatttgattaatctatcaaaaacccattcaattttttaaaaaacggcgcacttcgacgttggatcaaaattggatgaaagcgcagagaatgtcttcaggtccagcgacacactcaaatttttgcattcgtttccataatactagtatttcctcccctccataccttcgtccatggccctttggcccattccccgtcgaattgtcacagttatattcgcggaaaggcggcagaggcggcggcccccgtgctgtggccgcaaataagcgcgcaaattggggcagaacttgggaagaagctgcagctgacaaaagaacttttcgagtttataaaacagagtcaaacaaaaactgaccatttaacgcagttggatgtcctaaaacaaataaaggaaaagcagtttaataaatcagtaaacagaaccaaccatcgactagcaatggcgggacatctgagaatttggcgatggtcatctaaattctaaacaatccaacaaaatgcaaaaatacagtggataaccggtcgctgggaatttaagtggtcatcggacagagagtgctgcttgctgttgaccgtctgttgttggccaacagactgtttttcaccattttgacattcgaaattgggaataatcaatttataaagtatttgtaattgaaagattacttttaattcgatcgctgcttggcatttgactatttgatgactgtgagt

SEQ ID NO: 32428 - DNA, 2056 bp, Heterodera glycines
  misc_feature (61)..(61): n is a, c, g, or t
  misc_feature (101)..(101): n is a, c, g, or t
  misc_feature (2042)..(2042): n is a, c, g, or t
aaaaaaatttcaaaaaatttgatcgtccataaataaatttgtaattgatcagcggctcaancaatttttgcagagatacgtatcggagcactacaaatgcnttactaatttttctagattttttttaaaccgctgaaaaaagtttaagcctaaactttttcggccctgtttaaaaaaggaattagaaatttttaaaaatatttattcatctccctttttgataatataagagtcagagtgccttattcaacttgtaaataaattttggtgcgtttcagagcagtttctgaaaaaaatttatgaattaattttgcaaaaataaataaataatgaaccttcctccttaataattttcctgcgcccaaggtactcactcggccgcttcgcggcctcgtggctgtaaaaaaaatttggggcaatttgaaagagaatagaaagaaccaggttcgatgaagttttggtaagccaaaaaaaatgcaaccatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttgttaagccaaaaaaaatccaaacatttaaaaatctataaaaaatttaaaaatgagaattcatgcgagattttctggaaataagcttaattgggcctagttaagctgtaagacacccaccacttttgcacttaaaaaaatttcaaaaaatttgatcgtccataaataatttgtaattgatcagcggctcaccaaattttgcagagatacgtatcggagcactacaaatgcttactaattttcctagatttattaaacccggtgaaaattttttgcagacacccaccacttttgcacttaaaaaaatttcaaaaaatttgatcgtccataaataatttgtaattgacaggggctgactaaattttgcagagatacgtatcggaacactacaaatgcttacttattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaaagcttacttattttcctagattttttaaacccggtgaaaattttttgcagacacccaccacttttgcacttaaaaaatttcaaaaaatttgatcgtccataaataatttgtaattgatcagcggctcaccaaattttgcagagatacgtatcggagcactacaaatgcttactaatttttctagattttttaaacccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaataattttcctgcgcccaaggtactcactcggccgcttcgcggcctcgtggctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtgaaaaaaatttggggcgatttgaaagagaatagaaagaacacaggttcgatgaagttttggtaagccanaaaaaaatccaaat

SEQ ID NO: 32429 - DNA, 361 bp, Heterodera glycines
  misc_feature (49)..(49): n is a, c, g, or t
  misc_feature (53)..(53): n is a, c, g, or t
  misc_feature (58)..(58): n is a, c, g, or t
cgtttccaggacgggtatgccgattttcaaggacatctataaagagaangcangaaanccaaggacaaaaaagaaggatcttatatgcaaagcaaaacggagaaaaaagatgcaaaaggctgggataagacaccggaaagaacagatgccaagaaaggaggtttcactacggtgtgtcgggacgggaccgggtctgggcgagaattaccggtcacggtttttcccaaaattcccggtcccgtaccactctagttttcactgatcattttcctaatttgcgacgccttttttctgctttaaaaacgctttttttgcggcgcgctttttccaaaaattttgtggaacagggggggggggtccg

SEQ ID NO: 32430 - DNA, 1093 bp, Heterodera glycines
  misc_feature (1069)..(1070): n is a, c, g, or t
  misc_feature (1072)..(1072): n is a, c, g, or t
  misc_feature (1074)..(1074): n is a, c, g, or t
cccccccccccccccgcccaagggaattcgtcgttattttggccggacaatgctttagggccaagaaaataatttccattcgaaattgaaagcattaaatcaatatctgtagggctaggtcgttttgtaaatccgctaagtttggtatttttagacaaaaaattgcatattttttgcaattttattataatcaaaatataataaaaatggcaaattacgagagaaaaaatcgctgcgaaataattaatttgttagcgtaaattaaattagattttattcgccatttaagcaaatgcttcacacaattctgttattcattttcacaattcttcatttaacatctgcgaaagttgaattcagtgaacagcaacaaaatttacgaattggtacagtcaaaaatgggaaaattgtacggtagaataaatccaggataacgaacggtaccgatgccgatccgctcaattttttgggaacacccgcctcaaaagctttaatttttttggcccatccctccccaaagcatcaacttatttagctcattatccctaccccaattcccgactttttggtaggccacgatcccaaaaatctgtcccgccccaaactcctgactttagtgacaagtcaaacctcggcactctttactccaagctcccataatttcttatatagccatgacaaaaaaaacaccacgccccctcaggcgctgtttttcgagcaaaagaagacgcccatttggtggctgcgttcaactacagcttgcactggttgcatgaacatcagaacaacattttgttggtgccgtcggcggcgaatgccaacaaaaataatgaaaatggcggcggagatggcaatgtgattggatacatggagattttggaagacccggaggattactatgagctattggagaagggtaaaactaattgcattacttttttattgaaaaagctttagaaaattttcggcatttttggggtttccaaccatggagtttcaatttccgctttttaggcctacgtttttgatccattccattcacactgatcaattaagtttcattacccanntnangtttgttaatccaatatgt

SEQ ID NO: 32431 - DNA, 1728 bp, Heterodera glycines
actcgaatatcactgggttggcatgcagtcagtcacctacgtgtccagtcgatgagtgcccgaacagtggtgccgccaccgccgccctttgcctgctgctgctgctgcttaatgccgtcatcgtcagtactatgatttactgctgctgctactactgcttgatgttgttgctgttccgcaattgttaggtcaaagaacacattgcgtccgatcgggtttccgtgcaccaaacactcgggcaatcccaactcggcgcaactctccgtagtcaactgctccagctgtgcagtggtggccattaatgggtcgagcagttgctgaaaaatctttataaataaaaaataatatttttttttaaaagaaattctcttagaaaattatattttaagaaaaaatggcatttaaaaaaacattattgaatttttcttaacaagtttcattagtggctccagcagttgcctcaaaaaaaaaaataaaattttatccgatcttttttttttgatttgccaaattttatagcacccaaaaattccaaaaaactgaaaattttcttaaataagtcttttcaaaatatctttaacaaaacttcagagaaagttaaaaaaattttgttttttaaaaaaatgttccacgacctttaagctggcgactgaaaatttatttctcgtttatgtacataaccaagaccctgaaaaactcaagccatgatcgtcccacaattcaaaagcattttaaatggattatttatttttaaaaatcttttattgacctaaaaatgccaacccacccgaacacgttcagtgcccagcaaatccgctgaactgctcccgccgggcgcagacaatgaagtgatcagtgcaccggcaaatcgtccaatctgttggtagagaaatgggggcagtcgagcgccgtccaactgacgatgccattcctcacggcacaccatggacaaggcgtgcaactgggccaacacgcggagcaaatcacggacaccttaacggcacaagcgttggcttgggcctgatcagtgatcaccaatagtgacaaaaaataataatttgaaaaaatccgcaatatttgaaaatgccaaaagctgagagaacaccttcaatagcaatgccggtgccgagttcgttgatttgtgctttctcgctaaggtcctccatcacaagcaaagcattgcatgaacgagaccattgtttctgaaatgagtccaatggtggatggagggtgaaattaatttggcattgaactttcgaactcggttaaatgcaagaccagaaatgccaatcccggctaggttcgtcagctaaaaccagtcaaacaaaaaacccctgagatttcgaatttgattgaattggtttcggcttaagagttttgtttagaaaacaaatagcattgatcaaattgccttgatgacaaagatccgtgggattgccacccgacgatgtttggacagccattcataggtaagacattcactaaaacagaaaaagcaatggaaatgatgtgtacatattttggtggcattcagtttttttgtaccgcttgaaaagttccgatgccaacgcggcctcctaatgtgagaaaatgatgttgattgattaatttaaaacgaaagtttttgccttgggcggatcatcctcgtgcctctcgcaaatcttcaacaccacactttttggcaattttgcattttcccatccaaaagtgatgcgcaacaccgttgtt

SEQ ID NO: 32432 - DNA, 1413 bp, Heterodera glycines
  misc_feature (20)..(20): n is a, c, g, or t
  misc_feature (54)..(54): n is a, c, g, or t
  misc_feature (62)..(62): n is a, c, g, or t
cctggcttggcaatttccgnaagcagtatcctggcccgagggtccgtccgggtntgcccatntcgtccctaatcaatgcattttcgtgtactcaatagcctttcgttttgatcgcttttccgttgtcgtcccaaaattcctgatcaatggcaatggccaaagatttgttccgtcaaaagaattttccggaggctttcattttggcttttcctttttgatacgaaacgaaaccttggccaataagcagagcattttacggccaaacattgtgtaaccgaagagccctctcccctcttcatcccatccttccgagattcaacccccaagcgttgattatctcttttctgactcattttgcttccccaagggtatttccgcttttatcccctccatccaatcatatccgccgtagcctccggccccagcatcaatcagccagcccaagggcacattctctcgttttttttctatccccttctctctctctctctatccgcttgtctctctctccttctctctctttctctcggcccttctctctccccttctctctctctctctcgctctctccacttctctctctctctcggcccttctctctccccttctctctctctctctcgctctctccacttctatctctctctcggcccttctctctccccttctctctctctctctcgctctctccacttctctctctctctcggcccttctctttccccttctctctctctctctcaggccttccctgtctctttctcctcccctttctctctctctcgccgtatgtcatctgtctgatcactgttgtattggccccttctcacttgttctatctctctttctctgctgctgtgccctgtgggccaaacacggctgcttttaagcagcatttccgatcagtgagagcatcatcgtcaatcagtcagtccctggaattcccttccccccacacaccttctcccctcgggggcaaaatgcgtgggaacagagcagcacagatggcctcgggggacggatgatggaattgccgagagggggtcgagaacagccctcccccgtcccgtcccccgcctggagagaaacgaatcgcggctaaaagaggcgaagaagcacagcaaagtgatcggacggatcagctccgcccccgccttgggcgtcggctggcgactgatcaatcggttggttgttgaagccgccactatctgttgagacgtcggcgggctctggcaattggcatacccctcatggcctgcccaaaatgatccctccccccccacccaggggacggcccccgcggggccatccgggccaagccaagacaactgtcattaagccgacaggaaagaggagcaatggcttaagtaatgggggcgattggcgtcaaaagccccatcaaaagcaggggag

SEQ ID NO: 32433 - DNA, 1054 bp, Heterodera glycines
  misc_feature (136)..(136): n is a, c, g, or t
atcagagtgctaaaattaagttgtaaataaaatttggtgcgctttagagcactttctgaaaaaaatatttatgaaacaaaaaaatcgattttttcaagtgtccgtttggggtactcaaacaattatggggagcaanaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatcgattttttcaagtgtccgcttggggtactcaaacaattatggggagcaaaaatccaacgcagaattaaagtacaggctatagggaagctattcccgaaggattcggtctccccataaatctgggcgcatcggttcggggggactgccccgattacaaaaaaatcgattttttctagcgtccgtttggggtactcaaacaattatggggagcaaaaatcccacgcagaattaaagtacaggctatagggaagctattcccgaaggattctgtctccccataaatctgggcgcatcggttcggggggactgccc

SEQ ID NO: 32434 - DNA, 1301 bp, Heterodera glycines
gcaggccgctgtaagacaatatatttgtgttcagtagagtcttaataattgtttaagaacattcctcctccggcagtttgtaacagatttgtcgaagggttttcaagcgtttatgtgtatgtgtgcagtttaatgcttttgagacaataaagttatttaggttcgaaacccgaccatcttcacatggcggtgcttttgcattccgctacgatgttgaaatggtgcaactgactagaaacaaaagtttgacttcgggcggtggcgacgatgggaaaaatggattgctccgcggcgtttgttttgaattgatcaagttcgtgcacgactcgacgcagggatttggacaagcggtaattccctctaaatcgcattcaccatttaccttcattttaggcacaattcgtttacgacaaccgtaaaatcttattcacgaacaaacgaatcgaacaatttgtttgctttttgtcttttaacattatgtaactatataattttaggcattggaaattgacacggaaaaagtccaaggaatcgttcgcgatttcctgcgtgggtctccagtcaaaattgaggttaggccttgtcagactgataagcatgagctggatctcaacggcattgtttcttcgatttcgcaccatcctgatcaacaatcggacagatctttgcggactttccttgaaatgctgtcttcccagccatttctcaatgcgtaattagcagtatttaatttttttaagtttattcttagtgggacacatgacatcattggcgctggtcgactttttaagcgtcagatctgcaaagagctcgaagatggcattgtcacgcgcgagggtattgctaagggagttcgcgtcattgacaacaatggtgaaccaaaggcggctttgtttgctgacggtttactttgtattttgttggttgagtgcttaagaatcgcttgactttagattagtgcattctcttgacttctcaagcttaaggaactcgaacggctacataaagggaaagagaggaacaccgaccaaaccaggaacgaaaatatatgcacccaagcgaccgcgaagttgatacaaatttcaaaaatcagttaagacccaatccagttgtttgttacaattgtaacgaacctggtcatatttcacggaattgaataagacaatttccgcccaaaccgaaatgaatttccatcgtctttgcctcaacggaatcaacagcaaaccccaaatactactgcaactggagcaaaccgagttttcctatagtcgaaaaaacgtaatgccctcacccgggcgctc

SEQ ID NO: 32435 - DNA, 1149 bp, Heterodera glycines
  misc_feature (1114)..(1114): n is a, c, g, or t
  misc_feature (1126)..(1126): n is a, c, g, or t
aacgcacgaaaaatagttattgacaaaaaatggctattctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgtgaattggtcaccaacttttgtcttttgttgtaacgctgaataaagcactaatagtgtgtttgaaaacgcacgaaaaatagttcttgacaaaaaatggctatctctgaaagtcactattaaatccctaccgggaattggacaccaacttttgtcttctgttgtagcgctgaataaagcactaatagtgtgtttgaaaacgcacgaaaaatagttattgacaaaaaatggctatctctgaaagtcactattaaatccctaccgtgaattggacatcaacttttgtcttttgttgtagcgctgaataaagcactaatagtgtgtttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgtgaattggtcaccaacttttgtcttctgttgtagcgctgaataaagcactaatagtgtgtttgaaaacgcacgaaaaatagttattgacaaaaaatggctatctctgaaagtcacgattaaatccctaccgngaattggacacncacttttgtcttctgttgtagcg

SEQ ID NO: 32436 - DNA, 1203 bp, Heterodera glycines
cccaaaatacgggagtaaaaaaatccactggtaagaattgaaatttttggcaaaatgaataattttttgatcgaaaaactgttaaatatatacccaaaatttcaaaaaaaatttccggcggcgcctatcggcaccgccggacctttaaaatccttaattttcttaaaaaaattgctcaaaaaattgcaaaaattggtcatttttggacaaaatctgacaatgtattgtattcaaatataattttttcccggcggcgcctaccggcaccgccggcctccctcctcctccctggatcccaaaaagttttttcaaaaaatacggcgcaaaaaattgttaaaattaataaaggattcggaaatacaaagtttaaacctttttgttcgaataaattgattaaaaaaaattatttgaagcaattttgaaaaatttttctgattttcgaccctaaaatctattttttttttatttcgtttctgcatattataatttttctgtattttataaaaggattgtccttcaaatttgtgcattaaaaatttttttgtgggtatttaattaaattttcgaattactcccgctcccgcccgggactcccgttaaaaatggacgggagttttcgggagcgggagttttacgggattcccgctcccgctcccggaaaaatttgaactcccgctcccgtaaattattttttaccggtctctaatttttatacatagtagtcatatattgctcaatttattagtcgattttcacatttatataaacatagtcaccaaataggtctaaaaaattaagaatagggattggaatgacatagaatacaataagagcacacagcaaatagtgggcaacagttaattttagaatttctaggaaaggaaaaacaatccttgagaaaagcataaggggaaataaagaaggaatggaataaatgtcggtcccgggcacattccgtcacaatggagaatcagctaatcagtcagctgcaagggtacatcagaaacaggtcgcaaatcagaaataatcaagtttgcaatcaagaacggtcaggatcagactcaaatgtcaggatcttccagggatgcagttacagacatagggttcagcagctcggtaagaaatggataagaattcggggtttttcattattgacaaatcctgatcctgtcgcgggtcattaatgaccggatctgtgattta

SEQ ID NO: 32437 - DNA, 1410 bp, Heterodera glycines
  misc_feature (1124)..(1124): n is a, c, g, or t
ttgaatttcaaatttgagagcctagaaaaatctgaaataattcatgctaacataactttcgatgctgatcaaaaaagtcttttacacaacttgatcagatcactccttcatggtgatctggcaccccaaaatacactggaaatcggggaaattttcaaaaaaaatcctagggggttgggaaaaattttctggaaaaaaccgttaggttcatcagaaagaggacaaaacggtctacagtatgcaaaagaccgtaagtctctatgacttatacccgctgaggtatgggtacttcaattttgatttcatcatttctactgtaaaatgcactatggccataaacatatgaccacgcgaaaatggggtgtaccaccaaaagtctggaagtgatctgacaaaaaattctcatttcgactaatgattggtatcatttgaaagcccacaaaaaatgctacaaaaaatgttatgacacttctggtcatacgtttcttggtaactaattattaaggaaagtgtttgttagcagcaagtcgccataaacatatgaccatgactgtatctcaatacacatttggcttaattttgctactttttttgaatagcttttgtcgttttacaccactaaattttaggtttttatttgtttattcagaagaaataaaatatccaacgaaggggtgaccacttacacgttaattagtaaattagtcaagtccaaggagcgcttttacagacaaaattttttgtttgactcaatccatttactcataccttttttgaaactgtcaacagatggagcatctgttatatctttgttgagtttggaccatattaacgccattctgttgataaaagaattttagtggattgtgattttaacacaactttacgtctaagattgtaggggattcgaccagaaaattgaggaaatatttccttttaagatgtgtaagaccattaatgattttgaatgcctgaactaaatcaattgtttttctcctttcttctaaagtttgaagtttgaataaatcaagtctttgtttgtaaggtatgtaaggaagtctgcatttaaataaaggaatttttgtaaaatatttttggcatctttttagtttatttatatcttnttttgtatgtcgggattccaaatttcaggcgcatattctaaaagaggatgaatatatttttataaattttggttccaatacgtatagagctggattttagattttgggcatattaagaatcctaaataagcagcttaatatttttagaatatggatagaaagcctaatttattaatcattaaaatgcccaaatcactaatggattccctccttaataattttgtgaataatttatatggtggttttggattttttttggtaaaaaataaaaaaaatggatttattt

SEQ ID NO: 32438 - DNA, 1392 bp, Heterodera glycines
aaaaaaatttcagttggcaaattgccagcggaccatcgcgagcatgcgatacatcatttgccgagagatgaagaatccgaccgaagcgaagaatctgctctcacgtgagtgttttgacagaaaaaaataatgggaaaatttaattaattaatttatataattaaggtgtctcagaatatctccaacaacaccacaactttgggcccacccctccgctcgacgtctctttcccgaattatgtgagttaacacttaaatttgtaacacaaacatattcaattcattaaattagggttcctccccgactcctcgggggggggggcaaaatgtcgggggccgggaacctcggggggtgacatgtcgggggtcgggtcgagggtgagctcaattgtcgggggtcggggacctcggggggcgacatgtcgggggtcgggtcggggggctcggggtcggggaggaaccctacattaaatattcaaaacaatgggcagggaggggttggaccccaactttttggagagtaaaagtcggggaggaaattctcggggataaaattgtagtcggcagctttatgaattaaaaaatgccagcaggcagggaaattccgtaaaaaagggtccctttttcttttgtcaaaagcctcggggagtgcccccggcttttggtctaaattttaattaattttaaatttaaaaattttcagttgaatgaaaatgttacttttgctgctcggttggtcacccaatttgccgcacagcccactaccacggtggaacaaatgcgtaacatcgggatttgtgagtttcaaaaattttgtctccataaaataaaattgggcaaatgagcggtcggggtcctttttgcgcgggcacgagttttagaaatctaaattttttttcattgtcaaccaaatccaccaatcttggcataattcgaaggaatgttttgaaattgttacaaaccttttgctaggcgattcagtaattatcgtcaaaaaagttgtaacatgagctttttgtaaggctaatagagcatgcgaagagctttctaatgatgcccagattgctagatttgggtgaaaaaaagaaaaaagttcgaatccaaaaactcaggcccgcgaaattttaaaaatttttgcgatgggaacaaaccggcgttagccccaaatggaagaccggcccaatttttgggcgacttctggggctttttaaaattttaaaaattattccttaatttgcattttcccatcgtttttgtgattaataattattcttctgactgttttgggaaattttgagttttgaggtctcagattaatattcattattcacccacaaccattaactattctttttaagtcttgtctacataccacactcaactgcaaaaccgt

SEQ ID NO: 32439 - DNA, 1335 bp, Heterodera glycines
ccgccggaggaaattttgaaaatttgagttaatttgttaacagattttcaacaaaaaaggctgggtttcgggattaataggctcaacaatttgtacggatttccatttaaaaaaatgataaaatgtgtcaattaaaataaaactatgaataatcatattttgtcgataggaaagccatgagtatacaaaaagaaaactcaaaataatttaatttctgtgtagagagatttaaccaatggaaagaagaagggaaagtcatggagactagccactaggccatccgcacaattggcagaactgcttttaaagaatatattaatatatttttaaaattttttccttttaactccaattttcttcactaatttttcactcagacacccattcttaccagtgcttgtttttcccggttcccggttgctttaccgggaccgggacctgagcttttcaaaatccgggaccgggacctcggatgaccgggaattcccggcccggtcccacttcaatgatatcattcgatagatctatgtgttttctattagcctacaaaattttaaaaagtttcgttaaatttcaaagaagttatgaccaaaatgtgcaaaaaaaaaatttggttttttgtaccttttttgaatgttaattgatttttacaggataataggaaacacttaggctatctaaaaatatcaaaaattttattcattttcgctaagttatgaataattttctgtcaaaaattttccacttgaaagcacataatttgttgcttcgtctcactcataaaatttaaaaaaattaaggaattaatgtcaaaagaaaattgaggcgcggaacaggacaaaacactgccgccgaaatacagtcgagacataacacagccgagaataagttttttcaaaaaaatcactagaaaattttttttacagttttctagaaaaattttctaagatttttaaaatttctgtttgaaaattttttaaatttattcccggctgtgattttttctaattttcttcctaaacagaagaaaattcagattctaataagaaatgccaactgttcgcgaaatacttgagtgcaaaagcgagtaaaaatgcccagcattcctacaaatgatgaatgggcagttttaatttattggacgggatgacgacgaagcaccgattcaaggcactcattccgccagtttacgttcggcacccctttttaactattgtcaacgcggcaccgtttgagttcatgaatggctggcgcattttggcaaaccttacattggcaccactcaattcgagattgatcgtggatcggaggcatttgaacccaatgctgatgtcg

SEQ ID NO: 32440 - DNA, 917 bp, Heterodera glycines
tttgtccacttactgctattttgtaaccccgaactccacacaatttgttcgaaagtcgaaaattttggtagcagaaccaaaaagtgagcaaaaatgtcgggatatttgcggacaaaaatcgcaatagagctaaaggctcttgaaaaggcgaaaactgcaacagaattgtatgctgagccggaccaaactctgacctcattggaaaatgcaattctcctggaaagcgcggcagagagaataaagtcagaggtggaggcagtgaatgccaaaattgagcaaatttggataaccgcaagcaaatggcatgacgtcatacaaaaaatggacaaggacgaaagaaaaagtgagcagacagcgtatgaacaatttcaaacaacggagaaactgaacacaaaaatggaagcagccaacacaaagctaacagagctgaaggacctctggagatgaaggtagaagcgggagcaaagctgcaacgctccaaagcggacagagacgcgcgagtggagcaaatagaacatgcaaaagcaatgtcgaagtcaaatgcagaagcagacaaagggaatagccgagcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcctggaagagaaaaattacgaaattgccatgaaactgttaaaagacacctatggggataaaggcgaatacgtaaggaggttacatacggaattgtcgaacctcagaacagatataactacggtggaagacacaaagcaattt

SEQ ID NO: 32441 - DNA, 1065 bp, Heterodera glycines
aaaagtctatgattttcaaaattcaatgataaaatcaatgatttttgcaaatctgatatcatattcgtgatcagaagccccgaaaaccctcgggttgatcttttcataacaaaaaaatttttgggcggagcccagattctccagtattgccattatttttttgtgataactttttgattcattttatttttttatttgggtcattttttcattttcatttgttgtaaattattattaattaattgaataaatatggatattttgtttccgtctctttttcgtcgtattccaatcatcagtaaacaaaaaaaaggatatagaattgcagcttaaaagacgatttttgggattaggatttcggctgggccttttagacaaattgcatttttcagagccgtctttctgctggccgacttttggatggcacttttatttaggagagggaaattggcatacttttaccaatgattctgacgcaaattaaggctcaccgtacctcggactgttataattaattaattctaattaattattgtcgtaggctttaaatttcaatggattccgttaaacagccataaatggggagaaaaagaacaaaatatccaacatacacttggggaaacgcgtaacaatggccaaaatcaatattatggccaaactgctgacaaaaagagttggcccattcagagcattttttatattacaatattttatttattatttatttgttttcgatgcaaaatatgagcaaaagcacagaatatcaaaacattcattcgttcgttcgttcgttcgttcgtttaatgcgttaattggccaacgaatgaatgactcattattcttttgacttttccattcatttgactttttcagacaaatatttgaataggaaaagcttacattaattagttagttgtttgttcccttttgatttgttggctccctttttctttctttttttatccgtttgtttttcactttcccccaattcgctgcctttggatttgtttgatcacttttcttctgtctcgcttattattattatcattgttattatttttatta

SEQ ID NO: 32442 - DNA, 1197 bp, Heterodera glycines
ttatttagggccaggttttgtataaattatttgggccttccaatgaattgccttattttgggcttaaattgaaattcggcatattatgagccttgaaaatttttgatgaaaagcttattttgcctttttgttttgtgcccattttggcttaaaatgatgaaaggaattttgccttttgtttttgcccctttttggcttaaaattgagtttggcttcgctcttaagattttcatttctttttaattcgaaattgagcggaattttattcatcggccggaatttttcgtcggtcggaattttgagctttggcatgatatggaattacctcgctctcaattatttttcgagatctgagcggtatatatttattttttttttatttatttatttattattttttttttaatccggccggatttgttatgttgggctgtcgcccctgcgcagaatactccctaaataacaggcgccacaatacaaaatggaaatgtgcacatataatttatataattgaaattgtacaatggatgaaagaggagaaaagagaaaagaaaaaaaaatggaggggaagagggaagaaaaaaaaatggtcgaccgtctcccgaatccatcccaaggtcggtggaaaggttgtcattcgacaaccatcccttaatatagttaagctgtgccgtgtttcgggattcggcctgcttagttccgacccctgagatcgatctcctccgtccaccgacggattgttggactgggccgtagcccccgcggaaaggctccgtcccatcggtcggcttagggggagggccagtagtgggagtgatgactggggaattgactgactgacctcgatggctgggagagccatcgcttaaaaggggaatcccggtgggcgttccaatggggaggagcctctcccctccaatcccaatcggtagccgagacccgagtcccggcttacacctccacccccagggcaggaaccgtcgctggttcctcaacttactcgaaattttgcgcgataatcctgctgcgctccaaacctctcacccaaagaccattttcacgcattctcacaaattaattgcccttcagtcattctcttctctcgcctcttcttctccccattcgccctctttccatcaccaccgcccccttcttccctcctcaaagctccaaccacaggggaaagacttctcctcc

SEQ ID NO: 32443 - DNA, 1254 bp, Heterodera glycines
  misc_feature (1239)..(1239): n is a, c, g, or t
gttttcgatcagcggaggtgaaaaagaaaagaagaaaggggcgcctttccttttccccttgtccgttccgttgtttctttgtccgtttcttttcttccaacccttcgattattttttgttcagaattttctgcagggggaacgatcagtaacaaaaaaagaaaaaaagataaaagagtgagccctggccaaagagccccttttgtgggattgcccccccccccccccccgacaatcggcgactgacccaccgccattcgcttgtcttttgctcattgcccactcaacttgcatttttaaatggactaattgggtcatcgtcgcatcatagtcagtcaattagtctaattactcaacagaattcaaatattaattatgcaatcaatgccttttaatctatttacctacgaaccgttatttagttaagtggaaaagtattgaaccaaatttttttttattttgaaaaattgatttctcaaaaatgtttgatataaaggccttattagttaatgccagaagaaacattcataattgtgcaaaccgattaattttattgtcgtcgagtaaaatggtccaagaacaaaacagcccctttttttgtcggtgcaaaagtaatgctccaaaaaaggggaatcgcaccaatttgatcagataacctcaaatttgatttttcaaaatgttctatacttttgcatttgactgtaaagattagaagaccaaattcactttcgaattgccttgaataataagcaagaagcatgcttttttgtctttttaatttagcgaattttccccgtttttcttcacttttctttccttccttttctgttctcttctcggcccttttctcgagaggtcattcactgaaagagattcgcagcctttgcataatatttgcattaatctttaaatccatcgaactgcggataaataaatcatttcatccgatttaccttttgatgacaaatggccaatgggcgaaattttggattggaaattgatttaacgttaattggtggataattacaattctgtatttgacaaaattccattttccctgcttcatactcatacacatccagctatttattcatttactagttgcccttgcgaaacgccgaaacggaccgatcattaggggagataaaaggggtcgccggggataacccagggacgattcgttcattttgaaaagggtgcccgcgcactgcgcatggataaattgtacattttttctaangactaggactaaatt

SEQ ID NO: 32444 - DNA, 1544 bp, Heterodera glycines
cttcctgtaacccttctcgatgcggtagcttgtctctgcatcctttcttacgcgcgccaactcctgctcatagaagctgcccttgaatttctctccgtgttcatcccgcagtttgtaccgaatcgggcgcaccgctttcaacacctcgtcaatctccaggatttcgtccccgtaatttggcagatatcccttctcaaattgccccttctctctgctcatgcggacaaattggtcgttatgaaagcgtggcgtccgcctttgaagggctgggtgtccgtacaatcgcttccacaccctttgcgcatttgaaaagttaacatcaatggggcgcattccgtgaacgcgtgacggcgagctgttaattccgtccacaatttgctgtactgtgtccacccaattcagcgtctccttttccgcaaaatagcggtacaatcgctgcttcacattgcggatggcccgctcagcaaccgatgccttgacgaacgaatgcactggctcatgtttctcaatttcctgctcctcgaagaattccctgagcaagcggttcttgaattcagtgcctttgtcggagaagatgcgatgcgggaccatgggcatttggtcaatgagttgtttgaatgcctccaacatctcctcggctctcttgtttttcagcggaacaacaaacaatcgttttgagagcacatcaaccgctacaagcaggtatcggtgaccccgattgtggcgcgaaagcgcctgaaaatcgaccaaatccacttgaacatcggtcatgaaccccgccgcaacggttcgggcccttggaaagtgcaccctgcgggggcgcatcagagtgtacgtgcggtgtccctccaaataatgctgtacgtcctttttccgtaaatgtttaatcttctttcgcgcctctttccacagtgcggtaacaccagcgaaatgccgctggggatgatggatcattgtacattttgtcaagagtggtgttgatcagctccattttttcgggcgaaattccttcttgattgtccgttccgtccgggtggttttgctctgtgacggtctctttggtggggccgtccatgaatacaaaattgggtccttcctaagccgctcttccaataggttcgctccaggtggtttaatggtggggcggcccgctctccggtctattatatacttgagggccattcgcaaattgctatgcgccaacggcttgccgtttgcggtgttaattgtatttccccgaacgcccatacgatcagcgtaacggttgcatttgatgtgcagtcgttcaatccgttgagtcatggtcagctgatttgacgggatggcaaacggttcacgctgctgttgttgttgctcatccctttgtgcagaagttgatgggcccggttcgggagagtactgtactctcacccttctcgcttgcctcacgcgttttcttatgcgcacctcatcagcatcattttcaccgtttacggggtagtggcgtttggtcccccgcctaggcagaggaatagtgggcatttcttcttcgacggcagaagcag

SEQ ID NO: 32445 - DNA, 1082 bp, Heterodera glycines
  misc_feature (1057)..(1057): n is a, c, g, or t
gggagggggatgtccgtcggtgccgataggtgccggcgaaagtttttcggaattttaggaatttttaattaattttattaagaaaattgtacaaatttaaaaattttcaagagtccccaattccccgagttagtgtcgggagtcgggggataaaaagtcggaggtagggggctcggggtcggggagcaaccctattataaacccccaaaataggtgctaaaaatggaaatgagataaatattttaaaaatcaaaaatgtagtcaagtaaataaataaatgaatatgaatttttgataaaattttccatttctcaggggtgtatttttcgtttttattgcatttttgttaataatttttttcaaaatagcagaaaaaattttacaaaaaattcttcaaaatgaaaaagagcacaaaaaagcaataaatttatttttattaacaggttatattgctccaatttgattaggtttttttcggtttttcataaaagtcggtcggttgtttcggttttttgattatttcggtcggtccgtttcggctaaaaaaccaaaaaaaaccgaaccgaaaaaaactgaaaaagtcaaaaatttctcggtcggttttttcggtcaaaaccgaaaccgaaaaataccgaaaaaacccgaaaaaaaccgaccggtccgatctctaattataattgaaagggtttatatttttaaaaatgaataaaattgaaccttgaaaaattttttttaaataagcaaatttaatattttaccagttaaattttttagtttttttgccgaaacaattatatccttagttggacatgcttatttattaatagaagtcaattatgacaaaatattattttgatctataaaacttatttcgcaaatttctttttaattatcattcacatcgcattaaggtttttgtacgtgatcaaggtcgcaaaacattaccttcatcaatttttcagaaaggattttttatttaatcggtgtgccccgttcttaattaatatagttattgtgaatatattacaattattaataatgggtttttttcctactnatttttaattattaaataatttttt

SEQ ID NO: 32446 - DNA, 974 bp, Heterodera glycines
cttgaaaaagttaattttttgagtatttggcagccatgacttatttttaagaaagaatgaaaatttttaaattttgctagtttaaacattttcacgctctttcgaacagtaacaataaggtttaattaattagaaaaacatctcatgtatggatccgagactcaaaaatctcagaaattccgaaccaaaaagggtccggatttccggaaactgaatccaatccccctattgcctttttgggatttggtttttccttcaaggactgcctttgattttccatgccaatttttgtcatttttatgctaataaaaacctgtgccatttgtatgcattttcgccagcattacctgataataatgcttttgaatccgatcactttgctgggcaatgctttgtccggcattagcaatgttttggcccgtgaattttttattgccaattcggtggtgccatttgcgccaattttgtggccaatgcgcacaaatccaagcgcccatcgccgcgttttgaagtgttcgtcgaccaaacagtcaaatcggcggctgagcagcgcaatttgaaggccaagctgagtaggtggaagcaaatggaacacccccagccaaccgtcgccacaaatgtaactgaaccggactaaattaacgccattaattgctttaattagtggggctccctgacccgagtcgggggataacaaatgcttacattttttttatacgttttatgcaaatcttacccccttgggactctaaaaagacaaaaacattgaaaaatagattgcaaacagttcctctaggtctgtactgaaagaatgcgaaagaatttttggacaaaaaaaactcagtctctctaaggaattggttttcttccaaaattctttcgggtttgttcgttatagaccaagagtaccggatgctatatggatttataaaggatatcggtgttgtcagcattcttcaataagtgtctagctc

SEQ ID NO: 32447 - DNA, 1116 bp, Heterodera glycines
aaatattcctataaaaaaatttttctaagaattttttccttgaaaaatttctaagtttgatattttttttttgaaatttctgcggcgagatttcggccggcgagatttcggcggcgagattttgtctcggcgagatttcggccggcgagattccggccggcgagattccggcggcgagattttggcggcgagatttcggccggcgagattccggccggcgagattccggcggcgagattttggcggcgagatttcggcggcgagattttggggtgcacccgaaaatcccatatttaatgaggaaaaaacatttcaattcatacaaaaaaggggggtggtggggtgccttaaaacaattccgttcgggttgaccccctcccccatcttttttccatttataatttccaataatctcttttaaatgccttttttacgcttttccatgcttttccctccctcactgtccgtgtgcgtgcttttaggtgaaatacccgcagctgcaagtggaccaaaccaacgaatgcgaaggcgtttatttcgagcgcaacgaattcgtggacataattctgtccaatgttttgtcaaacgccggccgacggcgcattgttttctcctcttttgacgccgacatttgcacaatgtgcggacgaaaagcagggggaaaatatgaaatcgacgaacacaaattattgggaattaggggcaattaatttattggacagttagaattggcattttgccctcttaatgcgccaaatcatttcaatacgtcgttaaaaatattctcgtcatttaaacttgaattcttcaagaatgagagagcattttttcaggttgtcggtcaagcagaagaagtacccggtgctgttcctgtgccttggcgattcgagtcggcacgtccaatacgcggacgagcggacgcggttgccaatgtccgcagtgaaatttgcacatgccatcggaatagtcggcgtgaacttcaacaccgaagatcttatgaaggtggacagtgaatcatttgccatttttaatacggcctgattttgtcccgatcaaaccaattacgcgtaattattaccgattttcccccaggacgcgtcgccggtggcaaatcga

SEQ ID NO: 32448 - DNA, 1046 bp, Heterodera glycines
cacgtcataactcactcagtccgttgcccgaccgacgctctattttatctgctcgactgatcgccgccgccacagccaacccatcgactcagccgaattggctgcgattaccgacttaatcggattattgacacatccatcagcacagaaagactgacgcgtcccaagcgataaaaaatgtcgcaaagggtaagcaatggcacagaaggaaaacaaagcgaaacaagcactaaattggcaaacaaacaataatgcatttgaaaattaagcaaagaaagcaatgactccaataaataaacgaattatttgacggggagagagagagagagagagcatttgcaaatgaaaaagcattccctcagttgaaattgcaatcaaataaaacaaagtggtggtggagggaggacgaattgtgatgggtggggaggggagcaattgaattgacagacggcactgccgatggcacactgtccgacatttgcaaattgtacgactttcctacctcataaaatgatgcccgcccctccgttcttcccccccccccctccgttctcaccaaaatatttattgccattcattaatcttttctcgcttatctccactcgcaactcttcccaattattttttgctgccaaactaataaatttgagctgtttaactgccccccaatattaatagtgccggcgatccgccgtttgctgaccttcgtcctcccattatccgcccgtccatctccaattgcccagtttctgaatgggaggccaatttgaatcgaagttaaatgtgaaatctttttgtgaattatggtagtctacgcaaccaattgactatgtgcccattgtctcactcagaataaacatgcgattcagcatctctctttgagaaactttcgtccattgcttgtattgagcaattttgggtaatggaccaaaggctttaaagtgtaactcactccaaaaatgataagaaaaagcttaatgagagaatataatcgaatgaacgaaaggagggataaaaggtgaggtaaaagaagggtaaaaggaagg

SEQ ID NO: 32449 - DNA, 984 bp, Heterodera glycines
ttgcgtatgagacggagggctgtgcacaatcgccatttacttcacgagaggatttttatatttagacggtatcccagaaaaatggctatctctttttttgataaattttatacacatacaaatgctctcgagcatgatagggagggctgtgcgcaatcgccattttatttcacagggaatttttaaatttatacgttatcccagaaaaatggctatctctttttttgagaaattttatacacatacaaaagctctcgagtatgagagggagggcggtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaaagaaggtctatcccagaaaaatggctatctctttttt

SEQ ID NO: 32450 - DNA, 2141 bp, Heterodera glycines
aaagatttctgttgctcaactccccattcccatttggcctccttcttaagcaattcatccagcgggcctctgagctctcgcatcggtttgatgaatttgccgtaataagtgagtgcgccgaggaatgatcggagcgttgatttgtcggtcggtgccggcattttctcaatggcttctgcccttgatgggtcaggtcgaatgccattttcagagataatgtggcccaggaaaagcgtttccttttgcaggaaactgcattttttcaattgaattcgaaggccatattcactgattttgtcgaaaaccgcgaaaattgttgaggtgtgatcggtcagtgatttattggcgatcacaacatcatccaaatagacgaatgcgcctggaattccggcgatgattttgtccatcaatccttggaaaatcgcgggtgccgatttgactccaaacggcaaacgctggcactgaaacaggcctcggtgcgtgttgagcacgcaaagatttttcgggcttccgacaactccaactgcagataggcatcacgcaagtcgacccgtgagaaaaacttagcgccgccaactgcgttgtagatgtcctcaggtcttggcagtggatgacgatgcagttcgatcgcatcgtttagcccggtcgaaaaatcgatgcagactcgcgtttttccgctctttttcttcactgccaaaatcggagccgcccaatggctgaactcaatcggtttaattgcgccaattttcgaaagacgatcaatttcggcattgacttcatccaatgctccatgaggaacaggccgagccttgcagtagaccggcttcgcctcctttttcaggatcagatgagctctgaatttggtgcaatggccaagttcaggtccaaaagtgttggcgtaattggtttgaagtgccgaaatgagtgacttttcatcactgatttgtgatgaaattggcttcgttggcagtgaattgacgatttgcgacgaatttggaaacatcaattccttcgggattatttccaattcttcaatccaaggcatgccaagcaaatcctggtgaatttcgtcgctgacgtaagcaattaggcttgccgttcgtcctttgtacaaaacttggcatttgaatttgccttcgattgggaatgctttttcattgcaattcctgacggtgatggccgttttgcctagctttggtttgccaagcttttgccatgagtccgttttgatcaccgtgatttgggcagcggtgtcgacattcattgggtgatccatcccattgatttggatgatcacttcccaccatttgttgctgcttccttcaatagccatacattttagcttaattgagacggtgtgaatgtgcgtgtccttcacggaatcagtggccactgcacgaacacgtcggatctctgtgccgcttttgcatgctttcgcaatgtgaccgttccgtccgcatttttcacacgtcgagtttttgaaccagcagtctttttgccagtgacttttgcctccacatgaatagcatggctgatcacgttggtccacttttcctttaggtgccgttgaatttttcggcaggaaattttggcctttgtggctttgctgcggcttcgttttgggcttctgcttgtccctgatttgctgcggtttggctcggatggcactggtgctgcagggatttgagccgagggagagcgcgctttcctttaggatttgatattttcggcactcctctccaagctcttgcagtgaggttgaccgtccgctcgttcgactgtcttccaagcgctgaaggcatttttgcctcagatcggtgaattcgtcccgcaatgcaatgatcagtatcatgcatttgagctcctctttgctcagcgacagatcggcattttcgcaggacgagttgatcaatgcgatcaaactttgcacgtcctgatgcgcgtcttgacgaatttggaaacagtcgaaacggcggagaaacaatgatcgggtttctccgaacaaatgtttcaattttgcggtcgtctcgtcccagttgaaatcgttctgcgtctttggtgcgatgctgtcgcagtaccgcttgtactccgcttcgcccatttgccaatcaatagttggactttgactggtcgctgagtgc

SEQ ID NO: 32451 - DNA, 905 bp, Heterodera glycines
ccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggactgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggta

SEQ ID NO: 32452 - DNA, 1634 bp, Heterodera glycines
  misc_feature (13)..(13): n is a, c, g, or t
ccccccccctttnggccctctcctgattaaaatatttaaaaattaaaaatttttctagcttaagttggccaccgttgagagtgtaatggccgaattgccatttagcgttttggaccgtttgtttttcgtcggagtgccaattgtggacgcagaagtcagagagcgatttcgaagactatggtaattggaaaattataaaataaagattaattctcaaattaattaaggtatgatcggccttattggaaatcatcaggcaattttgaaggggaggagcaaaatgaggagccaaaaatgccaaatgagaaaaatggtttaaataattataatttgaaagtctatttaaattctcaaaattattttactactttttaatggcactttttgccgtgcctttcttttcagtggtcgtcgacactttgccaatgtttttgaatgtgccgcagcccgtcctccatgagcccgtgggacgcgcctcaatccgttaccagcagcaccaaatgccaatgccatcgttcacttctgccgatatgccgcactttcctcccccttcacccgtagcggtgccaatttcgtcgaaggttttacgtaaaaaatttgtttataatacagaattttgctcaattaacggtgccaactagtgtaacaattgacgagcattacaatgtcgcggcaccgccagcagcacagcggagccgcggtctgtgcgcggaatgcaacggaatcccagatgcaatggcatcgctgtccaacattatgggcagccatttggctggcccactaatgccaaaggcaaatgcgatcgaaaacagtgccgacgctgatcagaagaatgaaaatgatcaacgcactgaagtagcagagttggcacaacatcaccaactgaagcatggaaatgcggctgaacggagtcccatcttcaaaatgccaacatttggaaaaggaaaaagggccgatcagcggaatgaacaggacgggagtggcagtgagcatatggttcatcttcagcatcagcttaataagcatgttgaccgagtacagcatttggggacaacaccttttggaggaggagaaaatgcagcggacggaggccggagagggacacaaatccgagtgccatcgtttgttcccgaatcaaacggatcggtgcagcagccggcggcgccaattacgggggaagaaacgggcaacggtaatcactagcaagcagaaaagggatttgttttgaattctcacaaatataccgtattactgaaacagaactccacttaatttgaaccccagcccctgaaataaagtccacctttggaggggggttgaaatttggaacccccgagggctctaattcataagtgcggtatctcatttatgccaatttttttttgtaaattttcctttgttttagtcattttgagcgtgccgagcagtagcgaggccaaaccatcgcataataaaaatgatgatgtcatggtaaagtcaaacggcgacgaaaagttggagcaatcggaggaggaggaggaaaagcggcaacaaattgggaccaaaattggcaagagggaactgctgacaattgacggggaacagcaacggggacaattgagcaccagtgatcagcgcagagcaatgatcatccg

SEQ ID NO: 32453 - DNA, 878 bp, Heterodera glycines
ctccccataaatctggggcgcatcggttcggggggacttccccgaaaacaaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcgggggggactgcccccgaaaacaaaaa

SEQ ID NO: 32454 - DNA, 1591 bp, Heterodera glycines
  misc_feature (795)..(795): n is a, c, g, or t
ctattcccgagggattcggtctccccataaatctggcctcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatctttcgcaaattttaaaaacaacaagcgttggcattttttcaggttaagttagtccttnacaatggagaaggcctgcaaaattgggagagattatatcgattttagtgcgctaggttcgatgaaactttttaaaatataagcctaaactttttggcctgtttaaaaagggattaaaaatttttaaaaattttattcatctccctttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcttatttaaaaaggaattaaaatttttaaaaattttattcatctcccttttgatagaaaaagcatcagagagcctaatttaacttttaaataacatttggtgcgtttcagagcacgttctgaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaagggattaaaaattttaaaa

SEQ ID NO: 32455 - DNA, 2013 bp, Heterodera glycines
gcaaaatttggtgagcccctgatcaatttacaaattatttatggacgatcaaattttttgaaattttttaagtgcaaaagtggtgggtgtcttacagcttaacaaggcccaattaagcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatatttggattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaatgaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcttttgtagtgttccgatacgtatctctgcaaaatttggtgagccactgatcaattacaaattatttatggacgatctaaatcttttgaacattgttctaggtgcacaagaggcgggtgcagagtactattatcaatggtcatgatcaacatcagacaacaacaacaccaaaccggtgctggctttccggtggtagccagtatgctgacaagcattctcttaccaatgttaatggacaaattactgccaaaaactaattgataaatagataaaaaataaatatataaaagcgaaacagctaagagagcactcgtttaattaaacatttagaagagcgcaaaaaatgcgtcacgcaatgcgaatgtttctcgtcccggaggacgtctttcagtcggtatttgttcaaccccaagcagcaacagcagcagcagacggtgccgacggtacaccaattgggcttttgcgctcacgcatccaacaaattgagcgtagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaatgcagcaacgccgccgccgccgcaaacgatcgatcattcaacgccaaaaagattggagaaaaacattgtaccatcagcgtttgggttgaggaggcaaagacaccactacacacaaaaggcgggggcattatcaaatcgcagacctgcccaaaaacaacaaagaaaagcagcagcagcagcagaaacaccaaacagcagtggaaatggagaaacggaaaaagaagagggtgatgtagatgatggggaacagtgggacgacgcacaatcatcatcatccacggcgtcaacaggtggtgtcgcaccaaaaagaatgctcagagcaagagatggggaagcaggaaaaggaggaggaggagaaacggctgatcgccttcaacaaaacacaactaccagatgaccaaaaatgcactgatcacacacattcaaaaaaaggggcacagtctggggagtcagtgatcaagggaaaggttttgcgcacagatggggcccgaggttaaaaacgag

SEQ ID NO: 32456 - DNA, 1306 bp, Heterodera glycines
gacaatgtcaaaaaaacaatgaatttttaatgggtgttttggcaattaactcattaattataagtgaattcaaacccaaaagttcccattttggattttctctaattttataaatattttggtccttgggatggtataagtacccccctccctccctccgtctcattgtcagtctctgtcaaccgtttccccctcccccctgtccttcccccattcactttgaacattgtctccgtccagtggccttccaatgcgccggtgtccaccagcgtcagtgtgtcggtgttcaccgtccgttcgtccagcacaagtcgatccatcaaatggttcagtcgcaattcctgctgagcgtgtgccactggccttgctaagtcgagctctttgtaaagcggcgcgtaaaaggcgcgacccgaccaaatttgggcgttcatattgctacggtattgttggtcaaggatgaaaacggtcgactgaatttgggtggaatttgcacaacaattagtgcaaataacctttcattttagggttacctcttctctgttgggcgcaatttgctgcacaacggaacactgaaaaggcgtctcttcgctatcggcggacggagggagtgcaatcgaatggtgggggtcactgaacacccgcaaaaggggtgcctaaaatgggacaaaatacaatagtggaaagccaaaaattggacaaagaatatggaaaacagcacagaccaacggaagaaaggaacgccaatcctccgcacttttcaacgcggcgacgtcctccaaaacgacggcgtcgaacaaagcggggggagacggaggagaggaggagggggaggaggaggaaatgcggacggagagatgttcaagcagggcgaaaacatcgtcaggagtggcgaaaactatctgaaaagctttaagttaaatttattaacagatttgttagttgctgttttctaaatttcattaaaatttctccctttttaccatgcattttggcttttctgaaggttttacaaaatggcgctgaccctgtacaaatttactcttccatgcagcacttttggcgttgtttggtttattttcttataatgagtgccgtgtcacttacccgtgtttggtgtcgtgccgacggactttccaagactccggcaatcccagaagtgatgtcgttccgtttcggcttctttcgactgatcattttcaccaaactccgtttgtccaatgcttcgcgtgccgccgggtgatgagcataaatgtgccggcgaatgtttggcataatgcgaaacgccgccttttcgtcaaagggctga

SEQ ID NO: 32457 - DNA, 1527 bp, Heterodera glycines
tttctgatcggtcctcgcaatcgcccgcttcggctcccttaaagtgccaatgcaatagcgatgcatcatctccttgtacacctacaaaaagttggaaacaaaataacatatgacacctttttggagcttgtgccatctttttttataattgccaccaaaatgccaaaaataaacgaattcgcaaaaaatttcaatttttaaatgactttccacgacggatggcaccaacctcattgttgcacaaatttttgttggacggacaatcgtcgctcagatcgccgtttacccgagcggcggctgaatttaaatttacataattaaaattaattagaatatttaaattaatatttaataaattagaatattgaaattgatataataaaataataataaattggaatattttaaaataagtttgtaaagaataaaaaattaaaatatttataaaattcaaaatttttatgccttttcattaaactattaatattaaaaaaatagtttaattgaaagttaattaattaattaagaattttttagccgcctgaaaattcaaaaaaaaaattaaataaaattaaaagtatttccgtaaattaataaaaatatagtattaattaataaataatttttatagcattttgtgctcaccgcccccgggttggcccgtcattgcggtcacagcggcgctcactttgcgcgtgtactgctcgcaaagctggttgttcgccgggtcgttgcacgtcaacgcgcacatttcggccgcgtcggcggacgcacaaaggcccgattcctgtagaaagcatattagcctaagataaatctaaagatattccaaaaaagattctcaactttttgtctaatattcggggagttttcgttcaacagtgccaaagccatttttcaattttcgatattttttgatatgggctcaactttcaatttttttggcaaaatgccgtcgccatctccttcaaatccatgcattgccaatattaaaaattttgacaataaaattttgacaaatttggcaaaatgccatcacacccatttattttttggcaaaatgccatttgtccttttcaaatgccattgttcaagtgcctgctcaatttctcagcaaaatgccattgccatcttcaaattaggtttttttattattgtcattgccagcattcaaattttgagttttttttttttgctaaatgccattgccactattttcaaattcgtcctcattcccccggccaccttcagcatcatacagttgtcaacattctccgtatcgtcacaatatttggtttgctccatgctgcgcaaatagtccacgcatcgtccgcacgtgcgcgggcacactttgaccgcaaatttctccaccgaacaaagggacggattgcacggcacttggggagtggtcgcctgtgccgactgttggtcttaaaaaatggcacaaaaaattgcgattacatactaatccaggagattggaagaggttgtgccatctgagggattttcttcattttttgaaattat

SEQ ID NO: 32458 - DNA, 933 bp, Heterodera glycines
  misc_feature (918)..(918): n is a, c, g, or t
  misc_feature (931)..(931): n is a, c, g, or t
ggaattttccagtacgggtttgtccgtgaaaatttgaaaaatatttccaaaaatccctatttcttttttctatccttgtggactgagtcggcccttgaaattatatagcagtgaacccaatacttccttggaattttccagtacgggtttgtccgtgaaaatttgaaaaatatttccaaaaatccctatttcttttttctatccttgtggactgagtcggcccttgaaattatatagcagtgaacccaatacttccttggaattttccagtacgggtttgtccgtgaaaatttgaaaaatatttccaaaaatcccattttcttttttctatccttgtggactgagtcggcccttgaaattatatatcagggaacccaatactttcttggaattttccagtacgggtttgtccgtgaaaatttgaaaaatatttccaaaatccctatttcttttttctatccttgtggactgagtcggcccttgaaattatatatcagggaactcaacactttcttggaattttccagtacggggttgtccgtgaaaatttgaaaaatatttccaaaatccctatttcttttttctatccttgtggactgagtcggcccttgaaattatatagcagtgaacccaatactttcttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccattttcttttttctatccttgtggactgattcggcccttgaaattatatagcagtgaaaacaagactttcttggaattttcccagtacgnggtttgtccgtgnaa

SEQ ID NO: 32459 - DNA, 999 bp, Heterodera glycines
  misc_feature (918)..(918): n is a, c, g, or t
ttcatccacgcccccgtatccttcgtcaatgaaatgaacgtaagcaaactgataacagcgttcactacgcgcattcaccacctccaccaattgagtaatcttaatatatattaggtaaatcaatttgaatttattttttgttacatactcttcctcgagaataaacattttccccaagcggtgccatcacatatttataaagttggatttccgaagaaaagggcgacgaagagtaagaaccacactccttcgtcctcactcgaagctgtctcttcagattcgtgtcttctcttgtttcgtgcatcagttgaatttattaactccaacgcactcaacggctcgctaaaatgagagactaataaaattgattttaattaatgcattttacgttagatgaatttgcagttgatccgttatatgattgtgcagtttgaaccatacacagttgggtgattgaatgtgagccaacttgcaaattgctgatgacccagaaagaacaatacgatgaatctgactatttttttacaattcaatataaagacgtagtatatatgtttgtaagattatttaattaaataacacaatttgccttttcctcatccgttatcaattcacgctgacgtcagccaggtccttccaaacgcttaagaatcggagaatttgaccggttacaagaagacattccagcactttcactgtttaatgagcccgatttttggttctacagtctgttaagaaattatatgtaggtccaagaattttttctacttcacagatcgttttcgcgccagcccgaaggcgccgctcggtaaaatttgaaaatttgagtgtggtttgttaattaacagattttgcaccaaatacataatgccataaattaataaaaaaaaaattgtataaaatttcaaaaaactagcnggggtcagcgccttcggcgcatcccccgctaggcagtacgattgtgttatagaattaagaatgataaatcgactggttcgg

SEQ ID NO: 32460 - DNA, 1075 bp, Heterodera glycines
  misc_feature (967)..(967): n is a, c, g, or t
  misc_feature (983)..(983): n is a, c, g, or t
  misc_feature (996)..(996): n is a, c, g, or t
  misc_feature (1055)..(1055): n is a, c, g, or t
tcaatcggttggtctgatcaattaattgcattcatttgttgcgtttcctttgcattgtccgtttttgccaagatttttgcttttcgtccgttttttcagcttttccttttcccttcccaaaatgagcgcacatcaaagtttgcttgataagctttccgatcagcaacagaacaaaaaggcggcgccttcgccttcgtcgcccgagcgaaaagtgtcgccaaatgcatttccaaaaatggaaattgaaatggccaaaacgctgtgcactcttccgacgaatgtgcgcgacgaaatggcagaggtggaaaaaacggggagacaattagcaaaaggggcagcaattagtcggagtcaatggaccaattaagggacaatctgagagagggggagatgatcattctgagggcatggaataaacatttttgtaatttgtcagccaaatgtcaaagaggaagagagcaaacagacaaaaagcgaagggatggaagtggtcaaattgggagaatgcgagcgcgacgacggcatctgtcggtaatatgattgtgacttttttttgacttttttatatttttgggatttttatgaaatttttgcacttttttttgactttttcgtgactttttaaggcaaaatttggattttagtgaagaaaattctgaaaaataaagataatgcaaaaaagtccatgaaaaaaatagccaataagtcgcaaaaaggcaaaaaaaaagcactaaaaatgcaacaaaaaaaaagcctgaaaaattaggcaaaagttaaaaatcccattttttaacaactgtattagttgattatttataaaattttactgcctaaaaacccgggtctctatttataaaatgctatcctataaattgttgaaaaatgggattttttaacttttgcctagtttttcatgacttttttgcattttttcgtgcttttttggcgttttttgtgacttttttgnggatttttaatgactnttttagtcgactntttggagatttttcgtggcttaattctcagccctataaatgacacagcgaatcactggncacaatttaaccagtaaaaa

SEQ ID NO: 32461 - DNA, 1102 bp, Heterodera glycines
  misc_feature (95)..(95): n is a, c, g, or t
  misc_feature (104)..(104): n is a, c, g, or t
  misc_feature (111)..(111): n is a, c, g, or t
  misc_feature (145)..(145): n is a, c, g, or t
  misc_feature (1058)..(1058): n is a, c, g, or t
aaaatggctatctctttttcggccaattttgtacgatcaaagggaaaaatgcttaattcaggccccaatgtgcgcctgaatcgctaattagctgngcacttcgnaatatancatataaattagccctctcaaattctccttcggncctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaatttagtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccgattttgtaccgatcaaagggaaaatggcttaattcaggccccaatgtgcgcctgaatcgctaattagcttggcactttcgaatattacatataaattagccctctcaaattttccttcgggnctcagaaaatggctatctctttttcggccaattttgtaccgatc

SEQ ID NO: 32462 - DNA, 1896 bp, Heterodera glycines
  misc_feature (1079)..(1079): n is a, c, g, or t
  misc_feature (1113)..(1115): n is a, c, g, or t
  misc_feature (1147)..(1147): n is a, c, g, or t
acatttcttttatttttataaaaaataaataaataaaattgcatggaatacaatgagcgtatttgtctcctgcttactctgtgtgatgctccggagtaaaatttttcaattaatccgcttcacacaaattgacacttgaagaccagcaattaggcacagcaaacacaaacgaattgaaagtccaaaacacagacaaatttattaaaagtgaagcacaataataaagaaaaaatgggaggcgatttgagaaacaaaaatatccaaaatcacaaaacaaaaaaaaccaaagtccagaagtcccaaataaataaaattttgagataagaccaaaaataacgaaacaaaacgccaaaattataaattttttaagaaatcataataaaaaatttggtggctagtagagaccggcgcgggacggattccgcgcgggattttgcgggatcccagtccgcaaaaaaattttggattccaatcccgcagcgggatccgcaaatttgaaatttccggtctctagtcgctaccccataatctgaatattcttataaccagaacatttctgagaaatcagaacagagcgagcacagtgctaatggataaatcaattaaaaacatttaaaaaattgccaattttaataagcgccaaaatttttaatagcattgagaaaccaagtgatatttgaagcggatcaatttcgactgatcagaatgtgcatcctgtggtggacaattgaaaaacgccctcattaggtgcaacgtataaagtcactccatgtgacaatttatgtggcacaaatatacgttttgaaattgtgcaattcaatccggcaatcggctggatttcgcagtgatgtggccctggaaatttaaatttttaattatatgatcgatcgaaatttttctgcttttgcctattttttcctgagctcccattgacctgaagcgcaccaaaaacatgttttttggtggttgttaagctacttttcgagttattagggcctattttctaatttttttatttttagagccaaaaagccaaaaatatcttaaaaagctatttttgcctattttggcgttatgcncaaaatttattagtaaaaataattttgatttaannnaattatatatattcaatactcattttgctttngctgctttgaataaaaatttgtccattttacaccccttaaatttgagcttttttgagcctcttttccactttttagtgcctattttatgcatttactcaattgaaaaacaataataataaaaatactgataccatttttcaacgaaattattcttacgggaatattattcatgaaaaaaatgtgagacaatttttagcttttacaaaattttatgtttttaacagagtgttcttcaaatcttttcgttcattatgagtttattcattatttttacctgggcattccttcagcttcccagcagcccatgcaatcatgaattttgaatagcaatgcgagaattgtctcccgtaaaacacttgcatgggaaatttacgaaaaatttcagggtgttttttcaaaatatttttgttaaatcgttcactgattcgttttgcatttttttcattgatataaaggttccaccaaacacccgccagagggtcgtcagctttctgtaattcaaatttatatttaaaaaatttaatataaaaatgattaaattttaattatagcaattagttttcctaccagttttatgctcatgtatgcttctgtcggtctcaattcatcaagctgaatatgagataattttgggttatgaaaaatacaataatttaatgtgtgccctatgagactcgagattttcagtttttctgcgattttgtttcgctaccaaaaattaggttttgcaaaaattggatgtcaattt

SEQ ID NO: 32463 - DNA, 1547 bp, Heterodera glycines
  misc_feature (1515)..(1515): n is a, c, g, or t
ttagtaaactctaataatatgtacataaaaaataacaaccttattgaataaaaaaaaaagttttgagaatatgcaaatggaaaagccattaaatatttaaaattccggaaaattttttgaatttactatttttttttgcctgttcgaaaactgcgggatggcggtcgaaaaagtattcgttaagcattgggtcgtagttggactgagcgggcgtcagacgcgacaaccgagtggcggggatcttcttcagagtggcctaagaagaacaaattcatcaatttatttcataaatttgtcaatcctaacaattttttgattcgaataattaggacaaatcccaacaaattatggcattggcatatccctccggcacttcctttacctggtacgtctcgtgccgaattccgccaacgttgagcaccactcgctcgtccatgcacgtcaccggcgacactgacaataattaatgggtgcgcgaaaataagtaaaagaaaaaaaataaattatccaaatgcactgctaatacggtaaaaaaaaaaggagaagagtgacaattaggggggatacggtattgaaatgaataacaaaaattaagctaattctgatggaattagcaaagagtcgtaaaaataatgttaaaaatgcaaccttttacttgccaaagccaaatcaataatttaattaattaagctgttggttgaaaaggcggctaaggccatttcgggcaataaaattctcccaagagaaaaaaaacccattaaaatggtcggccggtgccattcattcattcattcgttgttcattcggttttttcaattttggacgtgcggcatttcccccccccccgccgatggcattgcttcggcgatgaattttttgcctacgggggaatttacatcattccattgaaatggacgccgcccggcaaagcacaaaaccattccaaaaatgggccactcaaaaaaaagatggggggggggggcattttaatggaaaattaatttatttggaagagagagagagcaaacattttgagacgatttggattaccattaaaaattaaatacacaataattatttaaaggatgttaaaaaataaaaaacgatttattttatttgggaaataatttccaaaattttttaaaattaaattattttttaattcataataaattttatgttccattgacctgggagttgtgctataatgtattacaacaatggcacattaataatggtggtaattaattgctgctgtggtttttttgatggtctgttgatccgccgccgatcgcccgtcactcccccaggggacaaatgccaccagcggagttggccgggggacagctgtcgccaaattttgcttttggcaaagcaaaatgcctttaggagagtgggggagagggaactaaaagcacccagccaaaggtcgaaataagcaaaaaaattcattttcaaaaaaaaattaaaataatgacgggttggaggaaggggaattaacaaatatttaattanataattcaaaaaataaataaacaaataattta

SEQ ID NO: 32464 - DNA, 608 bp, Heterodera glycines
tttcagttatttggtgataaatatgcctctaaatgctcttgaaaatgtcgttatgaccagcaaaatatttcctcgagagacgtccccctctcccctccccctcccccctccccccccccctcgcccatctttgagaatcggattagcccccaaaaaattaaacagaaaattgaatagtgacggaaggagaagcggtacttaagcattgttgattaaatcaataaaccacaattaaaattgtgtttttttattaagtgccaaacccaaattggataagtgaaaggaaagggacaataagggaaaactaatgatgaaaaatgatttgtacaaataaaataaaggaaaggcaatgaaaagaaaagggaaaaaggaaaaagttggcaatggaaagggaaagggaaaggcattggtgacacggcacgaattattgccgaggcaattcgggaaaaccggcggaagaaaaagggcaatcggaggaatgattggaggggggggggggagtaaagtagaagtggcacttatggggagaagcgcagaagggcaaagacgaggcaaattggcaaaaagaaaaagaaaccgaccgaacgaagagaaaaaggggaaaaagg

SEQ ID NO: 32465 - DNA, 1085 bp, Heterodera glycines
ggggacctctagagcggaatgcattttcggtcaaattatttctataattattgactctatataattttaaataaataatttattaattgcttccacctctgcagtacactgattgccaaagaggaggctctttttgggcggatcactgctgcttcgtccattgtctgttctttgcgatattttccattcaaatttggcatcacaaaattggcataattttgctgcgcggcacttaacaattttttcaacatctatataattttcattttatataaattataactatgtttatcttctgtttttccctacaaaggtagaatttcagaattttaatatataattaaattctgaataaaatatttaaaaaaatcttatggcaggcataaaacttgtaaacaaattagcgctgcatgaatttttttttaaaatgattgcccgagaatttttgaggcaccttcattctcactttctgatgtataaattttaaaatatcagtttagccaccattcggcgctgtattcgctgccactgccgtgttgacgattttggtgcacaccgccagcaaattgcatgccattggcactgatgcgcggcgtgctgggccgaagcgacgcgatacaacttccaccaacctaaaaaatgaaactttggagttttagcttctaaaattaaaaaaaattgcactagaaaaaaagaaaataaaaaatttttgaatttattagtcagagcttttctgaaatcaaacctaaggaaactttttgtaagctatttaaataacactttgaactatcgaatgatacaaaataaatgtaaatttggttgcttctgagcaaaagtattaagggttttcaagaaaatttaaaatgacatgtcttcatctcccgtagatctctataattatttaaaagacggaattttaaaaataaaaagaaatcatgaaaatatttattaataaacgattagaaaattactaattacttaatataaaaattttaaattcgaatttcccacttcgtcatgcagcaatgattgggttgaacattgaaaagaatttgtgatcagtcgaacacatcgctggcgaaagc

SEQ ID NO: 32466 - DNA, 1374 bp, Heterodera glycines
  misc_feature (354)..(354): n is a, c, g, or t
tcccgcaaaaattttttgagttccaatcacacagcgggatcagttaacttgaatttccgagctctaactaaagccaaaattttcggcacttttgccgtcatttttccaaaattggtcatttcccacacttacaataattagctctgtccaagtgagtccccatttttacacaattcactcccatcgaaaatagcagccccatccccaaactctcacaacgcatattcccccccccgtgccttctttccattctcttaaaattttgttcctcaagtacccccccccctcctccggcacctccaaataataattattacttttagtgtttgcccctcaaggtgtgccctccccccncccccccggggggatgggtccctctcaccctctctctctctctgtctgtgtgtccatccaaaactcgtcaactttgtctgtcgcgacgacgtccttcgactgatgagagtgaatgagtgacccccccccatgcccaaatttcgtcccctcagtcgccccggggcgaattttggctggggacgacggagtccatttggaggggagaagaagcggctttacatatatactttacctttctcaattggcaggcttcctcttttgtatgtattgtaatttgttgatgtctgaaaaggcgtcactcaaaaaaattgaaaagtggcaaatttttgggtatgccataattggtggatgttcaattccaaattttcaaatgcggcaactttaatggcgactgattgatcagtcagtccatgatctaaaaaccgataatcctggaccaacaggtgaacactctccttggtcaaactagcaattccggccagtctgatcgatttgaaatgattattcagcagttcctttgtttatttgctcagtgacttctttccattttcggaacactgatcagttcattattcttttgtttaatgatcagtgacttcttcccactttctgaacactgatcagttgattttttatttttgtgaccgatcagttgcttcttaccagttatttctttgttttgagactgatcaatgggctttttcccattccaatcactgatcagtgtacgtttgctgtctcgcttctctcattaaaccattttcccagttggcatctcaacaactagcagattaaacgattaatcctaccttacccgaaatctcccgtttgaattttctgatcagtgatttcacggcttttctcctccattttcccccacaaatttcaccgtccgtccgtcgatgccattaataataatgaaaattgcatatgcgcatgcctctttccgcaacagcattttcaccatttcatacgcaatgacaatggatgatgaatgggcaccgattggggggggggggg

SEQ ID NO: 32467 - DNA, 774 bp, Heterodera glycines
ggaaatcagggacggtcccaggattttggcttggggggggggcacctccccccgggcgacgaccttttttttttttgcttttcacacccgttttttatgtagcgcggtttttccaaaaaaaaattttgggggacagggggtccggcggtgccgataggcgccgccgggaaaatttttgcggttttaaatgcggtttgttaacagattttgtccaaaaaatgaccaaattttgtgattttgagccatttttagcagattttcattaaaaatttgtggattttttgaaaaatttagcgacatttcttggaaaatttgggtgtggctaggtctggggggggggtaccagcccagcaaggaaaacctaaaattttcagccaaaatattatttttccttaaaaatttttggacccgggggggtcttggcggcgcaactgtcgcggcgcaagtgtcggcggcgcaactgtcgcggcgcaagtgtcggcggcgcaaacggcagcggcgcaagtgtcggcggcgcaagtgtcgcggcgcaaatgtcggcggcgcaagtgtcattttggctgggcggcgcaagtgtctgcggcgcaaatgtcacatcaccttttctttcacaatcatttaactcttttcaatctccccgaaatgtgactgacaagggaaccacccgaactgtaagtcggaaaatgcatatgtgttatataccattggatagagcagggtcgacttctattgtgaattcttaatattacgcccccataggaagaaatcaaaaag

SEQ ID NO: 32468 - DNA, 1443 bp, Heterodera glycines
  misc_feature (1331)..(1331): n is a, c, g, or t
  misc_feature (1355)..(1355): n is a, c, g, or t
  misc_feature (1377)..(1377): n is a, c, g, or t
taaattgtatattgttcactgccggattgtccgctcctcctggattgtccagtcacgtttttgaggcacaaaaacttctttgccaaaaaaactgtttttgatgaaaaagaaccccaaatttaaaaaaaatctccaaaatatttaacccaaaaaatttttttatctgccaaaatccataatatttgttaatgcgaagttttataacagcaaataaatgttctaatttattatttttaatgaattttaactcaaataaataatttttctcagagatgctttcttaccaatgtataaaaattatgtgttttctgccaaaatacgaaacacgaaaaaatcaacaaccatgtcttatagctttattaaatttgacaaaatttgctacatcataatttagcttaaacataatcaaattaaatcattcttgttattgagtgactttacatgtcctccattgtattataattttttataatctagcaaaaatttacaaaaagttataactagggcagcaacttttagtgacgaaaaataccgaaatagttaactaaaatagtgagtaaaaatcccaaaatagtgaagaaatagtgacaaaaagtccgaaatagtgacgaatagtgacataattttcagccaaaaattgagcaaaaaattttttattcactgattgcagttacaaatgagatacatttcctttataaaattctcttagcaaatattgacattttttaaataaaaaattttgtcatgaaaaaaaatttgcgggaagaatttttgagaaaatttttcatttattaggtgtgaattttcaaaaattttcgaccgtttcttaggggtgtatttttttgaaaattttggggtcgattcttagggatgtattttccgtttttattgcatttttgttgagaaatttcccaaaaaatgtcgaaatagtgacaaaatagtgataaaacgccaaaatagtgatttttaactattttagtgacgaaacgccaaaatagtgatttctagtgacgaaaagtgacgtccaaatgaaaaaattttaacgcagaaatgcgttttttgagctcctttcttcaaaacaattgagcaaaaaaaagttttttcactaaaaattgctgccctagttataaccaaaaaattcagaaaaattttgactcactaattttgtcgctaacttttttaaaattcaataaaattttctgaaatttcacagaataataaaaaaaatctttgggctatttttcgatcaaggtcggtgtgaatttaagtttgaaaattttatgcatttaaacgaccttacattttttgaggaccatttaaatatgacactnattaatttgtttataactttttanagaaagaacaatttttaatttntgtttagaaattttaacaacagcaagccgagaaaaagagtgttgccgagcaatgagacgaaatgat

SEQ ID NO: 32469 - DNA, 1214 bp, Heterodera glycines
  misc_feature (214)..(214): n is a, c, g, or t
aggtaattagccagtttatataagtagccatagtcacaaactcaagcgttgtccattcttcgtgaaaagtgcaaaacacttggcgcgttgccaaattcagtccgcaaccgaccacatcgccaatgtgaaatgagggcacattgtccgaaatgattacatcatttccattggcattttggccttcaattctacgataatttgcataaccgtatgnaaaacagtacaaaatccaaccaaatagtccaaggacatttcttttgttggtagtccaatgagcaaaatgaatagacaaaattagagatcggaccggtcggttcttttttccgtttttttccgtttccgttttttaaccgaaaccgaccgaccgaaaattttttgagtttttcggtttttttcggtttccggttttttcggtttttataccgaaaccgacagatcgaaataatcaaaaaaccgaaaaaaccggcggacttttttcaaaaaccgaaaaaaaaaccgaatcaaattggagcgatataacctgttaataataataaatttattgcttttttgtgctctttttcattttgaagaattttttgtaaaatattttctgctattttgaaaaaaattattaacaaaaatgcaataaaaacgaaaaatacacccctgagaaatggaaaattttatcaaaaattcatattcaaaatttatttatttatttacttgactacatttttgatttttaaaatatttatctcatttccattttgattaaagtgaaaaaaggaagatttcaagcatttaaagagaaaatttgacattttgccccccccccccgaggggtcggggagcggtgctacgtcatttcgcgacaagtgcaaaaagggcacttcgcgacagtgcaaaaattgggcacttcgcgaaaaatgcaaaaattgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaattttattaagcaaacgtaaatattttatattggtttttaatttactcttttaactaattatatttgaatatgattaa

SEQ ID NO: 32470 - DNA, 1220 bp, Heterodera glycines
  misc_feature (1202)..(1202): n is a, c, g, or t
agttcgtgtgtttaagtaagacaaagcaagcatatcgacaaacgattgtcatcaaacttttttcaagtctaccgaattttaaatgattgaactcattagatagttcattactttttaaagaaagtgatcctttttgagtttgggacatagctgataatgaatgaatgatatttattttattctgcactgtctttgtatgaataatatcactgaaagtttttttattgggttcccggtgatttagtagtcagctaagtgttttcgtcattattagatataaatacatttgtctgatgggttctggcgaaagcatttactaaaaaatcaacaattgattggaatcaaaatgataaataaattcgtaatacccctaaaaatatcttgttttaaacataaatctaaaacaatgtttaaatttttcaggtgttcggatatgttaccaccggtggtcttttattggtatcaagaaatataatatgaaataataataataataattaaataacataaatcataaacaggttcacttccagcacatttgtgctcggatattgtgttccattggtgcttatcatttatttcaattcacgcctaatccgaaaactgtacaggcacacaaagtgtgatgtggaaattatagaattgtttcttttcctcaaacaaatttaatttttaagacagctcagaagtggaataccactccgtcaaatcactatatatacatcgtattttaatattttaatttataaattaaattattatttttatttgagtctgatcgccgctttgtatttcatttgttggactccatattggtgagttaacattaataagtttgaaattgtatcaaatttcaatttctaatataattggttattaaggcggatttcgcaacataattttcacaaaataaggaaaatttatttgaaaatattatcgtcaaaatttttttctaaaaagtaggcgaatttatgtcaaaaataagccaaaatttgttttaagggaattatgacaaaatttttctctcacaataaaattaatttgaatatatttttttgattgtttcaaatgtccccaaatttcttagtttttcttccctgaaaaaggttctaccttcgttaaggtgcactgttttatacgcaatttggatgagcgcattcgctgaggatggccattcagagtcaacatcagacatgctactngtcatcatttactgtctt

SEQ ID NO: 32471 - DNA, 785 bp, Heterodera glycines
ttgttcttatttcttaaaattattcaaaaattttgaaattttatggcgaaatgtcactatgtatcaagaaaaaatataagatttgtgtcaaaatttggaatttttgacaaaaatccgttaacaatcgctttaaaaatcgcaaaaatttggccttttttggtgaaaaactattaacaaatcagaacaaaattacaaaaaattttccggcggcgcctatcggcaccgccggaccctccctcttgcccaatacccaaaagtttttttggaaaaatgcgccgcaaacaaaattgttaaaaatgggattttttgatcccgaatgctctgaaatgtacgatttgcttatttcctccccaaaattgttaaaatcgataatgggaggcgaaaaataatatttaatacatttttggccgaataaattgtaaaaataactgatttgaagccattttgcaaaatgttcttattttggactctaaaattttatttttttgccttgatgttcttattttgaaaaattttcgatcgaagccctgtatttttgagcccttttcttcattaaaagggcaaatttgcaagtagcgcccgcatttttcgacggtgttaatgattcttttttattaatttaaagaagtttagaaaacccctaaatgatatgtgaagagaaggaagtgagagagtttcgatgacatctgctgaacactcaaacttttgggcttaatttctcagtgatttttggggtgtccgaatttaaatgatttaaaaaaacaaaatccatgttgatcattata

SEQ ID NO: 32472 - DNA, 1435 bp, Heterodera glycines
  misc_feature (97)..(97): n is a, c, g, or t
  misc_feature (117)..(117): n is a, c, g, or t
aatcatggagcaaataaacctttttttgctgccttttttatttttttgaataaaattttcacacttggtgttagttccattcaaataaatcacaaanaatgtataataaaatttttnttggcaataagcaaagaaaaataaattaatggaagaaagttgttaataaaacttaataggaagttattgatatctttatttttttagtcagtacaaatttcagaaattgttaaattatttaataatgatttgattacaatttctataaaataccaaacattttatttaatttaagataataaatttaagtcattggcaaaaaacaaaggaaactgaaaaataaaggctaactgtttcaatcaaattctaataatgttaaactatttaaaaaggtaattggacgaactaattaatcaatgctataaacatggaaaagaaataattaaaacgagaaagctcattaaattaaaccaatataattaaataatgattgttaagaattcccagaccaaaattaatctagagcacaattaattctggatttaatggaacatataagaataaattcaataatacatctttaaccgcagaagtaattaaaggcacaaaattcgaaaaaattttttacatttatgcgtatcaagtgaatcaaaatgctattcttaaagtactataaccttgaaatgagtaattttaataaatttttgcaattttacatttctacaaatttgaatttatctgtaaaatttcacagtcagatgccaataaaatattgatggtaaagaattccacataaattattaactattttttcttcttatgattttcatttttaatttttgttactcatataaattttttaaattaaatagttgacctttatttatataacccaatctttgccaaagtattcaattaacaaaattttcatctgattatgtaaacatgaaataattttctcaattaaactttttcattaaacatttaagtaaattaattaattatttaatttatatatttttcatataacttcagcaggagaattttatgagcaaaaaatttttagatatatttttaaatttagtttataatttttatgtattcatgcttaaatatttttttgctttaaataaattttgtttgtgatataaactataatagtcaattgcaaaaatagacattaagatcatactttagaaattttcagttaaaaattttattttgactttgatgtatttattcgattctgatgtgtaaacttgattgaaattgtttattagcaatttccatgataaagtaattcagcctaagcataatttaatatatttattaattataatcgcttatgtaaaaaaatgcagaaagtatatatttaagtatttgtcttatattgttattttatttaggtattatttctgaatgaagtattttatgattt

SEQ ID NO: 32473 - DNA, 989 bp, Heterodera glycines
  misc_feature (959)..(959): n is a, c, g, or t
tttttagcaaaatcaattcataaatattttttctgaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataagtattttttcagaaagtgctctgaaacgcaccaaatgttaattaaaagttaaataaggctctctgatgctttttctatcaaaagggagatgaataaatattttaaaaatttttaatccctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttatttaaaagttaaacaaggctctctgatgctttttctatcaaaagggagatgaataaaatttttaaaaatttttaattctttttaaataggccaaaaagtttaggcttatattttaaaaagtttcatcgaacttagcgcactaaaatcgatataatctctccaaattttgcaggccttctccattgtaaaggactaacttaacctgaagaatgccaaacgctttgtgnttttaaaattttccaaaatctgactttttc

SEQ ID NO: 32474 - DNA, 1322 bp, Heterodera glycines
cgcgcaatttgatcagcaactgtcgacgcaccaattgatcagggttaacgagaccctggcaagaatgttgagttaaaattttaatttctaatgatttcctgaaaatttttgagattttgcgagaatgagtgtggaataaaagatgagttacgaaaaaacttaaaattgccaaaaattaaaaatcaataaaaaatccaataaaatgtttataaaaatgcatttgcaagaaaattaattttaaaaaatttcaccttgcatttgggtcatattatcaaaaattaggtgctgttctgtttaaaaagatatgccacacatttcttgagtcaattaaatttatgccaaaatttttgtgccttcagcagatggcacatttgctgcttgctgctcacctgctcctccaccttgaccacctccaacgagttgcgcacattgtccacatagtacaactgttttgacatccaatcgaatgccattgagaccagtccgtcgttgtgggtgaccagaattggtgctgccccttccccgtccggcttcacccggtacagcgtgttgtccatgatgtcggcgtagaagaagctgtaaatggtttttatggtgcgcgaagtgtgctggtttttcaaaaatatcttaatttcggcctagttttttttgatttttgataaattggctaaattaaaaattttttataaattcccaacattgataattacctaactgttttatacgaaaattttagataaatacgtaattctccgtaaccctaatatattatgattcttgatcaatgcgccctcaatagtacaacctaatacggtgcaaccctcgattaaattacaataatacggtactatagttctcgatcaatgtgcaaaaaatggcataattctcggccatttcgccctaatatggtataattctcgaccttgtatcccctaataatgcatattctcgtcaaattcacattaataatggtatagtttcgctaaatgcccaatgtctcgcccgctaacctgcccccgtgtacgtcacattcaaccgcaaaaaagtagccaatgcgacgctgtgaggacggcgaaattggcaaaattgcttccgccaatgcgttctgcatgatctccgggtaaatggcacgcaccaccttgttgctgctgaacaacagatagtccatggccggcacacagcgtttgccgtccaccaatttctgtaaaaatgtttatagcatttggaatggattccatgcttttccaggataagtggacaaaaatccaggaaaatactgaccccaaaaaatccaggctcttctgagccaattgaccgttcct

SEQ ID NO: 32475 - DNA, 1059 bp, Heterodera glycines
tgggataacctctaaatataaaaatcctctgtgaaacccccccaagattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaatttctcaaaaaagagatagccatttttctgggatagagtataaattaaaaatccctcaaaataaaggtctattgcgc

SEQ ID NO: 32476 - DNA, 1015 bp, Heterodera glycines
  misc_feature (915)..(915): n is a, c, g, or t
agtgggaaacatgattcaaaaatttcaatttttttctagtctaatttactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattgnggaaaaaaagactttacaaaataatacccctgggagaagggagtgggaaacatgatttcaaattttcaatttttctagtctaatctactcaaaccggttc

SEQ ID NO: 32477 - DNA, 735 bp, Heterodera glycines
  misc_feature (549)..(549): n is a, c, g, or t
  misc_feature (574)..(574): n is a, c, g, or t
  misc_feature (581)..(581): n is a, c, g, or t
tacagagaattgagaccagcggattcagtacgggcacccaatgcatcggaagggtggcgcacatttggacagccaataacgtggagacgacacttcaaatttgaagaccaacaattgagcgctgaccaaaagattgataacattgacaatcaatggcaaaagtgcctgaattttagacaaaaaataaataaattttgattttaaatatcatttaatttgtaaaaatacgataagataaatttctgaaaattggtttgagtaaaaatacataaacacataaattttttgcacaattttggtattttttcaaaatttttcgatttaggggcgcattttccaaaaattttccattaggggtgtattttcggttttttttttgcaattgcagaaatatggatgcaaaaaatgtgaaaagtatggaaataaaaagaccctataagcatcggtgtaccgacatttgcgccgcgacttttgcacctcgacacttgcgccgcccagtaaaaatagacatttgcgccgccctacaaaacccatttgcaccgttcttanaattttaaaataatccaaataattntatttanactataatctacagacattaatgtgcctaattaaattgccattatttttgcttttcttagcattaaatttgcctttggtgctgatgcgcgcagtgaaaaaaactatttgtcaatcgttgtaatttggttctttgtattcctttattgctttttt

SEQ ID NO: 32478 - DNA, 1139 bp, Heterodera glycines
tcacttccaaagagtgttcttgttcttccgcatttctcgctgcttccgtcctctttcacaacaaataattttgtgcccttcagcgtttgctttttcgttgtcgccgttgttgaacttccttcggttggttcttccaaatcccaccattcctaaaatcgttcaaatttaaactgttaaatcgcattaattaaaattcattgctcgccttgggagggaaattctcctccccttttcgtttttcgccttcttcccattcgaattccttctccggcacttccacctctttggcactctttttcccgtcctgcggttcgtccaaactgaagtccaaattcagcaggtcgtactccgtcagaaagtcgtcgttcagtgtgtcgtattcgctgacagtctcggcttttctcggccttcgcttcatcggcttattggcgcctgctgacagtgaatgagtgatcaagaaggtaattgctcttaatctctgatcagaaaaacgacctttcggttgcaattcgccggtgtttccaatgtccaaccgatcattcattggaatggttgtggtccgtctgatcggatttttcaggccctctcggctccaaactgactgggccaactccggctccaaaatgctgaatgcgtgtctcaaatggcccactttggccccgtccgacctctccggcatgtcgaatccgccatcgtccggcaatcccgagatgggttgcccacttctgaccacaccggtgagcaacagcagcggcagcagaacggggaacagtacatgaaggacagcctcatcggaccaggaaatttggtgtcgcatttttggggaattaggtcagtgtgtgagcccacagcccgggggctttttgctgctgccgcgggcgatctccgccgatcatttggacttccctagcccacccgacggtgcctttacacatcgatcggaggacaaaagccggttgttcgcctcgtcggggcctggatattggacggatcagcgaccgaccgatccgatgcacacaccgccacactcattagccacgtaattcacaccaattgctgctgttgtggcgatgggaacggtccccgccccttctccccctcccctccccccggccatccatcattcgaaaaaacaaagc

SEQ ID NO: 32479 - DNA, 968 bp, Heterodera glycines
cattaaatagtcacatttggcaatggatgaaagtgtgcggtcggcgcttgcagcttcagtttggcaaaactgcttgacaacatttgttgcggaattcagcaaatactcaagctaaataaatatgcgtattaaaattttacatttaatgtgtttagttttttaaattatttaataattaaggattatgaaattagtagagaccgacttttagggtatgcctttttatgcgcattagttccgattattgagcataaaaaaacccattttcccttctacaattgacttttattatgccttttttggcattttgccgtttcggtgccctttttggcctttttttgttgttgttgaaaaattccattaaaaatttaataaaacaggaaaatacacttctaagagaattttttaatttaaacgattcattgaataccgtatatgctctaattatcaccccgggggattattattcaacctcctcagaaagggggggattattagatacggaggataaatggagacggggggattattttaaaagaaaaatgactgaatttttagtttgtgggttgacaacgccattggactgaacgggagacgaaaaaatagcttgcttcaagccgaaaggggcaattggaccgataggaagcaaacttttgcgcgagtttagggcaactgaaacgatgaaagatgggcgaaatgatcacgaagaagctggcctatctgatgatgatggtgatgtagagttcgatcaagtcggagatgaggacgaaattcttattttgttagcgttttttctattgttttttttaaattgatacaattttccaaatacaaattccatttatccccctggggtgataaatggagaacgggggattattggttcacctcctcagaaagcgggggataataggagccagcgggattaatggagacagggtgataattagagcaaatccggtaattat

SEQ ID NO: 32480 - DNA, 983 bp, Heterodera glycines
ccaatgcaaaagtccggtccgcgtaatgttttaatttggttttatttacttgctggtggttttggtagttattccatagaacctaaatttgtccaaaccattaaaaaccatattttaacattattaatatgtatgatttaaattgggttgcgtccccgaccgtcggggttgaaaaagtgggggttcgggtggggtcgaccaaatcgttcggggtcgggttttttcaatttttgccttatgccatataatcaaaaaaccttatattatttttgcttaaaattttttataattcataatattaattttgttttttaaatttcataaatatttttgtatagaattaattaaaaacgcataaggcatttagtcgccttttatacacttttttttgccccactaaatttttccattttcgggaattttcattttttgttactaattgtaagtgtctataaaagggaaggcattggaaaatttgctctcattcgttgcgcctgtctggttttaatgcctctatttgccaattgcgtcaaagcatcgttctgctgctccttcagctacaaaatatcacagcaaacggaagaaggcgtcacacgtggcgacattatggagaagatcgtcaacttcaagctgatgcaatttgtgctcactttggcattcatttggcaactcatttcaatgcgccaattctgcggcacttttgccgacccaaaagtcaattcatttaaatttcacaaatgatcaaaatgttgtgattttcaggccttcatccatgaaaacatttcagttggccattgcaaacgttttacgctcataggaaaggactcaaaaactggcgatttcggcgctgtgttcgaccaggacaaatggcacaaccaaatgtttataaatagcaacaatggccaaccaaccgaagaacagaaacaccaattcatggacgaattggccgcgaaattgccacccgctgggcgccattgcattcc

SEQ ID NO: 32481 - DNA, 890 bp, Heterodera glycines
  misc_feature (22)..(22): n is a, c, g, or t
tcgattttttcagtgtccgttntggggtactcaaacaattatgcgggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggggcgcttctgataagtttctgaaaaaaaagataagcctaaactttttggcctgtttaaaaaggaattaaaaatttttaaaaatttattcatctccctttttgatagaaaagcatcagagtgcctaaactagcatgta

SEQ ID NO: 32482 - DNA, 1394 bp, Heterodera glycines
acgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttt

SEQ ID NO: 32483 - DNA, 1168 bp, Heterodera glycines
aacccggaactgattggaaatttaaattgttcttaatggagttttattttttatttgtcccatgcattttttgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaaccgtataaataaatatttggcaaatgaaaaatttttttccttcctctttagaaagtgtctaaaaatttttgttgttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataa

SEQ ID NO: 32484 - DNA, 1098 bp, Heterodera glycines
  misc_feature (5)..(5): n is a, c, g, or t
  misc_feature (26)..(26): n is a, c, g, or t
  misc_feature (93)..(93): n is a, c, g, or t
  misc_feature (119)..(119): n is a, c, g, or t
cattnaagcttcagtcaaatcactanttttaattagggctctgctgacaaagtgtccattgatgatgaatgattgtcttttgtctgtaatttntcataagcaaaacatgttatataatntaaaacaaacttttgcatttttcatttgtcaaacgatgctttttacattatatacatataaacatatgaattgtatttatttcttatgtatattaatattacaaattgccaaaagaaacaaatgtacatatcgcaatgtttttctataccaatatattcctgctcagatcgtaacatttttcttgaaaaattgttggaactcaaagccaactcgctctttggcggctttaatccatttatgaagcgccactcgcaaatcctccttaaatgcgtttttttaaataattttttaattcaataatttaaatttaaaaaagtatgtgtatttacagcatttttattgtttccgtagtgttcgccttttaataatttgaccattttattgtaaagatgcataaaaaagaacagaatttctgcatgagcattatttttcttctcattgtcagtttcatttgattggtttctaaaaaaaggtttttataatttaattttaaaattttaattatgttttgtaattgttttgaaaaaaagggatttccaacaaaaaacttactcaaataaaagatgtccaaacatgtctttggcttgcttttggatttttttaaaaatatggcgtaataaattgtcatttttgatcttttcatccttaaacatttgctctttaatccgctcttccaccattttggcatccatttggcgtaatatttttgttaacaattcaaattgccattgaacgtctggcgagtctattggcgcgccttcaatgaccagtgccaatggtttttcaatgtaaacgggcagaatgccaagtgctgagaggctcagttcgaacagatgcagaacaacggacacgaaaaagggggaaataaataaagtttaaaaaaattatataattctattttggattttgaaaagattttaaattttaatcaaaatttacaagaaaatgacatattaaaagtgattaattcataaccaa

SEQ ID NO: 32485 - DNA, 1925 bp, Heterodera glycines
agaacgtgtgtagtaattaatgcgtcaataatgggatggaaggaaatgttagtttgtttggtggtgtgggaagggaagcggccgggccctttgatcactccgatcgcttttccaaatgtgtaaattagacctaacagtatgactaagcatcggaacaattcaacccggtttgcactaactgtggcttgattgccgaaactgcgggtggaggaaaagccgactgatttatcaaaggaggtcccagtgcccactaattactgtgtttgatcgcttgataatcatttttgcgccgagccttcctagcggagtaagtttttcttttccgttgtcttaactttggttctaatttacacattttgtcccaactttttggtccaatccctcctccaaatttgatggtcccatcgctctgtctgctttcagcttcatgccagaaacatgcagtcctcgctggttgggtccaaataagtgtccgtttggcatgccgccggaccgccccgcaagcggacgcacttgccggagtgcttctcgacctgaaccggatgagcaattacaaattgaggctattttctctcgggaatcccgggtcgggctttccttttggatgggaccccgattttccgatatgagcaaatttggcgcgattagggccatcatttttgccatttgtctgcaaatgcttttgtccctgctgcccaccttgtgcactttgatggtgcagctcagctcctcctcctgctgctccgtctcgtcctccgtcggctgtccgtctcccacctcttccgctctgtcctcctccgttccgtcgtcctccgccgccgccgcttcgttcttcggctctttgtacgtatgtacccatccgcccgcacttttcctcaccattttctgctgatgcttctgctggttctgttgtgcttctgccgccgctgccgaaattgcatttgccgaggcaattttctgctgactgtcaatgagcagcacgaaaaggacagagcaaagggcgaggaaagtgccgcggcacaatttgttgccgccgctgtgccgatgtgtgcgatggtggaagaagggcgaagttgctgcgatcatgacagtatgaataagaatgggtacggtaatgcccagggattggcgaatggttcaaaaaatcaaattttttaaaagagtttccaattgctgcaaatacaaacaattagcatatcaaatggatgaacattgtcatagtttctcttatcctttccatctacggaatttaattcttttaagtgagtgacccccaaaattaatcgctagcccattgccaaatattaattgatcagggataattaatgccataacaatgatcagagagagttggaacaatgtatcgtttcattcaaaaaggaccccaacttggcacgattaattaatggtccctaatccgttgcgttttgaattacccaaattttctctttctcgcgctcctttttgcttttttcggcctaacaaaagtgcagttgctgctgcttcctttaggtttggcttatatgccattgcttctttgctcgtgggtggcatcggtgggggtggtgccattggcactttcatctcggccctttggcggggggggggggggagcccataatcagaacacccgatataggaaagatattccccattgataccgtctccccataacttgagcatcatatacccggcgcgactgtccctaaaacaatcatagatctaacttttcgagcgatcgacagggctaatcatacgatcaagcttatcaaaaatccctcccacaactatatgactcaacaggatgacctatcaataacgtctaattcctaaacatggatataactgatgcctgagtaagctagtcatccgatctctattgctccctacataaaagacacaaccgatcctggtcattacagccg

SEQ ID NO: 32486 - DNA, 987 bp, Heterodera glycines
gagtccagcactagcagtagtcgcgcatcttcccccctccccctttattttcccccttttttgtaatgttccaaaaagtgcatataatccatccatttctgattcgaatttccatttaacttcgccagccttttgtttttgttttgatcagaaatggcattaaaaataacagttgaaagtcgcttcctccgatttcgcgccgttggggtgggcgaacgcgcggtaaaagacaaacggtcaaaaaacaaattgtaaacgcaagaaaggaaaacggcggtttatccgtcgccattcattcattaacccttctctcctccgcttcgttttgtgctgtttttttatttcttctttcgaccaaaaaaatggactgaaagatggaaaagaaaattaatttatcacaattttcgtcattctttcttcaaaacgaatgaaagaatgtgaaatttagtcgtttcacaaatcgtcaaagttaaattagtttataaaatgttttaattaatacaaatatatatttgtttttcccttaaatttgacactttttgaattaatctctctcaatttgctttgactgattataatcagattcaatttcaaattcatgtctggtgcttatcagaagtctattttaccattcattttcccgctttccatgttttttaaaattaattttcgcttccttttccgctttatctttcttcgcttcccttttcaagtttttgcccctccgttgtcctcgtcaacgacaagcactaacagcaccgccagcagcacaaccaccatacccaacaccaccaccggtagcagcagcaattgcggcgattactgctcgagacccggccgtgttgggtgccgtgccgcatcgagttccgcaccccggccgacttccccgccgtggaaggcgtcgcggccggccgtttccaccgccctggccgcactgtgccgcgttgtgtgtgccgaacggaagccggggaacggcttgacgacgaa

SEQ ID NO: 32487 - DNA, 1610 bp, Heterodera glycines
tttataataaaaaaacaacattttttgtttcagcatttttcttttttttggcctctttgagatacactttccgcttcataaagcaaattcatttttccattaagccaaaagggaggtggaggcggcttaatcactgaaccgagcttgaaattaaaaattcatattaattcttaaataatgtgttactaaatttgaaatcctttcattggcgttctaatagattattcaagttatttcaacagattttttaaatttgaaaatacataatttaaaaaaaaaatttatattttattttatgaaaaacaacaaaaaaaaataataatcttctcaaaattttaaattctctcatttccaattttgacttttatgtaagaattttcaaatattttttattggataagaagaaatatttttggcatttttttttgccatttttggcaaaaaatcatgtgggcaatgattaaaaattcattcacacaacaaaaaaattttctgctaaaatttgccgggccatttttgtccattgcatcagcaattctctcaccaatgtccaaagaacgaagaattttgttaaaaatatttcttcgggaattttatttaactgtttctttttttgtctaaacattaacaatttttatttcaaatttaatcttaaactaaatttcactaataaaaactctataatttttataagattttttagctttttgccatgacccacatttgcgaagcgccaaaaaatatttaatttcaataaatttttccatcttaaagtaatttattttaatttaattgttaatcgaattttacaaatttgtttaggtagaaataaaataatttaatttacatataatcattttaccacaaagaaaatcgtaaaaattttcttaatacgtcggttgattatcacaaattgagtcaataatgcgttggagcgacagcacaaattcgcaccaaggcaagagaagtcattcattgatttaaaaatttaattatattgaaggctttcgaataatgccaagttgtaaaactgtcagattgaaaaaaaagttatgccccgaaaaatttggcccagaaggagtttgcctgacagagcataatcacttctaacaaagagcattccttgatatttatgaaaaagcggatcagtcatataaatttcggttgatctcattccgttcaaacgtttccgtgccagggaggtttaagaagccataaattctttcacagttgaccaaatgaaacaatcttaatgttaccaaaagggtacaaattaccaaaatttgaaaaaaatctatttttttgaattgtttcttaataactttttccattttgcaaaaaatattatgattttatagaactaatagagctccagatttttgaattttaattaaaaataaagttttggcttcttaaacctccttggcacggaaacgtgcgcactgcgcatggaactgagtcgaactgcattaaattagaataatttcaaaaaatgctttttttgttagcggtcaaatcagtccgatcatcgagcagtaacggacactacctcgttaacaatgatgatgataagcagcactgttcaattgacgaagagctgcgcaatttgt

SEQ ID NO: 32488 - DNA, 954 bp, Heterodera glycines
ctagagctcggtattttgaaaaaagcctggacctggccctggacctggattccatgttggacctggatttcctggacaaaaatccaggaaaatccaggtccaggaaaaatccaggctcttcgagacctggatccaggcctggacctggattttttgaaactcatcttaaaaatcaaaaaaaggtttgaaaaaattaattaattgcttagaaacatctaaaaatatctacttaataataataataatgtatttttaaattaatttaatctttttttgaaaattaaaaaaaaacatcggtcacttgaaataataaattctaaaattttgtccaggaaaatccaggtttttcgtgttttgcctggacctggacctggatttttttttcacattggacctggacctggatttcctggacaaaaatccgggaaaatccaggtccaggaaaaatccaggttgccgaaaaatgacctggacctggatccaggaaaaatccaggcctggatccaggaaaaatccaggcctggatccaggtccaggccgagctctatgtttacattaaaatatgattgcaattagaatgtttttttaattctttcctatcatttttatttaaaacaacacgagactgggaccgagctggaaaatccataccagatcccaaaagtttattttatttaaatttttcttgataaataataaaattaaaattgtttgaaatcctagttttctggcccaggcaagtcgtggtcacgaatttgccaagtttcggtttccttactttaaggtattattaactaaaaataaggtatttttttcttaattgagcttggtttcttgtatttaatcaaaattcaactgatagagacttaaataattttttcatttttcataataaaaatctcttatgttttttaaaaatttttttgttttgttttttgatatatttagaaattt

SEQ ID NO: 32489 - DNA, 1780 bp, Heterodera glycines
  misc_feature (1758)..(1758): n is a, c, g, or t
gtatgggatgtgtgccgagttctgatcactcagtgcggagattacatttcccagtgcggataaggagaggttgatcctgatcagtaagcgttgtccgatcgcttccctctccgtccctcgacttgcctcgtcgcctctcgaaagcgttgtccctctgaacctgtcttgctctgtcgttcactccccgccaggtcgaccaggttcaatcggcccacccttcattggtattcctatcacttctctgtccaccagtcgatcacctgatgtgtgtttgtccgtcctggtcagtctcagaacattccaccgtaatgacctcaaaatattgccatttcgtttaggtcttactgcattacggttaagccttacaaagatggcatgggagcgtgagctgtgctcgttcatatttgtgcggccgactgatcggttggaatggccaacactgatcacttcttccgtctcttccacgctgtgccgtgccgttttgcctttgctttcctttccgtttgccttaccttttggtgacaaatgagctcaaatccttcacgtacactccaatgtccggcctttccttcagctccaaccgtttgttggcacttcggttcagcaaatcccgaatttcttcctggtaaatctccagaaaagaggcgcgcaccaaaaactgctgatttggcggagaatgggcgatgtgttggaaaatgtgctaaataattgcgggaaggggcgcatcgaatggcatggaaagggcacaaaacccacttggatggcatttgggatgacaccccgctgagtgggctcccccctcgtcccctccattgtgtgcgttttgccggtgcccgtctgtccgtaagcgaacaccgtcccgttgaatcccttggcgttttgttttgtccctccattctttctttcttccctttcccatttcgcttcacctgtaataccgaatccacaattcctctcaccgtttcatcgtaaatttcgaattgtttcgcgctaaattaattgttatactcccaataaattgttcaaattgctgcacttttccccgaagacggagtcgaagaaaaagcttttggacgggcctttggggctttgcaactcgacaaagccccgggcgacgtccgcccggacaatgttcgaatggccctgggcaatctcagccgaagagagaggccgacacccaaaatgacacggcaaattaaaaaagtaaaatgcaaatggtccttctaattatagtctctcaccgccttacctcaccgcaactttgacacattcgcctgtgttgctgctactgcttgccatcgatgcgttcgatgaaagtgccgttggcgtttttgccgatgaaaaatttgggcgattgcgggaaacagaagccgccgcgtttcccaattgagtcatcgtcgaatttctgaatgttttggcataaagtttagcgaccgatatagacagctgcgttgatttttctttgcttttcttccctttattaattaaatcccttttttaattaatgtcgatcatttggtttaatccatcggttatctttttgtgtccctttgccgctgcttccattagtctaaagattcccttcccccctcccccccatttcttcacccaattggtcgtcgtccttagtaacggggaaaaactgaacaaaaagcgatagagagagagagagggggagagggagagagaggaagagagagaaagagggagggggagggaaagagagaacacttagggatatggaagataacaaattgngttcaatcgtacaatatgaaag

SEQ ID NO: 32490 - DNA, 1233 bp, Heterodera glycines
gtccgatcattacggattgatcagtcggtgatcgatcagcgccagttgggcctgatcacaggtcactgactgtcgtgaattaatcaccaatcacattcgccctgctagttgaatttaaataacgaaaattaaaaaccaaaggcgtcgagggcactgaaagaggccgccgatgttatccaagcgaaccccgtggcacttcagctgcgccacctgcaggcactgagcagcattgcgtaaagctcgaattgcaaaaacttttttaaaatatattttattaaagtgcggaacacaattcgaccatcgttttcccggtccctgtggaaatgttcggtgagttttttttgggggggggggcgtagggaccgtcgttttaatttgaaaaaaaatattggcaaataaacctatcccataagaaataagcacccaccgcgaatgaatcggcgaattctgatcagttttatgtatttttgttttctgatcaattcggtccatccaatcaggcgcatttatgaacaaaaaagaggagtaaaacgaacgaaagaacaaacggaaggccaaaaagaaacattggcacggacggagtgacaaaatcaaaagcagcaacggattgggagcatttcttcttcgttttggcatttcacattcacacattatgcgacagtgctgtgtttatataattaattttctcaatttcccctccacaaattttaacgccaataaaacaaaacattcccggcaaaagttgtcgtttatgtctccttttttggccaattcggatcaaaaatcagtgatcactaattctgatcattcaatttcaattggataaagaattggcgttaaaaatgagtcccaactttgtcccgtcgtccttttattcataggaatgtgaacatgaaaccacaataggactcatacaaatcgttttactcagctttgtattcaaaagttttattggcattttattccatttgataaataataaaattcaggaccaaaatttaaaaaatcctcagatattttgtcttttctcttagtttcccatgccattcgagctgaaattattggtttaaaacttttaagtaaagagtttctttttttctaagcaaacctttaaaaacgcaaaaattttcaacagtaaatgaaaataaattgagttggctaaatttagcgcttcataacttttttatttaaattttctcgaacaacataatgccatattactggggttattga

SEQ ID NO: 32491 - DNA, 1369 bp, Heterodera glycines
  misc_feature (1311)..(1311): n is a, c, g, or t
tctcgaccagggctgcacgcaactggatttgcaattacggaaatccgtaattcgtaattgcggcgattttgttgaattttttttaaagtagtgaattaataaaaaccgaaaaacagattttgggatgccttttctttattttttatttcaattttataaagaaattataattttgtttctgaaaaaaattcattctttttgaatttttaggatttattttggaaaattttttgaaagtctgatcaaatcgggtaaatcggggtcagggctgcacgaaatttcgtgtcgttttcgtcttttttttcgttttcgtgtttcgtttttgtccgttaaaattttttgtttcgttttcgattttcaaaatttcatttttcgtttcgtgtttcgttttcgagttttaaaattttaaattttcgtttcttttcgttttcgtcagacggaattttgacgaaaaagacgaaaatatttacaccttaagaatgactttttttagtaaaaaaaaaaagtggtttcattgaactgtaactgttttagtttagtcgtgcaccttcagatttttgttgtttttttaatatgggttcgatcccatatgcccgcactatattttaccgtttttttcatttaatttactattttaattactaaatctgttgacaaattacactaaaattttcaaaatttaccccagcggcgcctatcggcaccgccggcccacccaagttccccaagttttctgaaaaaatgcgccgcaaaaaaattgtttaaaatctgatttatttaaccctattgctctgaaatgtattatttttaatttcttccccaaaattgtttaaaatggataatgggatgtgaaaatataatattatgtgcattttgatggatcaattataaaataactgagttgaagcaatttttaaaaattccttatttttgactcaaaattttattttttccttggtgttattaattcgaaaaattttcaatcacacacccctgtactagagccatatccgcttttccacctactattatctgcatacactcagtttgaggatataattttaaagatttataaataagttaaaaaaaatttcggttttttcgtttcgtttcgtacgaaaatttttttttagagtttttgtgcagccctgatcggggtccggcggtgccggtaggcgccgccgtgaaaattttttgaaattttaatgattttattaagaaaaatcgataaattttttatgattttcataaatgagtaaaaaaaatagtttcacaaaaaagggatacctctaatttgttgtggctttccgngtttatttctgtattttgtttgtttttatcaagaaatggaaaaacaaaatattagaaa

SEQ ID NO: 32492 - DNA, 1797 bp, Heterodera glycines
aaataaaaaatattaataattaaatggaaatgtaaaaattttttcatttgtgttacatatatttattgatagcaaaatttccgaaaacaaattagaatatgttgtgaaaatataaattagaaaaataaataattacaaataaatcattgtaagcaaaaaatcaaaacaaaaaattgtccccaaaaaatttcaaaaataaaaataatcaaaaataaaaatattgtataaaattcaaacatacgcgaactaaaaacaaattgataaataaaatgttatatatatagcaaaaataaataataaaatatataaatatgttttcatacaagaattttgcctatttgagaagaagaacaatttgaaaatgtgggctttgaacacgaactagaaaatgaagattgataaaatatttagaaaataaaaaatgaaacatttaataaccaaatactaattgtttacaagacgtgccattaacaaaataaaaaatgcaagaaacctactcgaaaaattatgaggaattaaattttcaataataatctaagcctaaaaataataggaatatttaaaattcataaaaaattgacactttggtagaaaacaaatataggcatttaaaaatgagaaaaaaacataattattttgattgaaaataatgataaaaaatcattaaaaaatttcaaagttgactatacagagttcttcagttaaaccgagagaatgcaaaaattgaaatttaaaaataaaatactttaaaattataatcaaaaaaattcgtataaaaaatttacactgaaaaaaatcgatacctatgaacaggggaattgacatgaagtaaaatgaaaaattaattgttaataattcaaagttcaagaaacaaaaaattttaaataaaatttgagaaaaactgatttgaaaacaaccaataaatttataaataaggcaaagtcaagaaacaactaaaagaatatcggcataccttgaaaaaatagaatttccacaaatcacaagacacaagattacgaaaaatattttacaaaaacattaataatcaagtattacgtgtttataagaccaaaatctgactctcatttatcactctctcactgcattctttgttagaaaatccacacaaaacgacgcgcatccatcgaaccattggcgtcatgccctcacagcacaacattggcattgccaccccctctcatccgctgagtcgcccccactcttattctccacttcatttcatagtgtaccttttgcatcaattttttctctaattaatagttttttctatttatgtaattgaatgagcaaattgtaatttctattaaggtttttactaggcccgtacagaaactaaatgaataaaaaccaatttaattaaattaattatgcagtaaaccttgacatattagaaatatatacacaaattaaaaaataatataacaaattttaaaagtaaatattcaaaaatttaatagaaaaattcaagaaattcaattcattaatttctgtaatgcattaaacaatagaacattgtctttaaacatgtcaaaatcatttcaaataaaaaaatgttcttaaaaaattatttaattttaatattattattaaaacaaaaaattatttataaaaaaataaaaggtttaattgcatatgagttacaaatcagtgtttttattttctgtccatgagatgcatattaaaaaatgcatttatcaatgcaaaatttttattatgtgtcgaataaaaaaattaggtggtttttattgaattgttttggttattttaaataataat

SEQ ID NO: 32493 - DNA, 1104 bp, Heterodera glycines
  misc_feature (57)..(57): n is a, c, g, or t
  misc_feature (1034)..(1034): n is a, c, g, or t
  misc_feature (1087)..(1087): n is a, c, g, or t
tcggtacaaaattggccgaaaaagagatagccattttctgaggcccgaaggaaaatntgagagggctaaggaaaatttcagagtgctaatttatatgtaatattcgaaagtgccaagctaattagcgattcaggcgcacattggggcctgaattaagccattttccctttgatcggtacaaaattggccaaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgacgcccgaaggaaaatttgagagggctaatttatatgtaatattcgaaagtgcccagctatntagcgattcaggcgcacattggggcctgaattagccattttccctttgatcgntacaaaattggccgaaa

SEQ ID NO: 32494 - DNA, 1180 bp, Heterodera glycines
tttttatatttaatagattttcagaaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaggtgcggtgcgccatggccattttatttttcaaataatttttatatttaatagatattccagaaaaatgggtatctctttttt

SEQ ID NO: 32495 - DNA, 858 bp, Heterodera glycines
cggtccaaaaaatggctatctctttttttggaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggaaggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaatggctatctctttttttggcaatctggtaatagaaatctcttttggaacaatgacagtggctgtcatcagttgttatgctctaaaaatgattttcgggccgtttgagtatatgtgaggtatggacgggtccaaaaaaatggctatctctttttttggcaatct

SEQ ID NO: 32496 - DNA, 1300 bp, Heterodera glycines
tgcgatttttgttatgtaaaaaacatattaattttaaacttattattatttttaaataaatacaattttttctgagaatttttaaataaaatgaaactccacctattaatcgttttatttatatttttgatcactcaaattaatcaaatcggaacagaaaagaaaaagttggaactaaaatcatttgatgaaacatttggagaaaaatgggaagaaaagaagaagaaaaacgaaatgaagagaagaaaagggaaataattagcaatttctataaaataaaagagaaaataaaggaaaaaggaagaacttattcaaaaaaagaatggaataaaattaatgcaaaaatagcgaagaaattggggacaaatcgtcaatatattgctgaatggatcaaagaatttggtcttcaaaaacaaattcataaaaactataaatcaaaaactgatgaagaaaagttagaaattgtacagaattttattgaaatgataaatgaatataagcaaaaaagaaaatatacgagaaaagaatggcaccaaaattatgccgaaatttgtaagaaaattggagtaggccatggaacaattgaaaattggaagagaaaatttggcattcgcagtaaattaacaaagaatgaaaaaatggaaaaaatgaaaatttattcgcaaataaaaagaaaaaacccaaaaatgagtgaacgggcaattgcaaaaaagatgaaaattgatagaacgaacatttcaaaatggaagaaactgtttggataaaagaatcattgaagattgaaacgatgattataagaaaaattggataaatttgccgaaaaaattatcagaaaaactatgacaatttctagttttttttcaaattttttgtatttgtattaaaaaattattttaaataccctaaattttgaaatttttcttagtgaaaataagtgaaaacagtcaattcaaggattgggagggtatcataaaaaactgaacaatgttggaactgggctcccagtatgcgtaaattttcgattttagaggccctgtaaaactccttggggttttgctagggtgaaaaataaaaaaattaaaaaagcataaactaatattcaataacaaataagtttttaaaaaatgaaattgagaagcaaaggtttgggtcaaaataatctcaaaatgttgtataatttgcttaataaaatccaaaatgattagatttcactattaatgggccatttatttatttgtgaaatgatttaaaaaaaataaattggctttctaattaaaataaactataaaaaattagaaaa

SEQ ID NO: 32497 - DNA, 835 bp, Heterodera glycines
atatacaaaaaaaaatggaaaaaatcccgtcagaaaggaaaagtgccaatgaaaaggaagataaatgcgcagcatcaattggagaacggacttaaaagattggcaacctgtgaaatgagcaaaaaaggggtcggccacatggaaacggggtgcttcgcttctctgccgctctacatgaacctgtagtaaataccaggtttcttccatcttagtctgatatgtatctaaataaaatatttgaaaggagaatctttttctaagcgagtgctaaacaatttgacatctcagtagagatagtacgccaaagagagagagaaattacattcaactttttttcgagttcgattcgggattcgaaatttgttgaaatggatgtcatgttcttgataagcgaccccgaaaacccaagaactttgtctttagagaattaaattgctaatttttttaaaaaatcaaaaataaaacccgaaaatttccgacttcaatcctataattggaaaaaaacaattttttgcagtgtcttttattcggagggtcttctactcgagtgaggtcttttattgttcaaccccctcaaattttgtagattattatgacgaagtcgaagtccagtagcggaacgactcgtaccaagaagcgtaccgctgaccaagttgtaaagacggtgttccgtcgcaaaatctgtctgttctgctttatggcctcactgattgttttcgcgctggtccttggtttggccatcactttgacagttatcacagtgaacaattgggtaacgaatgaatgtctctttcctttccataacttttcacgctgttttcagaaggaaatcggc

SEQ ID NO: 32498 - DNA, 1134 bp, Heterodera glycines
ctagtttatataccatagagaaaagggggtttcgtctcaaaaacaaaatctcccggcggaggcccggagcgccctgaaagtagtgaaaggttcttacaactttttgaggcgcatctgggaaaaatatgggttttcgctccggtggacggttcagcgccggcggcgctgaaacggcgtgaaatttttttatgtcgcgatttttggccccgcaactttttccagggcatcgggagcggaaaatgtttggaggtaggaaatcaagttggagtgtttggcacagcatgccgttggtttgggggttctatctgtaaatgccaatgctgcagaaaatggcaaaatttggcacccaatttcggcattttccgtttttcgggaataactcggccgggattgtgctgagcgttttggcgtcagaaaacatgatgtacagctcggcgagctctttcagatggaattttaaaatttcgaaaattttcaaaatttttcgagctaggccccctcgaaaatttttcgtttttgaattttatctttttttgccgatttttcccagggaaacgaaggacaccttcaaaacatagtttttcgagctctatcgattggtggcatttttgaaaaaatttccatttttgtccggaaatagaaaaattttttggcctgaccgggacatttcagtcccgggcctataactcgtcaggggttgattttaacgaaaaatcgtccaagagcttttttgtagagaatttcgagctctatttaatgtgctttatctcatatttttatctttaatataaaaaaagatataaaataaaaatgaatttttaaatgcaaaaccaaaggggggaccccatggatttgcatttcatgagaaacttttttgctcctaaaattgccaaaaaatacttttctgggctaatttgaggtgctgaacacgaatatgcactttatattgcgttttggattttttggagggtggtaaaaaaattttgaaaattcaataatttttggcccttgaaaattcaacctaaattttaaaaattcataactcgcctcaaaatggtccaattcagctcatttaaagcataaaaaatagcaaaaaatcgggagaattttatgagatttatttgaaatttatac

SEQ ID NO: 32499 - DNA, 1456 bp, Heterodera glycines
gtttgtttgggacaaatttggaaaattggctatctatttttctgctcaacagtaataggaattcctaccgcattctcagaataattacgccgatactaattgttctggaatttgtttctcggcgcgtttgtttgggaaaaatttggaaaattggctatctctttttctgctcaacagtaatagggattacaaccgcattctcagaataattacgccgatactaattgttctggaatttgtttctcggcgcgttgtgtttgggaaaaatttggaaaattggctatctctttttctgctcaacagtaataggaattccaacagcattctcagaataattacgccgatactaattgttctgggatttgtttctcggcgcgtttgtttgggaaaaatttggaaaattggctatctctttttctgctcaacagtaataggaattccaaccgcattctcagaatacctacgccgttatggatttaatatatcggggcgtttgtaagggaaatatttgtcaacaagaatatatacgtcatctcatggacttaaaatcgcaaaaattaggcagtttttggtgaaaatctgttaacaaatggcattcaaattttcaaaatttttccccggcagcgcctgtcggcaccgccagaccccccccccccccccccctctgtcccacaaaatttttggaaaaagcgcgccacaaaaaaagcgtttttaaagcagaaaaaagtcgtcgtaaatgaggaaaatgatcagcggaaataaaaaaatattggaaaaaatccattccggtgaaaaatacaagccatttgaataaatattaaccatttttcattgcatataataaaaattttaaatgtccttgaatttcatgaattttccccactatgtccttgcaaatcggcatacccgtccttggaagccgaccttggacgattgcagccctgccctaaagggtcgactactttagatgcttgaaaataactgcaaacttaaaatcttttgcaatattttttattcatatttttttttttgatttaaaaggcgggaataattttcccgtttcccttctcgctttttctgtattccgcttcaaaattaactgatattgatcagttcaaactaggaatgcactttgaaatctatacagattcatagtgattcatataaaccactgaaaatatttttcataatattgggttgacttgtggatgttgtcgtgtggaagagcttcctggggaagattaccttgactccgcattacatacacattctgatatctcttaagaaattctttcttcgtgaaaaacttcggaaatgtcgacgcaacaacaacaacgtaagacgcgttccccaattgtattggagcgtggagtctctggtcgtgtcaaatggttcgacttctggaaagggatcactccttccattgcaaactttcaattttgtcattacgtcgtaa

SEQ ID NO: 32500 - DNA, 557 bp, Heterodera glycines
ggatagaatattcctcacattttctttaccattattttaattaaaattttaattttaaaaaatattccaacttttttctttcatgttaagcatcctaaaacccaaaacttaatcaattggtcatttttttacaaattctgttaacaaatcgcattaaaaattacaaaatttttcccggcggcgcctatcggcaccgccggccctccttgtcccccaaaagttttggaaaaaacgtgccgcgtaaaaagcgttgttgaataaaaaaaaaggtaattgattgacattaattttcctgttcttagacccttatttttagagttaatcggattgttgatcacgagttttctgaaattccttttataggtattatatgtagaataaatcgataataggtataaaataggtattataaaagttatcttatacacctaaaacctataggaaaatgcttttttcgtgcttatctgcgcgtattaaatgcgcaaaattttaggtatttaactaaaaatcgcatccctataaatttctttttgttcatgatgaattgtgtgatatag

SEQ ID NO: 32501 - DNA, 1236 bp, Heterodera glycines
tttgttgttggtgctggtgttgtgccagcaattctcttctaataatgctaatggtgatgaccttctgccggggaatgtttcaattgcttttttttcgggaatggtttagagactcacaaaatcactcctcaaatggcatttcccttcgctttcgctttgtcactttatgcttcataccatcattcattccactctctctctattaaattagcattaatagccagatttgaatttaaaaatgagtgccatcggcgacggcactcacagcgatggcactcagatggaaaaaagtaaaaagtgtaaaaaggatcatgacgatgactcagtcattaaaggtaattgcgacgacgaataatattgggtggaagattttttgaatttcagctgaaaattgtggctgggaagagatgcgatgtgaccatgaaattgaagctgatttgacattgaataacaggccaattgaggacgaaaatggacgaacggaaagccaaggacaaagggacaaaggggaaaacagagacagttcgtcacccgctgctgatcagttgcgccacactcacagcttcgagtgccaacagtgcaacagccaattggacagttttgagcagtttatcagtgagtgtttacagcgaatgatcaatgcatggaaatgataaaatgagaaaagcgaattgatcaatgggacggactaagtgatcagagtcggacttaagaagcattcattgtaatacatggtgacaattaatgatgctattgatcagaacacatgcgaactgcgcatctgcagcactgtgacggctcttccgtcaaatgccaatgccaaatttgcgggaggcaattggccactaacagaaaggtcagtcagtcaattattcatctcatgctgttttttggcttgggttatgattcctcactcatttcaaaggagttcaatgcgcatttggcagagcatttgttggacacgcgtaccaagtggcactgtttgaggtgccacggcacacaattcgacgaggcggacgaactccgacggcactttagccaaagccatgttcaaaccgttttccgatgcacaatttgtcttgaactttttacggaacgagacgatttacaggtgaaaaggatgaaagggagtggctaattgaaatgtctaaccaattattacgaggttatgaatgaatagtcactgcttcatcgctctctttctctgtgccgtcatttttggcatttttcctttct

SEQ ID NO: 32502 - DNA, 969 bp, Heterodera glycines
gttttaaaaagttattggccaaaaatttttgaaaacccggtgccttgggtacttttggccataactttgctcaaacttgaccaaatttttgaaatttaggtgagctaatagttagggctatggaatgatatgaataatatttaatttggtttacttttacaaaagttatggacagttttttgttggaaatttccatttgatggttttttatataacgactcagcaccttctcatcatggggaaagtttcttaaaaatgaaagagtaaaaagacattcacaaaagcaaaaagtaaacaatttgtgattggattgacaattaattaattaatattttaattatatatatattagcattttcccacctttcttatgtaaatttcgatgattgaaccgagtaaaaagtaaagggacacagagatcagaaaaatgccgaccttaagggaatgaatgggaaggtgttaaaaagtgccattggataccaaaattaaaatggagccaatcgccgcttggcgccatcgctgctgaattgtcgtaagaaaaaactttttagaaaatttactctcgcccattctaaaaaaataaaatcattgaaaataaatgtagctgtttttgacgacaatcgatgaacaaacttttgcacactttcacaacagaaaatgggaaatgggtcattcgtttcgatggcattcgtcggggggggggggggggggcaacgaaaacggaggacaatcaatcggacgcacagcggcggcaaatccccgcaaatgttgcacaaagagagtggggagcgaaatttgagggaacgaatggaggggggcggggcgggggtaattacagggcaaatgggcaaattaggcatttgaatggtggacacttttaaaacgcattattattaatacgcatttttgaaaggatttacactttcacaacgcacatttgttaccctttaagaaataaataagtactta

SEQ ID NO: 32503 - DNA, 1050 bp, Heterodera glycines
cagacgcgacgagaagcacattccagatcgacgtaattattctgagaatgcggtaggaattcctagtactgtgtagcagaaaaagagatagacaatgatccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttgtaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgcgaatgcggttggaattcctattactgttgagcagaaaaagagatagccaattttccaaatttttcccaaacagacgcgccgagaaacaaattccagaacggcgtaattattctgagaatgcggttggaat

SEQ ID NO: 32504 - DNA, 1128 bp, Heterodera glycines
aaacaaaaaaatcgattttttcaagtgtccgtttggggtactcaaacatttatggggagcaaaaatccaacgcagaattaaagtacaggctatacggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatgagaattcatgcgagattttctggaaataaggttaatagggcctagttaagctgtaaaaaaaaatttgggaaaagaagaaagagaatagaaagaaccaggttcgatga

SEQ ID NO: 32505 - DNA, 1360 bp, Heterodera glycines
ctctttaaaacctatacataagccttttcctatacgtaatttttcgaaaatttgaattttcaaatgactaaaaaagctagagaatcagaaaataggttaagaaaattaattttaattgtcaatttttaagacaagtatcctccgttcttagtggtttaagtcactcttttttaaggtgccattttttttattccgataaaaaaccaaaaaaaaaacaatttcggcacaaaatgcacaaataggcaaaattgggacgaaaaattcatcctaattgttcaaaaccaaactaaaaatgttttttcaagcttatgacgataaaaaacataaagcgaatgacatttaaaaatgatgggcctaaattggaaaatctaatgaattaaaaaaagttaaattcaaatgtttagcctgactttatagctgttctttcgaatttaaaaagattcttttggcccttagggtaaaagaaaattcttttaaaatttgttcacttttcatttcacattttttgttcagcaaattctatttttctttctcaaagcgatttaaatttttattaaattttcgacttccataggcaacaaataaatattattaaaaataagaagagatttttaacaagccacaaagttataggaagaagtaatttcaagcaaataaataatttaacaaaaacaaacaaaaaataattcattttcttacaaaacaaaaaataaaaatggaaaaagaagaaaaaagaaaaaagcttacaacaccttcgattcccaggacgtctccgttccaagtactaagaaggcccaacgttgcttaacttgccagatcggacgggatggcgtgctttcaacgtggtatggtcgtaagcgaaagtgctccatttgaaagcaattaaatagtcaatttttaatgcattttttctctttggttaacttatcattaatcaaaacaaggatcgataaaaaatttagaattcacttaaataaggtaaaaaaaaagaaaaattcgatagtttttttcgaaatgaaagagcaaaaattcggagttttgaattctttttttaactaatttcccaactgcaaatcggctaaaattaaaaatgatttatataaattttgaaatcatcgcaaattctctttaaaagcacatataaagcctttccctaggaacaatttaattgttttgattagaaaaacctcgaaaagcaaaatttcttaagaaaaattgggtttggtggtgattttaagaaagtcatccacccatcatttttagtgcttaaagtcatcttttgaggctccaatattaaatgttattgtattccgttaagaaaaatagaaatccatttcggcacaaatccaaaaaaggcaaa

SEQ ID NO: 32506 - DNA, 1936 bp, Heterodera glycines
  misc_feature (10)..(11): n is a, c, g, or t
cgccaataanntcagacttcttgggctaaaatgcaatctaaaaggggtaaaaattgaagctccagagggggcacaaaatgtcgagttatgttgtgacggaatttgcggaagtagaaattatataaagccatttattttcccgcttatcgaggagagtctcctttccggttttacatgcatggctactttttgggtaccgcctagcacaaaccttcagcaaacggcaaaatgtgcaccaatcgatgtgtgcactttgcttgattgctatttatgtgagggtcgaattttgaacccccactgttcaccgatgatctcggctttcctaatcgggatgttaatgcaaaagatgaaatatgccagactcagaagagtagctagcgatggaagcagcgatgtggaagattataagcctcaaaaggcttataggggacgaagttttaaacccctcaccaaattgggcgatgcctcagcaatttttatattttctggtgttcctttctcttttggagaacctgcgtccatcaccgcaaatacagaagagtgcgaaacggactctgttggaacgaaatgtcgaataaattccgtaactctttagaatttgctcccggcaggacagccggtggatctcattgtccggaccaccaaatcggcaatattagggactctgacgtttaaattaaagggactagcacaggagtgtgtcccggaatccttaggattcattagatcataccagattaggactttagcaagcaaacgatgtcctggaatgggttcatgtattgataaaacatgcgaaaatctgttgactaatggaacagtgcccgagttagcggaagggaatgtatttccagggaattctttttgcctcgatagtagtagcttttggttccacggatgcggtgggaccaattatgcatgccttttttaccgcaactatgcagtaccgtcttcaaatgaagaacgaacggtctatgagatgtttaggtgtccagcatggcaatttcgggtcaaaaccgaaatcaaggtcaattttgccggaggcctagtaataaaggaagaaaccgatttttattccggccgtacttttcacctgaaaggggcaaatctatcagttaccccggcggtgttcggaaatccagcggccccaatcatgtcggagattttcttcggcggctgggacaaagctgctttggttcgaaatgttgaaccagccttgcactgtagagacgaactgtcggcctcgctgatgaagtgcaaactctcgttagacgcatgcacgaagtgcagacctgatcataatgaaggcatcgtccgatgccattgtagggagattgacgtcgaaaggtggttaggagagccgtccaaacggctgccactttcagtcggtcctctaaccctaaattaccgacagccaagacaagtttgggcagaatcggagtacgtcccggtacaggtggtcataaaaatggaagacctaacacttagtgttaggcaggatagggccacatgtcacattactcccggcggcctaaccggttgttacagatgccgaaccggcagtcgttttaaatttaaatgtgaagcatccctagggaatccgctggcagaaattctgtgtgataacggggcccggtgggttacacattgccccgagggagcaacggataaagacatatcattatctttaaatgaaggcgacgtggacactatctgtgtggtaagatgccctggcggcgtatccaactttacaatgaaaggaactttgcattatttaccttccgcaaagatggaatggcgaatttcgggaaaaaagaccgaatttggctctgaatggcctgatttttcccttatgagtaatattttcagaatttttaattgggtccttgtcgggccacaattttttgttgctgtggggattttcttcgcgggaatc

SEQ ID NO: 32507 - DNA, 1164 bp, Heterodera glycines
cccgagtgagtccgcgaagcggcctaataagctaaaaaacgggcgcgaagcgcccgtcttgagcctcgatgtggactaaaaacccctaataattttttaaaaattaaaaaaatctctccaaccaattcgatcaatttgaatcgcttcacagtctaggtagcgaagctccgaaagcgcgaagcgctttttcccagctaaatagccgacggttcacgcacccgctagttaaaagtagttatactttttctgtctgcagctgtttgactttgaatactgcggagtaaaaataggaattttttcttttcactaattgaggacaatttttgtcctttcttgattagctaataattttgaaaattactcaccaattaaaatatacttgcatttttcaaaagaggtattcataattttaaaataagcacatatttatagtgagactgttttcaactcgcttctattattaaagggttaaagtatgcgcataaaggccttaattaaacacaagaacatattcacatattttgtgtaattctatctcggactccctcctgctcaaaataatgagtttaatgcaaaatagatttgactagcggatactacgaagatagtttaaaattttcatctcttaattattttcatttaaaagtagttatactttttctgtctgcagctgtttgactttgaatactgcggagtaaaaaaaggaatttttcttttcactaattcaagacaatttttgtcctttcttgattagctaataattttgaaaattactcaccaattaaaatatacttgcatttttcaaaagaggtattcataattttaaaataagcacatatttatagtgagactgttttcaactcgcttctattattaaagggttaaaggatgcgcataaaggccttaattaaacacaagaacatattcacatattttgtgtaattctatctcggactccctcctgctcaaaataatgagtttaatgcaaaatagatttgactagcggatactacgaagttattttaaaattttcatctcttaaaattattttcatttaaaagtagttatattttttctgtctgcagctgtttgactttgaatactgcggagtaaaaaaaggaattttttcttttcactaatagaggacaatttttggcctttctt

SEQ ID NO: 32508 - DNA, 1172 bp, Heterodera glycines
  misc_feature (49)..(49): n is a, c, g, or t
ccgaaaaaaagtggtggagaaaatcaaatctgaatttctattaatattncgatcatcttggtccaaaaatgattaatcgtttgaaataatcgaagaaaatttgtttgaaaatttcattaatttaatttattaaataaaaaaccaaataattttgtattattttcactcgatataaattaaaatttgaattttttttttaatttttaaaatttttttgaatttttaaaatttcccggttggtcccggttcccgggttttcttgcggtcccggtcccggtcccgaaaaaaaatcgaggtcccggtcccggtcccggcttctcaggtcccggcaagtcccggtcccggttttggcaaaaaattcccggtcccgtggcactctattttaaatctcgctactctgtttatttttttaaattttttgagattatttattcttgtttagaacattaaaataaatgttaagttaaaaatcattgaaaaatttttctgcgattttctttaatgaaattttcttataaaaatttataaagttgtttttcaaaaatttctattttataaaaaccggaccggccaggaggaggaagcgaagtaaaaaacaaaaacaaaattttgaatttttgttgttttcaagtgctaagttttttgtgaactacttaagtggtggcacctaaatttggctgaaacgaaaattaatttttacactaaataagaattgtgctcacctccaagtcgaaaagacgggcctgagcataagccaagaaaacattgcgcaattcggagatgggaatttgtaaacatggggcaaccagggcggggatattgtactttttggctaattaaaattaaaaactttattaaatttaaatttatcggaattaattcaccagcgtaaagcactgccattgcattgtctccgttcaattcactcaaatcacccgcgtaaatgaagctcaacataactttgaatgctgctggttcaacgtcgggcaccaccaccacagggcaattatcggaaactaattgaaaataattaggataattaccataaatattgaaaataattaattttaattgtttgcttgtatttttattactatttcccgcattttcattttgtgcgtcaaaacggaacattgcctcaaatacgtcggaagccaacttcaaaatgaatt

SEQ ID NO: 32509 - DNA, 1347 bp, Heterodera glycines
  misc_feature (1270)..(1270): n is a, c, g, or t
  misc_feature (1296)..(1296): n is a, c, g, or t
  misc_feature (1316)..(1316): n is a, c, g, or t
  misc_feature (1336)..(1336): n is a, c, g, or t
tttaaaataacattccgattttcatcctcattgatttcgtttaaatcatcattttcgtttgactcttccaccgccggtggttcaggcaaacacatttcaatggcaatattatgtagaacagcggctgctagaatggaagttgcgatccgtttaagttgcaagcggcatgatgttctgaaatagcgttttttattttaaaaaatctttaataactttgcaatcgaaaatcgccgtttaaaaattccaaatgcgtgctcaataacagaacggcctttgcataaagcagtgttgaaacgcttctcggcaacactttttggatcacgaaatgggaccactagccatttttttaatggatagccactatctcccagcaaaattgaattgcctgccaagccggactcaaaataatcccatacatctgattgctttaaattaattatttttttaaagcttattcttttgaacctcaaaacaaaggaatcatgtgtgcttcctggccaccgcaaatcaatattcataaatttgcacctcatgtcgcaaacggcttgcatatttaatgaataaaatgcttttcgatttatataactttcttcgcggatccgggacccttaagaactataattaactcaatatttctttcttataacctcaattttatatgagaacagtcaattgatcccatcacgaatggcaaatcgcaataattcagaaaatcgcatttgattgcgatttcatgttgttgtgaatttggaaatttaataaaatcggcactcttatccgccaatgcctttgagacgcgatgaacaacaagtagcaataaaatcaatcccttcaccaggaaaattttaactggtgtttaatataaaaacatatcaattttcaaagaagttaaaaaaataaaagcaaaataataaataattttaaaattaaaaaaaacataagcaatttaaaaagaaaaaaagtcgctttaggaaatgttgtgtttattgcgcaaatcatcaaggggtatccaaattcaagttataaattaaaatcacaaaaagcatttataaatgcaaaaataaacacattaatttaaaatctaattcgtcattaatatttataataaaatcaaattcaggataaatttaaaaaatacaataaaaaaaaatcatataaataaaatacttacatttcattgatatctgaaatttttttaaaagaataattataaaattaagttatacaaagaaaatttaatatttaatttaattatatttcttcaaatgtngtatatttctcaattaatcccataantatttgtaccccttatatangtaaaagaataattaaatgnaatgatacttt

SEQ ID NO: 32510 - DNA, 1262 bp, Heterodera glycines
  misc_feature (86)..(86): n is a, c, g, or t
  misc_feature (91)..(91): n is a, c, g, or t
ctttcgctctctcgctctctctctctctcgctctcagtctcttctctctctgctttttgttcatttccctattcttcacaaaactnggtcncacattatttctctctcttctcgctttcctctttctctctgtctcattagtactctcttcccctctttctctctctcgctctctctctctctctctctttccctctctctctctctctctctctttccctctctctcactctcctccttcattttctctcttctctcattctgttgttcgtctgatcgcgctatttgacgctttttagcagcgtgagcatttggcctcaaaaaatgaaaaataagtgaaattcatcagagaggcaggcagcaaatccattcggcttttcattatccacgagccataggatggatttatttttcttgcacttcttcggctaaatcatatgcttggtttcggaaaattaagttcaaaatcaaaaaacaaaaatcatttttaaatttagaggtaatttttaaaagttaatttaaaaaatgagacttttttcctttttaaataaattaaagtttgtgtttctaatttaattaaaaaatatttttccctttttaaaaaccgaaagtttggatttttgaacaaaattggaattcatagccaaatttttttcaattttgaatttttaactaaatttttaaaaaattattcgacttaaatttctctgccgattttctccacaaaaaattcgtttttttaattataagaaaaagcattatttatgttcaagcattatttatgttcacattttccatcagcgaatagaaaattttttgcttccctcagccttactttaaagctcgttttttataatttttcattgttcgtttgttttgagaaatttctttaaaattcttccccgccatttccaatccccgaaatgcttagggaaccccaattttccggccacaaattaatttggatcctacattttaccgggcggagacatccccgggagcctttttacctttaccctactaatcccccctaattctcccatgtttttacgccacgtcccttcttcttgtccccctgctcccattctcgttattaagctgagtgagtgttgtgtgtgatcacctattagccaaaggtgctgccggccgggagtgatcgattattgtccaatgaatgaacaaatgaatggatgaaaatgcttcttcaaaagccaagaagaagagggagaagaagcatgtgagaggaggagtgaaacgagaag

SEQ ID NO: 32511 - DNA, 649 bp, Heterodera glycines
ggccccaactaaattttaaaaacgggcgcgaagcgcccgtctggcccaaacaaatttaaaaaacgggcgcgaagcgcccgtctggcccaaacaaatttaaaaaacggtcgcgaagcgcccgttatgagtccgcgaagcggccgaatgttcttaataaaattaaaaacgggcgcgaagcgaccgtcttgaggccgcgaagcggccgaatgttcttaacaaaattaaaaactggcgagaagcgcccgttatgagtccgcgaagcggccgaatgatcccataaaattatgaaatgggcgcgaagcgctcgtcctgaggccgcgaagcggccgaatgtccccaaaaaaattaaaaaacgggcgcgaagcgcccgtcctgaggcttaacagccggccgcgaagcggccgaatgatcccataaaattatgaaatgggcgcgaagcgctcgtcctgaggccgcgaagcggccgaatgttcttaaaaaacgggcgcgaagcgaccgtcatgaggccgcgaagcggccgaatgtccccaaaaaatttaaaaacgggcgcgaagcgcccgtctgaggccgcgaagcggccgaatgcacttgctccccacttatcaaacgcgcatgcactagcaacgaagtcctttgcgcgaagcgctca

SEQ ID NO: 32512 - DNA, 995 bp, Heterodera glycines
  misc_feature (189)..(189): n is a, c, g, or t
ggggcagcccccccgaaccgatgcgcccagattttggggagaccgaaccttccgggatagcttcactatagcccgtccttaattaggcgttggattttgctccccatatttgttgagtaccccaaacgggcactcgaaaaaatcgattttatttttgttttcggggcagtccccccgacccgatgcgcncagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctcccccataattgtttgagtaccccaaacggacacttgaaaaaatcgatttttttgttttcggggcagtcccc

SEQ ID NO: 32513 - DNA, 1027 bp, Heterodera glycines
ccatggccacgattatgtgaaattgttgagttggcaattaaaacgggaccctaaaaattcgaaaattataaaaaaaaaattagattatttatgctttttttgaaaaatagaatttttaattcaaaattttcttaaaatgaaaattttcattataattttttttccatttgtgctcaatttttgagggcaaaataaattttttattttggaaaaataacaattttacagcaaaaaaatatatatataaaaattcaaaatttttccagtggcacttatcacatgcaccgccgatgccctgaaggaacatttaaaatttttaaaattttatgcgaaaatcaaattcaaaaggtaaattttgtcgaaaattttattaccaaaatctgccaaaaaaatttttttaacctaccatcggcagcgactgttttttaaagtaaaatagttttttttgacaaaaattttcgattttccttattcgtatctcgcaaagaactcagtcattcaaaattttcaaaaattttagttaaattaaaaaaatccacaaaattagcatttttaaatataaaagtttgtttttttcattaaaaatcttaattttaaggattttaaaggtcgaggatctgaacatcggtcccattgtactgaacatggaaaaaatgtaaacagtgatttttaaaaaatagattataattttgtttatttttaaaaagtaaataaaatttttttaatatatttatacatgaataattttttattatttatgatttttattattttttttcctcacttccggctcccaaaagtaaatgccatcgtatgcactgcgctccactcggataccgttcatcaacggcggcacgccctccacatacagtgctggggtgacattttttgtggtactgtcatatccggcgtacaaaatgtccacaaattcgagccgactcagcgactgccgttgcaccgccacatcgtccgggtccaacggcacataagcgaacggcgaatggtacagttgaacgccttgagaacc

SEQ ID NO: 32514 - DNA, 1295 bp, Heterodera glycines
  misc_feature (38)..(39): n is a, c, g, or t
gctgcgccagggcgcatgtttcaacggcacgtcccgcnntgcatgtggccgcactgttcgcatcggcggcaaaagcggcagtgatcggcaccggcacggacacggcattggcacggtcagtccattgattacgtcaccaaatcattcataaattgtgaagaattgtaatttaaaaaatttatatgatttaaattttacgatttttcagaattttcaaaaatttaaacaattttttttttaatttttacaatttttctgcatttttcaagaagttaactggcaatggtgaaaaatttttggtgttgtaaatttttgcaatttttctaaattttctaatatttaaattttaaaagttagaaatttagacgattttttaaggttttgaattgattgaaattcttattaattttctaaaacttctttgtgtaacttaattaattgggatgaaaggaaggaattacaaattaccctcaattagtgacatgagtgaaatggatggttaattacccttaattagggatgaaaatgtgtcacggctgttcatgaactcggacgaggtgttcaaaatgtgggaggagaacatccggcttgctgaagacgaaccataccaccagcagcagaatgggcgcggcacgcgcaaaaacgcgtcaatgcacgagcggcggggcgtgggcggtgccgcgcggcacggcggcagcatcggcattgtcagtggaggagacattggcggcacattacaaagggtgcgctaataagagagggtactgtagaaaagacgtgaacccggtcgagagggtaggatacggtaaaggaaaaataggaaacggtgaaaacggtagaaagtactgtataaagaataggaaccagtaggaaggtgtactgtaaaaaaaaattaggaaatggtattatagaaaagtggagggttgtacttaggaattgcatgagtctaatgttgcaattgattgatgcagaaattagagaggatactgtaaaaagaataggaaccggtaggaaagtgtactgtacaacaatttaggaaaggtgggtgtgaatactgtacaacattccgtcaaatctccctttttttgagaaactttacctatcaaatggggttggaaattgccataaacaaataccgtaataaagtaccggctttaagtacagtatgcgtatttctttatttcatgtacggtgacagtaccttctctcattcccaattaattgatttctctcccgttttctcatttttctttgataaaatgacacccccacaaaaaatgacgagtgggggtcaa

SEQ ID NO: 32515 - DNA, 965 bp, Heterodera glycines
  misc_feature (11)..(11): n is a, c, g, or t
  misc_feature (29)..(30): n is a, c, g, or t
  misc_feature (58)..(58): n is a, c, g, or t
tgtagactgcntagaaattcagtaccacnnttgtccacttcagtacccggcgaatacntcagtagcgttgaactgagcagggggtggccagcgaactttatgtagagtttgtaagcccgatttttccaaatttaaaaattttgaaaattttcaaaatttctcgagctaggccccctagaaggttttggggtttttgaattttatcattttttgccgatttttccggggaaaaccgagaccactttcaagcaaccgtttttcgagctctatcgattggtgggatttttgaaaaaatttcggtttttttccggaaatagaaaatttttttggcctaagcgggacatttgagtcccgggcccataactcgtcaggggtcggttttagcaaaaaattgccttagagcaaaattgtagagctttttaagctctattgaatggtatattacatgtcggaaaattttcaaaaattttcgagctaggccccctagaaattttcaaaaaatttttttagggcgagaagtggggtgaaaaatatttttctggggtaaaataaggtgctgagcacgaatatgatgtctgttttttgtttgggaaattttggaattttttaaatttttttgaaaatcggtcactttttttgccctcgggattttgggttaaagtttgaaaattcataactcagttcagatcaggtctattttagtgtttagaggctcaaaaaatggagaaaatatcggagaattttatgcatattatttgagttttctatcaataatatgaaaaaagttattccagaaattctggaaattttcgaattttcagaaaaaaattcactactcagttctgaaaagatattttgtaaaataaaaatagcccaaaaatccgcaatttttgctctatttgataaatattatttcatgattttatcattttttagtagaaagttataattataaaagtgatttt

SEQ ID NO: 32516 - DNA, 1642 bp, Heterodera glycines
ttggggacgactggtccttggcgacggccgccccccgggggttcgaccgtaccgaaagattgaaaagtaatggggcaattagcgaattgttttcggtcttaagaggggggtgggggagaagggtgatcagaacagaggggggtaaatgtggtgaaatgataaaatgatggatggatttgtgaagaaaggccaagtgcgaatgaacgtaatggacattaacattgtttgatttatcaaaaattattgagatattttttaacgaaattggtgaactcaaagggaaaagctgtgccattcgtaaatggtaataaatttcctgctgggatcattaattgtttgtaagataattagtctaacttctgttaaatgaaagactcaaaataagttcttttttgggacggtatatttaaaaagaaaccactgcaaaaaataacatgattttggttaaaaatttgtttttattgcttacatattatgtatgaaagttaatgagttaattagtactgaataatgagtagtgaatcttgctgaagaatggggatgtgtaactaatttttattttggattaacttgaaaatgttaagagccaaagtgatgaaaaatgggccagagaataatttcccaaaattgataaatgtcacattgaaaggacggattcgttgataaagcaaagtgaaaataatcaataatcaatagataatttgataagggggaaaagaaattgggaaacaaaaaaagcgattaaaatttaaacttagagggattttatatatgtaaataagcaaatgggcaaaagtgagatgaattaaatgatagtcaatagagagaaaaggattatagggggatagatttttcaaattgagaaatttccaatgtttttttttctcgaccttcaatcaatgatcaattctcagttctcgagtctgcaaaattcgactcgagcataatacaatccataatattcaaatgaactttccctcctcttactgtctccgctcaaaaaacgattggccaaaatataaatttgccgttgtttttacgaccaaaggcataatgagagaatggactcaaaactaattgaaagtgataaaaactgactaaaacactcaaaaatttaaacaaaccaattgttggcctttgagaaaaacaagggaaattgaaatgagggcaatttggattgaatcgcataagaaaggtgggcaaagggaaaatcgagaaaaatgggagagaaaggggaacagtgcttaagggaaaagcaaaacgcaagagaacacagagggaacaatgtgaagaggggagagcaagagaaaaagaaggggagagacaaagaaagagagagagagagagagacagagagagagagagtaaagagaaggagagagtggagagaaaaagccggtgctgacgtaagagaagatggccggacatcaaacaaacacagcggcaggccttttgacaaaggcagccattgctccgccattagcacagagaaagaagaggacagagaattgcccctcaagggaaatcgatcatttggcggcgtacgcttcaaagggaccgccaaggcgtacgcttcgcttcaaccaaagggaccgccacgctaaaaagacaccgccgccggctgctccccacgcagtcaaaa

SEQ ID NO: 32517 - DNA, 1063 bp, Heterodera glycines
  misc_feature (1057)..(1057): n is a, c, g, or t
cccccccaaggctccccaatgttcgttcatatcgccccgcagggcacgtctatatgtttttaagagagagagagagtgtgtgtgtgagagagggagaaagagagatagcggagtgagagaggagagagagatggagagagagagatagagagtgagtgagagagagagagagtgagtgtgagagagagagagaggtccattaagagagggagcgagagtggtccattaagggaaaacagttcattagtacgaaataatggggcaaaaagaaagaaagtgaaacataatgaaaaaaaaatgaaataattagtagcacaggcgaaaaaaaatcgaaagcattagcataaacttgctggcatagaaacagacaaaatagcgaaataacgaaacaattaaagggacagagaaaaagacaaaaaatgagagagcatagcatagacaacgaagcccattcttaagcatgttttagatgctttggctagcgtcaaaaaagtgatgtcatagcagtccaacttttgctcgtgaggactcacaaaaagcgggcggcggagaatgggcggcggcttaaaaggccttgcaaaaaaagagaaaagaaaagtatgtttatacaatttaaaacagtaccgttgtcggtcggcaaccagttgatggcacaatggaaaataatgccattgccccccaggggaatgagtggttgttaaacataatgccaagcgggccaaattcgcccgctaattgccggacgacgaagacaaaacgacacacaattaagcagtattggcaacgatgaaaaacaaatgtgaacgaatcgaggcggttgagatgaattattgtgcatgcaatcttttgttgagagcaggaaataaatttttcatttttttgtttatagcaaaacaaattaatttggcacctaattagtatggatggcaaatttttggtaagaaaaattgcaaaataattacttaaattgtaaaaaaatgccgaaaagtagttagaaaataattacaaaaagcccgaaacaggtacaagaaaaattattaaatctttgagtagccanaaaata

SEQ ID NO: 32518 - DNA, 1455 bp, Heterodera glycines
aacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaaacggacacttgaaaaaatcgatttttttgtttcattaaatatttttttcagaaaagtcatgcgcacccgtccgatttggccagttaagcaacgattgctgactagccaaaaggttcggtgccgtgatgaaacgaaccagcactgcttactccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagagggaaacatgatttcaaaattttcaattttttcta

SEQ ID NO: 32519 - DNA, 1135 bp, Heterodera glycines
  misc_feature (57)..(57): n is a, c, g, or t
  misc_feature (117)..(117): n is a, c, g, or t
cataaaaacgacgaagataaaataaacaaaattgcgcgaccattgtccctttattcncgtgacataattaattaattataactaattaactgattgattgactcacttccgtcggcncactcttcaacaaagcattgaccaaagacataatggctactcggactctgttcgtttccttcggactgttcccgtgttctcgatgcaaatctgtaaaatttaaatccaattcctttggttttgctgatttcctctttttctctctctctctctttctctggtttctctggcgtctctctttctctcttcactttttttctctcacttcgaattgtctcactattttctttccctaccgtccacaagtctttgaaagcgcgtccgttctcccaaaagggtttttgcttctgtcagtgctctcaaaacggaacggtggccaaagtcagcgacgacgcaaagaccggaaaggatttccagagaaagcacctgcagaaaaagagaaggacaatggtaaagcatcacaaaatggggagagggggggggagatcagagaacaattggagaatgacgggaagtgatcagagagaagtgatcggagaatgataaaagggcaaaggagtgttcagaaaagagtgatcggagaatgataaaaaggagaaggagagtgatcagaaaagagtgatcaaagaatgataagagagagaaggagagtgatcagagaggagtgatcggagaatgataaaagggaaaaggagagtgttcagaaaggagtgatcggagaatgataaaaaggagaaggagagtgatcagagaggagtgatgggagaatgattggtgggtaataagagtgatcagaaaataatgatagtgagacggagagtgaccggagaattaaccagattgattgcctcgaacgattctaattaattttttaaggaatgaagttgaacattgaaaagaaaaaaaggagaaaaatgacttacttttaaataagacacaaatgaaaggaggaaaagcatggcgaggaatggcacaaataattagcccaaatttaatagcaattacataaattagccgatgagagagagacttttaagcccatcggcagaaggcgaagacaaaaagaataaattgaagg

SEQ ID NO: 32520 - DNA, 1188 bp, Heterodera glycines
  misc_feature (1132)..(1132): n is a, c, g, or t
ttttcaaataatttttaaatttaatagatatccagaaaaatggctatctattttttgagaaattttctatgcaacaaacgctctcgaacatgaaacgaagtgcggtgcgccgtggccattttatttttcaaataatttttaatttaatagatattccagaaaaatggctatctattttttgagaaattttctatgcaacaaacgctctcgaacatgaaacgaagtgcggtgcgccgtggccattttatttttcaaataatttttatatttaatagatattccagaaaaatggctatctctttttttgagaaattttctatgcaacaaacgctctcgaacatgaaacggagtgcggtgcgccatggccattttatttttcaaataatttttatatttaatagatattccagaaaaatggctatctctatttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccgtggccattttatttttcaaataatttttaaatttaatagatattccagaaaaatggctatctctttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccatggccattttattntttcaataatttttatatttaatagatattccagaaaaatggctatctcttttttt

SEQ ID NO: 32521 - DNA, 956 bp, Heterodera glycines
ttaattgtgctcggacccgttttttaggtatgactcctgtccgtttttatatcattttaataaattgggaccatctcaccctctccaattacggaaaatagaaaaaaaaaaattttttttacattttttttttgcaaaaaggttttacttagttaaaaacaaagggatagacggaaagcaaataaagtttgttttggctttttaaaacaatagtgatttttcaattgaacctaattttgctcggagcaatccttccatatttatgtgttaataaattgggaccatctcaccctctccaactccggaaaatagaaaaattttgttttccatttttttttttgcaaaaaggttttacctagttaaaaacaaaggaatggacggaaaaaaaaataaaaaaatggacttaaaaaaagaaaaatttctttttcttgaactttttcacttcgaaagtaatgaacattatttccagtgcggtgtgctcgactcggtgtccatccatttgtccaggcccgggccgggccaactccatctccaggttcagctgcagcaaccggtcgagttggtctggtcaccggtgctgcatttgatggtcaacgacgtggtcaggtcagccgctgctgtttcacaaacaaacacattcgaagtcgaactcacctcctcgtgaaatttcttttttttatggccaggcctctaaattcggaaaaaaattattccttcctgggaatgtattataattttttaattaaatttatttttaagtgtgaggagcagaccacgtacggattcggggacaccatttaccgcccattaatcccgcggcttgaaaatcatcgcgtgttgacttcctttatcggtgaaatatccggtgctggccagtattttcgttacgacgacgacagcggccgtttctgtgtcgtgtctatcaacacgcatgaagctaacgtaattaaaaatta

SEQ ID NO: 32522 - DNA, 1632 bp, Heterodera glycines
aaactgtattattattattttttgcctaaatcttattttataatcgtttttgaccccagatacttgaatagtttaattcgatattaatatattcgtagacttcgtgattttttgaaattttttcggtgttttttccgggatggggtcttaaaaaaacataaaaggcccagagaatgagtaaattgggtggccgacgttacaaaagtgcatttcaagcccaattccttggcccaaaaatggcacggcatacctctttccatttgatgacacgtggcagcaaaagtttgtgcagcagccgacaggaagagagcgcattcgggacggctttttcggcagggataaaaggcacaatttcgaacaaaagttcgagcggaaggcatttgggggccattgttgggagaagcaggcacagttttgttatttggggtaattagtgagcaattagctgattagcattgaacggaaccgtcgcactggcactttgaacttggtttggcccgtttcgtcgcaatagcagcagaagcaatggccgttagtctctcttttccgtttgctttatctcttctgctttgtctgccttttccttttctctctccctctctctctttttatttttctctatgccttgcgttgcgttcgtcctttcacaatgattcggccgcttttcgtcctcgcccgaggggttttgcgtagaactgtctcgcttttctgcttccacttctaacgtgcacacttttgtctttgcttctctgttctcgctttttctcttctagcgcaacactctctgcgtttctcgcctttccttccgttgtctatctctgcgttctctatctctctcgctctctttcacttcttcgttttgaataggacagagaaatgaatccaacttttgttttttatgtatttttatagtttagcttttcctaaaattaatttgggaatgcttctcaaactagaaaattttattgggtaatttaaggcagttagggcctcctcatttacaaggagttcagaagagtgagtaaccagcagcagcagaggaaaaatgagcagccatcgatttgcatacagatgacaaatggcattttgggagggaatgccacaatgtaaaaatggcatttaccatctcattagtgtacaataattcatgtataattttatccgttgccgttttcatatttgtacactccgccgatggacaattaattaatcctccccatttttgctcactgatcaactgctgttgctgatcactccagcgaaaaagtgattaaattattgcattgtgtattcattttaatccgactccatctgctgctggttattgatgtccaagcatccaaagcaaagccgaccaataaatttcgcattcacagattaaacatatttatagaaaaattttttccatttttattaataaattttttaaaattttttttataaaattcctataggcattgaataaattccgtatattgccgggccaagaaaagtcgggcttggcttggggtccaagtttttaaactgggcccgggtatcactgcaaaccgaaaatacatattcataatttttcaaaaactaaaataattatttcacaaaagaatttgtaatttaatggtatttttgtttgtt

SEQ ID NO: 32523 - DNA, 995 bp, Heterodera glycines
ggattgacaaaaatagagggccatgcaattcaagaacggcacaaatactaagagagttcggggttgggggaaagggacaaatcggcacggaggcggtggcattccttcctccgttttctattgttccttctttcacctgctgctcccataatttgccgcgagtgcaccacacgccgctgctgggggtaatgcgccgggtcagtgctggcaaaagtgtgcgccgtcgtcatttctttgttctgatttgagtgataaatggcaaagttccttccaattttcacttgccgtctcaaaaattgtctccctccccctctctctttctctcccccttctcccttcctctcttctctccctctctcttttctccctttctcctcctctctctctctctctccctctttttctctctcccttccttctactattttgtctttttcccgtttttaagactgttttggcgttgtgtttgttgttgttatcacctccccttttcactttttccaatttgtcaatgtctttctcattccttcgtttagttgttcttccctttgttctctcttcccttgatttatttggtcctttcttcttccatttcactttatcttcttcctcatcctgcctctaatccctcccctccccatttattattcaatttttccccccgccccgccccaatttgattccttttccttctgtcccctccctctcctttgtttctgtttctctcaccgcgttgtcccaatcactgaaagtgatcagcaaagtgcacaggtggtcttttgactcgcgcatctctcttttcttccgttttgcctttttaatcaaattatttgctgcattttctaaatgtttctttcattcattatcattatcattattgagaaaagaggcaaaatgactgatttgattacatgaattataaaaaattatcacataatgtgatttgcaaatttcaattaaaaattagacaataaaagggaagggaaatgggtgat

SEQ ID NO: 32524 - DNA, 875 bp, Heterodera glycines
acgcgtcgcccgcttcagcagtgcgcgagacggcttccgcccttcctcgatgatctgaatttcgaagatttcatttgaaattttgattttaaatgttacaaaaccttaccggaacaagcgatcgtcggaatgcctggcgaatgtaccgcaacggggaggaggagaaggtggaggacgcgcagctggtcttcttcttcggcactccggtcacggtgctcgcccgctggcaatacgcgacggcgccgttcctccgcggcactgtgccgttttggccattgcacagcgactcgccgtcatggccttggcctgtcctggtgccgccgctgaacttctctaccatgctggtgttgatgcaactgttccggcgtcgatcagggtctgcgaagaagcagttggtggcgccgctctccagcaagaaacggtaggacgaggaaagtcccgcgctgctttcgccaccggcgtcgttccattctgccggcgactgatccccgtccttttgatcactttgatcaccgtacccggattgattaaaattcagctgattatgatgttgattgcccgagtcgttggtgttggtgttgctgccgtgccgtcctggctgcgagcggctgctaatccgaacggaacggcgagcgtcgccgcctcggcccgttgttctgttgtgatggtcaactgctgaaacgacgccgacagttgtggcactttcgagcactgaaaatgataatttttgggaaggggagaaataaagtgatttatggtgaaaaaagcaaaacaaagtgatcagaaaagcggacaaacaaaacctgatttttatgagctaattttttgttttctgaccgttgggctcggctataattgatcaggaaagaagcgcg

SEQ ID NO: 32525 - DNA, 1172 bp, Heterodera glycines
aatgcacaattaaactccgtttgtacataaaattttgcaataaatttttccataatttcaatttattaacagatttgtctaaatccgatgaattgacagaaacataactgctaatgcttaaacggagtcttaaattattatttcggtaatttattgaaaaatttatatgttttaattaacaattaaagatatttttaccgaataaaatattgcctttattttcccatttttaattgacaaataatttagtaattattctttctttccattctttgcttctcctttctttaatttgatttgaaccaattgaaaaatccatctgaaaaatgaaaatatattttttttctttttgattaatttttatatttgtcttcgacaatttgaggcctgtttatacagaaattttttctatcagtaatacttctaacttttatctttgcattaagccttggaaaaaccgaattaatcacttctgtacatttgactttatttatacatatgtagaagatatattacagagtttcatttttaagatggcgctgtgttaagcccaattccgtttatgtttttaattactgcatctttcttcaccggaaagaatggaggcaattaacagggcaaaaacgatgcagccgatgccaaacgacgtgtgcaagccgatcactccgctgttccaatcagcagggggcctaaattttgcgattccgataatataaatttcaaaaaatgtattttcaactaatgatcagcctttttgataggcatgggcctagtttaatgtttgaccagagaatacccactaaaaactcatgcctggatattcatcatttttaatttataattaaaaatatgaaaatccgtctcgtattaagcggtgaaaaaataaaactatttatttttcattgaaaaactgggccttcctaaccattggggagttactgaaaattttaatttttaaatgtttttatgtttgagtttgatcccatggagccctaaatactgtgatatgtgagcattcatccgaaatcattaaaaaagcaaaacaacaagcactttttccgataacacaagctgtcatgtgccattttaaggatgtccttgagaaaagcatttctttactgagttttttggtgcgacggcttttcggcatttgaatagatttgaaataaaat

SEQ ID NO: 32526 - DNA, 1280 bp, Heterodera glycines
agtaaaaatgattaaataatgaattaaatgtgcctgcgggtggagagcattcaaatggtgggtgtgcgtgcgcaactgttcgacggcacccgccctgaacgtatcgccggcggcaatgagcacgcgatggccattctcattgagccaaaaagtgatctgttggcagagaaaacagataaagggaacacttcctcctctgagttcaccttggccaaattggtcgatttgccaacgccattgacgccacagaacacaatcacatagggacgtttttgcgctttggcgtccaaaatgtcgcggagaatgtccacgcggcgctttggagtgagtaactgaaaaaaacgatatcaaatgatcttaacgaaagataatgtccaaggacataacaaccaaacaacaattttttaaattttgctctctccgtatttccctcctttacacctacccttcccttttttcgctataattaattgcctggacaagtgcttcgcgcatggcctcgcgcacagtcgacgcaactcggttgaacgttccgatcactttgccctccaatttggcagcaaccgactcacaaatgcgttcagcaggttccgacgcgacattttttgcttaaattggaattttactttttgattatattaaacaattttttaaagaaagaaataatgcttactgatcagcatttccttcattttctccatcgccggctcaatgtcgcctcgggcaagctgtttggtgcccaccagcgatttgaatgccgaaaaccaaccgccggaagccgaaatgcccttcggtttcgctccgctgaattttaaggctgacatacaaattttagttttaaagcacctttccccgtggtcattttcgctgtcgctctccgactcttcgctgtccccaatttgctgctctccttcatccaatccgggcaaatcgcccttcagcgtaccgacaaattttttctaaatttagtgtaaaatgcacaaacgcattcccgtctttcatattgcaccaatttctcaccgctgcatttactcgttgacgtgccaagccgcgtactgctccgccttcaggacgtcctcaacatgctgcttcagcatttccgtgttcgccaactctctcccacgtgacaatgcgagtcgaccatcaaattttagtgaactctaaacgaaaccgtaatagtaaaaagcgctaaaacctgaaactttggtagccgatcttcgccaaaaatgattttgcgctacaattgctccctttggttcactaaaattgggtttgttatt

SEQ ID NO: 32527 - DNA, 1347 bp, Heterodera glycines
  misc_feature (1329)..(1329): n is a, c, g, or t
cagcatgcgcgttttgtgagggcgcgcattggaacgacaattgcgaaaagtacagaacttcgtcagcgagatacgcagtcgccagagagcgaaaattatgcgtcaaatgtttaagaagggcgcacgtggcgatgaagtgcccacgcccttcgaagtgctacttatgctacggcgaacacccaacagcactttgtcgacaagggaggcgacaagataggcctacgagggccatcaatcccgtcactcaatccaaaatgagaaacgagatggcggagaaggatcaattcaaagaaattggttcggcaccgacacaatgcaatgcattgaccaaggacaagtcaaaagtgcttctgcgaacaacggaagtcacaatcttcaatccatctgatccaaagaagagcacgattgcgaccgttttcatcgatgaaggaagcgagaggtcatttaaagaccgacatcgctaaacgtcttgaacttcccgttctcgagagggagaaatgttacctcaccagttttggggaacggaaccccagacattactcgagcaacgtggtcaagatcggattcctgggaatgaatggagacgcatacgtttgctctttgaacgaaatggagttcatggtgaaggcaatgccaatcgtggcactcaattcggtggatgaggaacagcttcgggaaagaaagctgagattcccgacgaagctacaacaaccggacattatgctcggaatggatatccgacatgacttgaacatacgggatgaagtcgaaaaactgccaagcggatttacactgtcaaattcgcgcctgggaagaatgataagcggaattggacaatgggagaaaacaatttcgccgtgggctcaagtgacgttcatcggttcgctcgctagtgccgtcctggaccaaagggaagaagtccatgaaccagaaaatgttctggaagaccaaatgaagtccttttttggactcaacatcatcgggatggatgatgacaacactcagttggatcgggacgaagtcatgaaaaccttcagaaaaaatctgacattaaaaaaaacggccgttatgaatgcggactcccatggaatgagagagtcaatgagctcccgaccaactacaagcaagcacgagcaaggctgtgcagcacgatacgaaagctgagagagcataacctcgtgagacagtaccaagaaattctggaagactgggagaagcaaggcataactgaaagagtgttagagccaagcctatccataggtccggtgcactacttaccgcacagatccgtgatcagagaaagataagcgacaacaaagatacgcattngtatggatgcctcagcca

SEQ ID NO: 32528 - DNA, 1425 bp, Heterodera glycines
  misc_feature (1367)..(1367): n is a, c, g, or t
  misc_feature (1392)..(1393): n is a, c, g, or t
  misc_feature (1409)..(1409): n is a, c, g, or t
aaaaaaaaaaaaaatgtccatatttcccgccttcggaatttttatttttttttttgattacgggcctgtgattacagtgggtaaaatgggttcataattgtaaatagtatagcgacattcaaacacaaagaaacgcacatagcataaaccaactgtgcttacaatgacccatttaacccataattgttctcttactaatatcagatgcataacaaatacccaaaaaacaaaaaaaatggcaatccaaatacacttaacaattgccacccgtctttgtttatggattctacggctttgtcgatatatttcattgactcgaatattttgatcattatccatacgcttctttcgtcttctatttgttcccatgagtgttgcggtgatgaaactttttgctgaaaatggaaaaaacagttaaaattagagctcgacacttttgaaaaaagcctggacctgagactggattccatttttgagttggacctgggttccatttgtacctggatttcctggacaaaaatccaagtccaggaaaaatctaggctcctcgaggcctggatttaaaaaaagatttgatgatttttttaaaacttgaaaaaacatcggtcatttgaaataacaaattcaaaatttatccatccaggttttttcatatttgacctggacctggatttcctgacaacaacccaggccttgtgatccagatccaggtcgagctctaattaaagttaaaaaaaacaatttagactgttttaaaatattttaacaaatcttacatttaattatttgttgtaattatcgctattcccgcgtttaaatactcaaacattgtcgcaagattttgttcatttttgttgctgagaattgaagaatttttgattttttgaagaatggtttttgtgtcaatgatttgcttatcatttgatacaaatcccatcaaatctcccaatgcttctttatcattgacaaacattttcagcagattttcatttgaaaagtcttttctcatcaattcacaaaaatttttgcgcaattttccaaaatttccatccatttctaattcaaatttggcaaagtttgcatcgcacaaaaggccaaaagtatgctttttccaccatgcaatttccgattcggtattttcaatttttgatgccttgtccaccaattcatgggccaatttgaaataatctgtaatacatggaaagtttagtgtgtttattttaatcaaattttaccaattttggcatgagttttggtcgaatttggcactttttgagtgcttttcctcgctaaaagcatggccatagcaaagaaaaacaataattttggcggtaaattgaatgaaaccattttcgaagttttatcanaaatttaggctttcaagatttctannaattaattggaaatanattttaaatcactctt

SEQ ID NO: 32529 - DNA, 680 bp, Heterodera glycines
gctttattcagcgctacaacagaagacaaaagttggtgaccaattcacggtagggatataatcgtgactttcagagatagccattttttgtcaagagctatttttcgtgcgttttcaaacacactattagtgttttattcagcgctacaacagaagacaaaagttgtgtccaattcccggtagggatttaatcgtgactttcagagatagccattttttgtcaataactatttttcgtgcgttttcaaacacactactttcagagatagccattttttcaataactatttttcgtgcgttttcaaacacactattagtgctttattcacgctacaacagaagacaaaagttggtgtccaattcccggtagggatttaatagtgactttcagagatagccattttttgccaacatttatttttcactcgttttccttccttccttctattcctctatccattacctccctacctccatccacctttttcgctccgttccgtcatcattttattgcgtcgataggataggatcatcttccccccccccccccattgtgcggaacaggggtcattttcgcgtgggccgagtttttgaactattacttttttcattgtcaaccaaattcaacaatcttggtatcattcgatagccctaagtgccctctattagtctgcaaaatt

SEQ ID NO: 32530 - DNA, 1535 bp, Heterodera glycines
atccctctgatcggccctttcctccccaggggcgtcccttcggttggctgctttccctgcgcgagtgtaagcagcgaaatggcacaaaaattgagccaaacgcaacggacaaaaaaggcaacggcggagagaaaaatgccattgaatgtccagtggaaccgaaatgtgaagggatgacggaaaagcagcagaaggcggaggagggcgcggaggaggagggaccaatttgcgacagcaacggacgaacgcacaagtgggcaatttggggggtggggaaacaaacaataaataggggggaggggggagacagggggagaagcgattggcatggatgaagcaattcaaaaaataggctgaaatgccatgcccatgatcgaattacttaattgacatcgtcattcatttgggtcaaaaagtgtacttaaaaatgcaatggtaccgtatggaattgccgccaccctaccgtattcccaacaatcagttgttactttttcgttacaattccccatcacctatttgtgagctccctcccatccaggaacatttgcatgtttgcgcatgcccactgtttggcggccaaagatggccaattgttgcgaattgtgccaatcgaacgatgcgaaaattcgctgccgaaagtgccaggggaaacattttcccgccggggagacagtcaaacgacggacaaaacggaggacaaaatggggggcaataatggcgaatgcgaaaggaaatgggcattgtgcaagcggaacacgacagagcagcaattgcatacggtggatgatggcgcaccgtattgcggcaccgatttcatcacttaccgtacctcttgcgactttcaggcattttccattaccgtaatcctttttatttgccttacgcttcttttgtgttcagctggcacagtgcaaaagcgataacaaattgggcttgctttttaaaggcccgtgcgaattgtgcctggcagaagagtgccatcgatcggatcgcttttcgatcactgccgacgacgacgattcgcattttgtctgcgaccaaaacggcgagactttgtcgcgttgcgaatttgaaatgttacgctgtgttgtgcaaacaaatttgggctacaacgtcacatttacacatgtgaacctttcaaaagtgtgccaaccaatttttcttccgttttccaggagggaaagtgttgtccgacggaggcgaaatgccccccggcaaaaatgccacgcaattcgctggaggaagtgtgcgattcaaatggacgacgccatcagagtcggtgccaatttgaggtagcaaaatgccgagcgaagaaagtcgagcgagagacgaagccattggaggagagatactgcccatcggaagaacttggaaagggcggaagagaaggaaaatgggaggaagaagaagaaacggagggaaggggaggagaagaaaaaagaggagatggaagaggagaaggaaagggaggagggaaaagagaaggaggagaaagaggaacaggaagaggaaaatgggaagaagaagaaggaaaa

SEQ ID NO: 32531 - DNA, 1202 bp, Heterodera glycines
tttttttttttttttaattttttgtaaccccttttttgagtaagatttaaaataaaaaaaaaaaagaaaaaattttgaaaatcaattttttccccctccccttttccccaggggggtttttttttgtaaaattttttttttcccccaataaacttttccaaacccccttttttcgccccgggaaatttttttttttattgaatatgaacccgttttgagtagaatagactagaaaaaattgaaaattttgaaatcatttttccaactccttcttcccagggtattattttgtaaagtcttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttcccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaatgaaaa

SEQ ID NO: 32532 - DNA, 850 bp, Heterodera glycines
catgatccattttcaagcacttttgtggttggtaattttctgtcgcttggaacatctttccggtccttgattttccggcaaccagcacatacaaagcgtttaccgtcatcttttttgactcctgcagatgtccatttgtagcaataattcggattttcggagcaatcagttgtcataactgttttagaaccaatacgcttgctcacggcgagtcaattttgggctccaagcgcaaataagtttattatttatttagtaatcagaacgccaaaactttgcaaaacttaaaatttattagggattttcccttgtaaaaatggaagagccgatctcgagttagaaaagaaactttcaaaaaacaaaagagaattcgatagagggggtcaaactatgggcctatgcaaaatttgaagaaaatttgaacatagggaaaaatttttcaactaggtgaaattttcaataattttaattcttttttagccaagtccacaatttaaggccaaaccaaataaaatttacaatattctccagaattttcccttcaaaatgagcataaaatggttttatttgctctagtattcaccaagttataagctaaaaaaatttcataaaattgtcgatgttggacgtaaccaacgctttttgaatatgattttttattgccacgaaaacttttattaatgaaaaaataattctgccttcttctttaaaagaagaaattgaaattaacacacaacatagggaggactcgaacttgagacccccttttggtgggtaactcacagaccactaagacaaaaaaaccaacttataggaagggagcccaaaatgactcgccgtgtgctatata

SEQ ID NO: 32533 - DNA, 699 bp, Heterodera glycines
tgaataattcataatttttgaattttcggctttaggttcgaattcgggtccggggttcgtaattggtcgaaatggatgtcatattcgtgatcagcgaccctcaaaacccaataagacatgtttttatgactttttagaagaaaaaaatttttattcaaaaaagggggggggggcaccagcttcactattaccaaaaatggttcaaaatcgcaaaacttggtcatttgctggagaaaatatgaattttatgctggcgccggaaaattgtaaaaaatttgagtgtgattttacaataataattggttctcatttttaggcactaaaaactgccaatatcaatcaatcaatcatttatacgcaaaagcgtgacgccgaaaaataaagaaataatatatcaaaacaatcaattggtcacttttggagttgaggtggcaaagaaatcaacaaattaagatcagatctttcaagaagtttggcaaactcattaggatttagtaatctcgtctctttaggtaaaagtctatagagacgagaggttcgaataaagaacgagttgtatctaacattagttgagcaataagctgttcttatagtgaattcgttttttacggggtttttggaaaaagaaaggtattcattattttgcctaaaattatttcatggaaaagttttaagtctatttttaacctacgactctca

SEQ ID NO: 32534 - DNA, 1345 bp, Heterodera glycines
tgaacaaatggcgtgacgcacttttttttatgaatgccttactttgaattgaatttttttttttttacttatagtttttcattaattgttgaatgaaaattgaaaaaatgttaaaaaattgcatcatataaattaattttaaataattaatttaaatttctttacatatcgtattaaatataaatcagttaatttttcagaatatgtttaattttgcatggaaatattttaaattaatgagcttttgatctgttttagaaaaattttgggggattaaaatttacaaaaagtgctggaatcagttttatcgacccccgaaaaactcccttaaaattgtaaatataaatttttggatccgcaaacgagaccggatgggatcaggatcccgcggaattttcacgggattccacttgggatccgtcttgcagactatctctaattcagtttcacaacaattctgtgtggtgtaccatatcacttgaatcaaaaatatttcatatttattaaattatattttaaaacaaaaattgtgatcactgatcaaaaacaaatcagccgacagatgatgccatttggcctccggcggccgcggcaccgccaagaaattggttgaatatgccgaacaaatcagtgttgccggctatgtttggcacaactaaaggagattttacattgtgaattaatttatgttaaaatggttataattgtcaataaatttatgataaaatggagatgcgagcataattttaaaattggaccaggacagattttataataaaaacaaaaattttgccaaattttgaaaatttcagagaattgtggtccagcgtcgcgcagcagggaaattttgaaaattatgaattttttttgaaaatataattaaaaatcctcatttttaaaaaatttttcattttggaattcggtggttaagaaggggcaattggcccccaggataggccccaattttccagcttatcctggctttttttcgaaaatttcaataaggggtcggtccctgggaaagccctgattggctttcctggtcctgtttgatcgttgataaagagattttaaaaaatcttaaattttaaattcaaaattccacttggcacactcggcggtggcctttgcgtgctgggcggtggcaacggcacacatttgttctgtgccgaatttgtgcgatagccacaacggcacagacaacggccccggtagcagccggaatgctcggggcattgttcctgggaaaatttttaacaatattaaattacacggggtttaattttttagaacaaattaaattaagaatttaaagacctggacgaagcaggcgcctccccagttg

SEQ ID NO: 32535 - DNA, 1212 bp, Heterodera glycines
atttgaaaattcataactcaatggaggactgatcaatttaagtgaattaaagctttaaaaatagcaaaaaatcgggagaattttatgagatttatttgaaatttataccacaaaaacaaaaaaaagttattccagaatttctgcaaattttcgatttttcagaaaaaaatttatacctcggttctgaaaagtcattagggaaaagtaaaatactacaaaaatccgcaattttttgctctattaaataaattttaattcatatttttatcacttttttaagaattattataaaaataaaagtgatttttggattcgggaccaaaggggtgagcataggattttcgagtggaaaatttttttcacccaaaatcttcaaaaaacatgtctttaggggttatttgggccgctgatcacgaatacgtaatcagattttaattttgacattgtttaggcctcagaatccctgtgtgattggggattcgaggcattattttgggggggggggcgaagttcggatccgatcggtgtacatttcttttttatgcattttttcgtcattttcaatccttttaattaatttgaacctttttgttttattaaaaattaataaataattttaaatttaaattaaattatttttgatgaataaattttttgtttcaaattagttaattttattgtccataatttttatttttttatatgccatctgtttattacattctcatgttgtacctcttcaatcacagttgtacctcttttaatcactgttttgcctcttctgatcactgttgtacctcttctaatcactcttctaatcactgttgtacctcttctatttcctgttgtacctcttcaaatcactcttcgaatcgctgttgtacctcttctatttactgttgtacctcttctatcactgttgtacctctttttatcggatttatttgggatttctttcaaaaattatgtatttaaggccctttaatgacgctgatcacgaatacgtgatcagattttacttttgacatcgtgaagacatcagaatccctgtgtgattggggattctgaggctaaaattttaaattaattattaattttcaacgttgtttttaattaataaaacgagtattttattataaaaaaaataatgaattaaaatgcattcgatttttaagcgcgaggcgccggtgaggaggccgcgaagcggccgaa

SEQ ID NO: 32536 - DNA, 1451 bp, Heterodera glycines
cctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgccttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggattttttccattaggtcgtccgttagcgttcaattgctctagtgaatttttaaaaatttttgttgaaatatttgtagtggtctgaagggtgggggggggttttttttaaaaaaatgttatttttaggggtgtatatttaagaccgaccccaagtcggggttaagggtcggggcacggggttgtcggggttggaagcgtcggggttcgggtcggggttaaccccgaaaaatggccaaaaatgtcgggattcggggtcggggcggggtcaggggtgcaaccctattatatatataaatctgtgcgtcgtttggtgcttttctaattcaaatctaggccccaaaaccgaaaagaaccccctttttcactacattcaatcaaaaaattttttacaatccccgctgctgctaaaaaaaaagtatttacgagacctttatataaataaatattcatttaaataaaaaaaagctttccaagaagccgcagatcacggtcgcatattgtgcaaaaatcctgcaatcggccatcgctgct

SEQ ID NO: 32537 - DNA, 895 bp, Heterodera glycines
gggtaatggaaaaaatttttaaggaggctctgcgggacggattagcttgggggttcgagaatagaaaattgtcttaaaaagagatacccatttttctgagaatttatttcacaatttccgcaactcttgcggtaatggaaaaaattttgaagaggctctgcgaaacggattagcatcgggggttacgagatagaaaattgtcctaaaaagagatagccatttttctgagaattaattcacaatttccgcagctcttgcggtaatggaaaaaattttgaagaggctctgcggaacgtattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcgg

SEQ ID NO: 32538 - DNA, 1749 bp, Heterodera glycines
aaaataattttttttttaggaatttttttttttgattatttttggttggagattttttttttgggggggggagggggggattggcgccacccattttttaaattaaaaaattgattattccggcttctttcttacaccatcagttgaaaattgctacgccgccagcaattgcggggcaatgcgcaacaacaaaaactttcagcaattgttgcgtggcatgccggaaggaatgtgttccttacaatttttcgggtttgataatataatattttagaagttaattttaaaaaacagttaattttggttaaaaacaatgcagttgcttaaataaagcttggtgtttcgtacaaattggcagattctaccgtacttagatttcttaggctaagttttttttaattgtacgaactgcttctaattcttattcctgtcataaaattattgtaagatttatactattatcccgtaccacttttacagtgtttcgtcgcggtgtttgtcgaggaggcggacgtgttcagcgggcgactgttgcccattttggagcagttttgccgcgactcggacgacgaagtgcgcagcataattgcctcaggctttcacgatattgttgcacaacgcaaaattgcgccaatgggaacaaaaaatgccaaaaactcttcgtcaatttcgggggggggggagcgcaaattgtcgggggtcgggaaccccgattggatagtgatcaacaaacttttttaacaaaaaaaaaagaccaaattttctctttaaatgctcgaaatcttccttttttcactttaatcaaaatggaaatgagataaatattttaaaaatcaaaaatgtagtcaagtaaataaataaataaattttgaatatgaatttttgataaaattttccatttctcaggggtgtatttttcgtttttattgcatttttgttaataatttttttcaaaatagcagaaaatattttacaataaattcttcaaaatgaaaaagagcacaaaaaagcaataaatttatgtcaatttttaatatttttcgaaatttgttgcaattgcttccatcagcatgagtcatcatctactaaatgccggcacggccatggcatatgaaaagcatggcaaaaaattttttgccaattgccttttcatagcccaactgtgaacagtgaacaccaaaaatggaaaagacgaaagagcaaaaaatggagaaaagatttttgttcgttgtctgttgtgtggaatataattgacagctgctggtgtttaacgcccgagggaggagggggggggggggcgcaatcaataaaattgggaaaagcagggagagaacggagaatggagggagacagacagacatagagatagagaaatacggacgagacaatggagaacaatgttggtgagacactcagacagataaactgaggagataataaaatgttgagagagagagagagagatgaaagagacagacacagagagagacatagagagagacggagacagatagactagatagggggagagagagagggggatacgagagacaggggagagagagaacgagagaagagagagggggaggggggagagagagagagagagagaagagaaagagagctggggaatggtgtgatcgaatgtaatacataaatgttgtaccattcaccgaatttgggcaggatttcacgggatattcattcacttcagcagtgacattccccactacctcaggcagcaagctg

SEQ ID NO: 32539 - DNA, 1520 bp, Heterodera glycines
ttggctggaaaagtgcaaaattaaggaagagaagagacaattttgaaaatattaatcaataccagaaagtgtaagtatcatctaaaacacattttcgaaaaaattaaggataggaaagagtactttttggctggaaaagtacaaaattaaggaagagaagagacaattttgaaaaaaaaaattaattaccataaggtgtaagaaatattttgactgcactcatcacgcccttcacgagacattgacgtgtcttccggcgttaaaacttctcggtttgcagggctcatgctgtctgtgtagttgtcattacgaatttctgtgaaaatacgaccaagccaatctggttcgtttggtccatcctccatttcgcataattcaagaggatagaagcgatcctcttgtccttccggaaagctctcaacagcacagtggaggaaaggatgtcggagtttaatgtggtgacggacgtagaaatgtgcggccacattaacattgaaaggacgacccagacgtccataggccatagttatagcagctccttgtgctgtaattccaccaaaagcaaagcttttggtgtatccatttctgtctttgtatgttgttttaacacggtgtcctttcaacgctttcacaaccgtttcacaatcggaaggatgattaagccgatcacgtagctcgctgatacggcagtttaaaattttggcgattttttccgtaagaagcaccattttgagaatttggaagctacaattttgaaaaaaattaacgaatggaagagtgcaatttatagaggaaaaatgcaatattaatgagatgaagacaacaaaatgaaaaaattaagggataatatgctatttataataatttttaatggtccaatttattttataggttaaataaacattgaaaggtataaaatgcaaaatttttagttctttgtattattattcttccattttcctaaaaatgtccacatcctctaataaaaattatttaccaaaaaaccaatgcccaaattgtgatggtaattacaatttttccttactgtacacaaaaattttttaattttagatgaagaagttgacaatgacccttcacccgaagaagttgagaagtggacgccggaagaagtgatcgagtgggaccgccgctgtgaaggacaaatgccagctgaagaagagctttggcaagaattcctcgacaaaggagaggcaaatgtcagtaaataaaatttttgatccattttttaaatgatttcattaggttctgcgtgagttctttggcggaaaaggggcgcttgaagttgagaagagccttcgagaatacgcgaagaaaaaggaacgccgagacgcaattttgattgagaaaagaaacgaatacaaaaaaatgatggaaaaaaaggataaaaattgagtgttcgaatttcaccatccgctatatcaatggcttttattttattcaataaattttcatttctatggagggaaataaataggttaaacaaacaaaaatgggtataa

SEQ ID NO: 32540 - DNA, 1050 bp, Heterodera glycines
gcagcagcttcaccaacgccggcgtccaggggcctattcaaattagcatcgtatcaacgatgcgatgatacgatgatcatatgcgtgttcaaattaaagactttcgccatatgatgagctgtcgtttgcagctcatcatacgatgagatcgtacgatgatccaatcgtacgttctcatcatacgatcgtatggctgttcaaattaattttatggataagatgtgatgatatgatacgatgaatgcatacgatgtttaccacaaatcattttatgtcttaaaaatatttccattggcaattttaaaataattttaaattcgacaaaaatttaataaaaataattacttttaatattcgctgttattttctccaaataatttatacaaacctaataaggtagctgctgatcctttttttgtgtttgtttttgtttaaaagaagtgttaatatgagacgaaataactcaatgtgatgatgtgatggaaatgaaacaaatatttttattcaacgccagagtcagcagcagttagtaacattctcagcagcagaaatattccaaattttttctatcgacagcgggcaatgcaaataaactatcttttgcccatttacacccaatttatttaaaatttttgtagataaaatgaataaagccgaaaaaaatttgcgaattcttatgaaatgattcggagagtttttcaattatttaaaactgttaataatatttgatttgtaaatcagcggcattaacaacagtcactacaagaagcagcagttaattagttttcaaattaaaggaaaaatgcgttcttttgaatgttttatgtttttaataatttgactggcttttattggtactaaaaatttaaaatttatatgaaaaaatagctgagactttaatctataagaaatatacaaatattatttatttaaaagtctcccgaattttacgaatttttttcctacatacgatgtaggaaaatcgctggttccttccatgtatgtctacataagagtttcatagagggaggctcatcgtatgatgggctc

SEQ ID NO: 32541 - DNA, 1147 bp, Heterodera glycines
aatttatttaaatattcaatttttttagctttttttcgaaaaattttttgtcttttttcggcaggcactgcctctgacaatgttttttatttatttagaaaaataaattgattttttttctttttgatttattttaattatatttcatccttaaattttttaataaacattttcaaactttcaccttattaatgtaaggcgaatttgtccttttttaataaattctcttgtgaaaaggcaaaaaaataggctcttttaaatatgcctatttaaattactttcattgctttcctttgcttacgaccataccacgttgaaagcacgccatcccgtccgtctggcaagttaagcaacgttgggccttcttagtacttggaacggagacgtcctgggaatcgaaggtgttgtaagctttttttccttttttcacttgtaaatttatttaaattttcaatttttttagctttttttcgaaaaattttttgtctttttttcggcaggcactgcctctgacaatgttttttatttatttagaaaaataaattgattttttttctttttgatttattttaattatatttcattcttaaattttttaataaacattttcaaactttcaccttattaatttaaggcgaattttgccttttttaataaattctcttgtgaaaaggcaaaaaaataggctcttttaaatatgcctatttaaattactttcattgctttcctttgcttacgaccataccacgttgaaagcacgccatcccgtccgtctggcaagttaagcaacgttgggccttcttagtacttggaacggagacgtcctgggaatcgaaggtgttgtaagcttttttcctttttcacttgtaaatttatttaaattttcaatttttttagctttttttcgaaaaattttttgtcttttttttggcaggcactgcctctgacaatgttttttatttatttagaaaaataaattgattttttttctttttgatttattttaattatatttcattcttaaattttttaataaacattttcaaactttcaccttattaatttaaggcgaattttgccttttttaataaattctctttgtgaaaggcaaaaaataggctcttttaatatgcctatttaattactt

SEQ ID NO: 32542 - DNA, 1625 bp, Heterodera glycines
acaaattcaaagtgaaaataacgaaaacaataatagggtgtggattaatatttatgaaaaaggtcaaaaaaaaaaattatgaaaaaacgtcaaatctttacgaaaatatagaagaaagccaaacaagaatatttaatccacagcgagatccgaaaatttgattttttgcattatcccgcggaatcctcatgctttgtaatttttttttgaaatatatcattatgccaaataattttatattagagttgtgtaaaaaaaattcgcgtgaacgggaatgcagaaaaagctggaccggaaatgggaccaggattctcgcttataatatgaatagtggatcagagctttatgcatacacgggtacaggattcccacaggaaaaatttttgtgagtcccaataattgtatgttataaaaataattaaaattttgaaatttaatattccaactaacagggcccggatttttaggtgctaaaaatcgccaaataggtaccaatgcgtttatctcaacataagctatccgcaaaaaaataggtgtgaaaatctaaaaatccgtgccctgactattaataaaaattatttaattcgagtcaggattttgaggcatatgcctttttaacttggttttagatttaatttatagtgcctttttttcttttagtgcatttttatgctttttttcactcttttttgcctatttttagtgcctatttaaaaaaattttaaaggctcttgggttccaataaagattttttagtaacaaaaagatgagttttatttgggtaattgatttgactaatttataataattaaagaataaaattctaaaattaaaattaggatcattttcctagttttaagtaaaaagttaataattatgattttatttttgtaatatttcctaatattttggtcatttaattgcattggcagatgtcgcaatcggaaaaataaaacccattaatttcactgttgaattttacaaatctttgtgattagtagggtaaggatttttatttatttaaaatattttttcgcaactttgttagatgagcagtgcatcagggatggagttccgaggcactaaaaattttcggaagtcggaagtcggaattccgatgccccaaaaattttcggaagtcggaattccgaccccaaaaatgtcggaagtcggaatttttcaaaaaaaaaatataataaattttaaaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacacctttttttgcggcgcactttatccaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcaaattttcaagaaaattaagttttttttgagtccggcggtgccgataggtgccgtcggaaaaaaaattgaaaatttctatgcaatttattaacataaatttacaaaa

SEQ ID NO: 32543 - DNA, 920 bp, Heterodera glycines
cgcacccgcagttccatcgtttctgccctgctgtgccgatcttcgtggctgtgcgacacggacataggccttttcaaaccctgaatgttcttgaattattgaaaaaaatcaaaattaataaaataacaaccttttaacaggtatttgaagatgtatttgcaggccttctgtccgaacacgtactccacgttgatgtggcatccgtatttgagcagcagaaacgggttgtatggaatgactcggctgtcgtccatcagaattgcgctccggaccccccttttcttcttgtaatgcgtctggccatgttctcccttaataatcaattatttttaaatacaattaataaaaaaaataggtacatgctgcctcgccggaactcgtccttggtggggaaagcgctgatagcgaacttcggcccagtcccgttctgggtcagcagcaggatcgtggtggtcgtcgtcatggtggttgtcgtgcccaccggctcttccaaagaaggcgtcactttcgtcgggcggaatgcggacataattcgtgtaacggacctctttaaatttttataattaatttttagatttttaaaatgacaaaatgatttacccgatagttcagtccggtccgagtacggctttggaaaatgtttgcggcatcgcgaaccctccagacatgccgcgttgcagtcgtgcaacatcattgatgtcacgtagtgccagaggcgacgctgttggtgtgcctccggtgattggtccgaagattgcggaagggtagggatgcgcgcgcagacatattcgtccacctgctgcggagtgtcgatgcggcccccccgttcaaggatcaggagcatgtggatgtgtggcatgccttaacagttttataatttaaagggctattaattctaatgaattaccgcacttctgatg

SEQ ID NO: 32544 - DNA, 1784 bp, Heterodera glycines
acgtatttttctctggcactatccctttttggttcatctctcgttttttgaaagcgatttttgttaattcagtcgaaaaaattaaattccagaaatttcatttctgcccccaaaattgctcgtaccattctcactgcaagtcgcccttccgcctcgtacttttcggataacaagctgaaaaggaagaaataaaaaagaaagtgccaaaaattgtttaaggaacagaaaatgctttaaaataaaatatttaaatgtatttatacaattcaaatcggtctcgaaaaataataaattcaattagatgattatttataaatacagaaacattgagaagcacaaaatttaacaaaatgaaaaacacgaaatttaatttaatatttcgttaaataaaatgaaaaaatgccatttagttaattggccatatgccgaaaaggcattattattttgacgccattcggcattgttcccgcttcatcaacaattacccaaatggcattttcactatcccttcaccgtgcctctcgtacaaactttgcgatttaccgaaggcaaaagtggaatgtaccgtaaccaaaagcaaatattacagaagcaccattatgccaatccaagtatacagggtaattagtggaaataattaatttattattgcgcactttttaaacattcaggttcacgttttgaagagaacgctttttgtgaagagaaaaggcggatgctttgccagaaaattgagattttgacttttatttattgggaactatattttttttacaaaattggaaatcttatgcagaattttaattgaatttgaaaaaaacttcgaattttcgtggaaaaattattgtcaatttttttttgttcatttggcattaaattaaggcaaaaacgagaaaatgttttaacaaaatgccaaaaatatgtcgatcaatttaaaagtcatttgtgctgtagtgacgctagagagtagagtagagcggtactggtactgtacaactgagtacctagtaccggttttggccggtaccggtctagtaccggttttcccagccaaaaactaccagtttttcaacccgaaaattaccggtaccggtttttttacaattactgattaccgctctaccctactagagagagagtcttggtctcgagaaaagtctcggatttttttgctctcgagtcttggtctcggatttttcagtctcgcttttcgagactctatttattgtttttggtaaaattatatttaataaatttttggtaacaactttttgtgtacttgcttttctcacatgcgtggcccagagggttgtgctctttttggtctcgggaaattttcgctctcgagcatcattattgtgcagcaactgttgccttgacaatgacggagtcggagaccaaaattcgattgccagatgtataaatgttcggggcaagacaaaacgtcgctggactgactataacttttttctttcgaaccaaattaaaattcttggtattgttcgtaagcacttgacaaactcattaacttgtgaaacataaaaatgtttgattcgatgctgtaaacgaaatcacgggcagaaaaattttctgaaaacaaatgctttttatttatacggaattcgtaattacgggtgcgtggttaataatttttacatttaaatatttcgggatcttttgtaaatacaaatcctcaccctccatataacatgtaaaaaatttcaaactaagcaccacattggtcaaaaataagtcggcaccgccgggaatttttaaaaaattta

SEQ ID NO: 32545 - DNA, 1431 bp, Heterodera glycines
  misc_feature (17)..(17): n is a, c, g, or t
  misc_feature (1381)..(1382): n is a, c, g, or t
tggttgtagggaaattngagatgtcaatatggtgaattgaatttaattaatactaattagttaattgattaattaattaattaattgtgtaggggacggtgtggttggcactaattaaccactaattgccatacatttaccaaaggtgtgcctactcaacaatgtccgatgtgtggtcatacggtatcgtactgtgggaattgctgacgcgtgccgcctcgccctacagtgatgtgccaagcactgaaatacggtagttttacacttttactaaacatttaaggttgtctaatagggttaaaaaactttgagaaaacgtaagacattttttaatctgggaattaattagtgtttttgataaatcaaaaattttttggatgaggtttaccggctcaagtccctaaaaatgcataccgtatcgcgcatttaacaatttaaatgcttttcaggcattttttggagaccggcaaacgcctcgcgcagccattgcattgccctgacatactgtaaccaattgacccaaaaaataaataaaaaatttccaattaaatccacagctttgatctgatgctctcatgttggcgctcacggccctcggaaaggcccgactttgtgacaattgagcaccaattgcgcggcattttacaggcaaaatgaaaagcatggaaatgttcccgataatttgtcaggattaaaaatttgttagcaccaaaatttcccaaaaaatttcgcgaaattttcccgaaaatccacacaattaccaattttttggtgaaataaaaaggcattgaaattttaaaaattgttggtaacgaaggtcgagcacgagatcaagaaatttccgagttttaggaccaaaaattttgccgccaacgatgtttgagggcgataaaattcccgaaaaattgggatcattgaaattcaatatttaaaaaaattttcaacttcataattaagcgtgaggaaaatctccggcggcaaaaccggcacagaaggccaagccaatcatttttcgcacctgtgccaccaaacacggcattcccgggctatttgaacgatttcggaggtgccgcgggtggcttcggcaaatgatcgatcacaaaactactacttacttatgaacaactaactatacagtattccccctgcccgtctttctttgtgtgtaaatgtgtgtttttgtaccgtattcattgggcagccaccatcaccgtatatgatatactgtactgtccaacgtaattcaagatggtaaaaaagtgtactggagaatttgtggccccgatgaaaagtgaattgaacaattttcattgaattgtttcttgggtaaaaaaaaaagagctgaccacgaataccgtatatgctctaattatacccatgnngggattatttttcacctctcaaaggaaaggggggggggggggggggggg

SEQ ID NO: 32546 - DNA, 1345 bp, Heterodera glycines
  misc_feature (1235)..(1235): n is a, c, g, or t
ttattcgtcacactttttcagaatatgtataagcattagagtacaaaaatattccaaaaaatatatataggtattgccgtttctgcaatttgttatctaacggcaaatcttaattggcattaaaacggccacaaaaaaggaaaggaaagaaacaaatttaaaaaggttatcttccgctattgcggaagaagcccttccacacgtaaattactcgcgaaatttgccaataaaatcgaccgagcaccgtttttttggggtgaatttatttaccgtatttcctaaaatacaaccccccccccctaaattaaccccctgaaacaaagccccctcccttgagggaaaaataaagcccctgggggggtactattttaggaaatacggtatttactgtggtggcactcattcattttaaaatggcatcattggggacgacgacaacggaacaaattgcaaaaagacagcccgaaactgtcgcattgcgtgccgcattcgctgaagtgagtttcttttgttctttgacagaaccaacagctcattgtcaaaacagtaggagagtttaatgagaattcggtcggaatttaaaaaaaaagaagaaatactgcgattattaatgccgtgaaaatggcatttttagtctcattggtcccctactgggatatgtgccgacgcactcaaaaaattacgccaatcggagaccaattccgatgggctgaagaaatgttggaaaccgtaatcacgagcccaaaaatgtcggaaaacggcattcagcattcagaaaacggcattttcgacaaaccctggaccctaaactcagctttttttgtcccgtgcttttgggaatagtcaaattttgtaaaaacgtaaactcccgccgcgttacagctccgccaccatgtgcccgcgcatccgtcggaccgaaaaatgagcaaattggaaatactcagaggtcgtccaaaaacggcgggaggggacaattttcaaaaaaaaacatatgcaaaatcaaatttttgtttttttttaaattttcttttgtctcattgtcagccgcgatacggtacattagcattctggagtactgtctgggcatgcgacagacgccaattggtgtcaaattgcacaaagaatagagagagaagaaaaagtgatggaagtgattgcaaaaagataaaaacttggattagagaaattccatgaaccaatcaattgtatcggattgataaagaatgatgctttanattggaataaaaattgcaaaaaattccccgagagaaaggcaaaaatattaagtagaaaaaacgacagcggctgctctggtccaacagaaaacactcccaaaaattgccac

SEQ ID NO: 32547 - DNA, 1598 bp, Heterodera glycines
  misc_feature (820)..(820): n is a, c, g, or t
tttatttgatgtattgaacaacaattattaacaattcgagttttagcattttggtttgccgagacaacttccgaattcattttggcatttagtcgctgtttggaattattactcccccaaattgctgctatcatttttaaaggtttttggaatttattaaaaattatttcagttatattttagaaaaccgtacttggtttctgatggttttgtcctcaatttacgcccttttttcttggcttttcacgcggcctgtcattttcagcacctcaaaattcgcctttttcttcagtccttacgaggactacagcagcacaacggcctcatcaaaagtgcaaaagaaaattttgaatttaaattttaaataataaattattgagagaaaaaatggccaattcagtgaaaaatattccaaatttcgttgttttttaaatgattatcgtttttttcagtactccaacatagtgcacactttcaacaacactttggtctcctgctttctgtgcgccacttatggcattttctgtgtgctttgggtgggccgaatgctcaaaacgattgccatggcaaagccaaagccaacggcggtgccgacgacagtcgcggcggcgaaaggccaaaacggcaaaaatgaccaaaacaatgggaacaaaaacagcgggggcagcagcaacatcgccgcgcgaatggtcaaatggcaaaagcaaaaacactaattgattattggaaaatgacggtgcttaattaatggttgcgcccttttagacttttttgcaagttgtcatcatcagttttttcaatggctgtgccgccgggttgngcgtttacatgggacactttgagattatcccgaaatgtttgtcgcttctcagtttacttacgtcctcactcatggcaaacactttcttacaatttttaaaaattaaaatatttcactcaatatgctaattaactaatcaattaattagtttttttaaacagccgctcctccgttcatttatttggcctacaaccgcacaatccgtgccgacgtttgcgccctgctctaccgtattctgaccggcaagagtaacacaccggttactgtgactgcgcagtgccacgagggcctaaacactgggctaattgcgccaacgcacactcaaagtgtgggcattggccgcgccagtggcgccgttccggcggtatcaattggggcggactatttgagcattctcaacaacggcgtgccgctttttcgtcgtcaaattgccggcagcgacgccgtcagcggacaatggcaaaaggcgaataccctatcatcaacagtctaatgatccaattaagagttagtctttttgcttttttgtacattgtttttatataattccaaaatattttattattttttggaaaattgttagggatgtgcgagagtctcggttctcgattcccgacttagcaaatttctcgagtttttcgcttcccggtaacggttcccggtctcgggtttttagtctcggaaaccgagaaatatttaaactgttaaggatggccatttcggggaatgggtcgccggcaaagggagaaaagaggaaaaaatattgaattttaaacat

SEQ ID NO: 32548 - DNA, 1869 bp, Heterodera glycines
ttcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaaatcgcagtggcttgaacccgggcaaagtcgtacaaaggtagctgtagtgacctgctgctggatcatacccaagtgattcttatcaccacctacctgctgtcctgtgggctagcgttgcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgcttagagttttcgacctgaactcagacgtgaacacccgctgaa

SEQ ID NO: 32549 - DNA, 1248 bp, Heterodera glycines
agagagagagagagagagagagagagagaagtgatatcctcgggggacgggggaggggggggggggggtcaagggttgggaggatggaagagaaaagtaatgaccggaccaaagaaatgccgccggggaatggcccgtgtcataaatgtcacatttggcatttcaatgcttaaaaagacaggcaaaaatataatgaagaaaaggcggaaaagcacagtaatcagaggcaaataaagcatacggtaccaaatgataaattaattagctgttgttttcacctgcatttccttcttctctttgtcggtggcttccaaaaatgactttgccgcgttggcactcagtgaaggcgaaatgccgcccacagaagtggagcccatttcggtaaccatcttcagaatgcgacctgacaatcagctcatttatttttttaatttgaaattaatatttgtttaatatttatattttgttaaatttctaaagttgtgccattttctcttcgctttttgttcaattttgtgctgatggttttctcgatgaatcgttcagtgtgccgatgtggacaaagtgccactcacaatcattaaagatggtttttgctcagaagaatttccgttcgctgttttttctttcctcgacattttcgattcttatttttaaatttaattaatgggtttgtgctctggtgtaaatgcgacgaatttcgaaatttaaagggggggggggatcacgcaaaactcggccaacccatcgttggtaggttttgaattttcctccttttttggcattctgacctcccgtgcccgtgactccatccaccgccgggggatggctcgtgttgttggacacgagcgacgtgttggaactggcccttttgatctccaccattggcgcctcaattttgttgttgttgcttttcctcaaccgttttttgcttttttggtgttttgtattcgccgctttttccgatggcttttctttttctttttcgctgtcgtgaagcaccaaagaagcgaaaacggcgcagaataaacgcgggtcgaacaaagaatggaaactttcaaaattcaaacaattctccgtttgttttgaaaaggcgtggcaatgaaaaaacaatgagaaatggaaatggcattttatggtgagggagggaattggcaccgcaaaacgacgcaaagtgcaaattaagcgcaaaatgaatttgggggaggggagggaggacgacggctgcttaaactagtggccctaaat

SEQ ID NO: 32550 - DNA, 2435 bp, Heterodera glycines
taagtcgaaagtgtctcattgaggcactggcgatggtcataggctcccacgttatgtcaatgccaccgccgatcacttcaaatgcattgtcgtcatcctgctgttcctcctcctcttcatcttcgtcgtcgttgtcgtcatccaagcatccatgccgctccagcgggtcactgatcgtcaagaactccgtgcgaaaagcgaccaacgcctcaattagtatgcgcgtgtcgttggtgcagtaggctgcgagctgttcacataggtcgaactgttgatggcggtgttccgcgtaccactggtcgaatctgcgctgtcggtcgggcgtcattccaccgtataagtagtcagcttttgacggtagcgacggcagaatgtgcccataattcgcctcaacattcgccaaatgagggaagaactccttatcctgcacattgagtccaaacgctccgggcagagcgcctagtggcaccggcataaggttccagctgtctcttacgatgatttccgggtttttttcgcccctcgaaattttcatttcgtataatttgttaccacgtcggatcatctgtggacaaaacccgttgaggaagaactgtcgaaacagcataatgttgtcaaagcgaccaccgaaatgggcgaagagcattgtgggatagcgcggatcgaattcgctgagcagccattgagcaaaggccgccattggacacggagtgatgaattgggcatcggtttgggtgcgttcatagacgcggtgggagaatgtgacggtgcgctgccgaccgcaaatgccacatggcgcttgtagagaatttcgccataaattttcgtttatgcacttggtgcagacgacatagcatgagatgaagttgacggaatgaactctgcggtcgccctcaattcgcgtgttctgtgttgtttcacagtcaaaggcgatcagcctgtactttttggggcggcgcgccttcaactgctgtatgaagcagccccgctccggcttatggtaacatttgcaggtgtagcagaatttctcaccgcaaacgtgtccgctgcgtccttttcgtcggttttgtttgacattccacacaactccgcactgtttgcatttcttgaattgtcggcacacattgctcgacaaatgatgactgaagcagtcttggctcatgaaatccttgccacatgctgtgcattctctgtaataattgtcgttgttgtcatccgctcggcacggtcgccccgctcctatgcgaccgcagtttatgcactttgctttacactgcagtgaatgatcattggcattatcgtaggggcattcgcacgaaaagcagtagtagtcacgcccaaacaccgctttgcccaccccgcaccgaattccgtcgaaatggccgttgtgatggtagagcgggatttcgacgttgtaattgtccggcccgtattgaaattttggccgataggtgcctgtagcgccaaaaatgaacactttaaatcgctggtttgctgtggcgtatttccgattccaatagtccacgacaatcggcacatagacaaccgcgtcatattctctcagatcggtgcgaatgtttgcgctgctcatcagtccaaacacgtcttccagtcgtcgcccgttctgatggttaatataataacagaaatttcttcggctcatctctttgatgtggtattttctgcttgcctccaaagcgtaaaaaaggcaataggcatcatcactgttgttgattcgcaggagtgcactctctttgacgatatgttgcactgaatttgttgtccttttcccactgccacgcacctgttgccgctgaggtagctgcgcaacatcaagcgttgtgatggtcacagtgaacggcgagccccacagagagccctcccgtgattttgactgtgccacctcaaggaagcggttcatgattgagtcggcggtgttgtcggaaatgcggcgtataggaatccatatgctgggatttagaagatctgaagagattgtagcgcccaattgatccggtgtgatcccgttctgctgtgactcgtccaaggcggttgacatgcagtgagcgaacaatgcgcgcagcattgactcggggttggcgggcaaattttcaataataaaggacgattttacactctgcactttgaacttttggttgtactgtttgtcggcgcttagagtgcggatgcaatttttttgaaatttctgctccccatcatcatcgtcatttctccttcttctctttgtgggcgtttcgttgccgcccaactcgccgcaataattgtggtcttccacgacattatttattaatatatttaatttatttttgcgaaaaagtgagcctttcccgcgtgagctcgctgtatatatgcgcagcaccacagcgcgcgcaacgtgagccgtggtataataaataatcaatcattccctatgc

SEQ ID NO: 32551 - DNA, 1019 bp, Heterodera glycines
tcaaatgcgctgagaaaaaaatcccagaccaattagtatcggcgtcattatgctgagagtgcggttggaattccccttgactgtagaccagaaaaagagatagccattttccaaaattttcacgatcaaatgcgctgagaaaaaaattccagaacaattagtatcggcgtcattatgctgagagtgcggttggaattcccttgactgtaggccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaaaagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaa

SEQ ID NO: 32552 - DNA, 1722 bp, Heterodera glycines
  misc_feature (45)..(45): n is a, c, g, or t
  misc_feature (884)..(884): n is a, c, g, or t
tgcgcatgatttccgcgtcgttcactccccgcagtttctcctccngcctcgacaaacagcaaattttcttccgcaaatgtttcgtggagaaaacagcgaaaaaattggcgacctaaaaaaaaagaataattattaaattaaaataaatcaaatcaattaaatttaattgatttattttgttttccttttttctttttgcctcacccaatggatccttcattaaatctgccaatgttgcggaaccccaggaaagggcacgtgcatactgtatttataaatttaaagaatacagcatttagtaattttaaatatgcattatttaaatttgaaatggcatttcacttcaatgcccgccattgttggcatctgaggcgtttgctttctgttcagttcgtcctccttgaacaaattcagatttttattggagaaatttggcgattttggcattttcgtatccttcacaaaatcgttgtccgttcgaagtgccatggatttattaattttacaattttggtgggataaatgaaatgatttagcaaagaaaaaatccaatccttataaattgtggttaattaatgagtgcttaaatgtataaaaagtgctcattaaatgtttaagcgccggaaggaagaaaaaattcacttgaaaatacaaaagaaagaagaatgaatgggggcaatcagtggtggacaaagggcgaagaagaagcattttccgacaaataatggacacaaatggcactaatgatgatcataatgatggtgatgatgataatgaaactgtgatgaatgccgtacttggaaaatgaattttacacgaagtgaaaacccaattaaatttggcatatatttgggatgtgcggaaaatctctacataattggaanaattttttttgtttgcagtttttaaaagctctcaggaagttcattccttaatttaatataataccattcgaaaaaggaaactttgggcactgatttttttactgcctttttaggtgccaattttgcgatttttgtgtctaaaacactcagggatggcacggaattccgaatttcaaaaattttggggcctaggaatgccatccctggtgccactgatgagacgatggaaacgactgccagggcgcacaatcgccgtcgaaagcaaaacgcgtccgtgtcgcagatgaaattttaagtatttaaagcactaaaaccggaaagaacctgtcagcctttatggaaatttcaagcaatattaaatggaccaataattttaatttttatttttattatttcgattgctatttatttattattttaattttcttttgcaattaaaataaaattcgagtcaattaattatgtaactcatcgagctttcgaacattccaaatttgtcagaattcgactgttttaaaaatccctcgtataaatcaagagtgccacgtgctagtgctttcgagaccgaaaccaaaaaccgagactttttgagtcgagactctcgaacagcactaccacacacgcagcttccttgagactgctcggagccagaaaatgtgacatcgagataaactttttaatttcaagaaaagtgcgacactatgaaaatacggcaaaattaatatttttgaatttaaagtctggaaaatgagcattagtaccaaaaaacttgttaagtgttggtaagttgattttgtaagataataaagggaaaatgggcgcaggttcgagtccgttc

SEQ ID NO: 32553 - DNA, 1991 bp, Heterodera glycines
  misc_feature (1979)..(1979): n is a, c, g, or t
tatgctcttgttcacgggggtcatattttctccactatgatatcagtctttcctgaaaatttaatgtcatataaattcagtcttggtacttccgtgttttgctacccccccccccccgataaactaaaaaattcatatcttggagttggttttcaaggtccctggccacgagacgcaaaatggtgtttgttttgatagctgattacatctggtcatggatttaacaaaatatctatgtatttttttaaaatttttcgactgaaccgtcagcttgcccgacagctttttactttggcatccaaatcaaacattgttgtgatcaatcgaaagcccttcacatgctctctattagctttacagaaagcgaaaacattttcaagcatataaaaaaaattttcgatggataagggggggggggtatcaaaacaaggaagtaccttaactttatcattagaagttaaaacttgcccatgtcataattggacccgcgtgcgttggtgaacacaaaaacaatgttctaaaaaggtgtgttataatccgtgttatccattctagaagatgagtacagtactttggctgcatttttgtgcaagtacgtgagcagtcccttaatgcaatatgtgattgcgggcgttgcgcgagtggtgttgggacgcaacagaatgcaaacggcgtgaagttcaggcaatgtgctgatgaagttgagcgtcttgtcaaagttgattttgtcttcgttgacgccttttgtgtcaccaattcccggcgcgtcgattattcggactttgtgtccatctgaaatgcgaatgacgaccgacacatttcagaattcataaccattttgggacccaccttttgacgggatcacatatgcgtttggccatttggtctgcgattcgccagcttcaagacgctcctctttgctctcctcgcccagttggacttcaattctatgacggatctttttgctgtcataacgacccgtacaaaatcgggccgggatcacccagtcaatttcttttgcctgttttggatttaaataatgccaattataaatacagtactcaataaactcggtcacctcaagcgctttttgcaaagtaccatgtttcaggtaagcgatgagtgcattgatcagcatcgatttgcctatgcccgtctcacccagcagcaaaatgtttagcattcctttgttgttcaaccgatccaattccttgtccagcgatgctttagagccaaactgcttgaaatcggttccatgttttgccacatcggaacagcgaaaagaaaatgcgtccaccggcgtttttccacaagcgcaaaagaaatgtgtaatttgtgtatgtgggtaattagcttttatgcccccgatattagccaatcagcaaattactttttcgattttcacaaaagtcaatgtttggcaacaatcgtcgcacacccaaaaatgaagagtattcgggcattctccaccatagccttcgcagaagggacaggacaaaatacaggcatggatgtctttcggatcagcttcaggcactgctccaacttctgtccgtcgaatgttctcaatctgtaaaaatgtatttgtttttgccaatttgtttggtcgcgaatcgtttttgactcgatcaatttttattatcttgatccgtggaatcaaagacaaactgatggaaaattatagattttttaacttatttcatcgtaataacaatatttttatatcatttaagcatttagaaaattaaaaaaataaatttataaagtaattttttggttttttcgatccacacataatgatcatcccttaaaactttttatcagggttttcaaagttgatgatcaaattaaaccacccgttttttaattactaacactaataaaacccaaaaataaaaaacatttttttttaaatttaaaagtcgaaatttttgtgggggggaggtgaaacggcgggggaaagcggcagaggaaacggngggggggggggg

SEQ ID NO: 32554 - DNA, 1105 bp, Heterodera glycines
attttccttcgggcctcagaaaatggctatctctttttttgacaattttgtaccgatcaaagggaaaatggcttaattcaggccccaatgtgcgcctgaatcgctaattagcttggcactttcgaatattacatataaattatccctctcaaattttccttcgggcctcagaaaatggctatctctttttcggccaattttgtaccgatcaaagggaaaatggcttaattcaggcccaaatgtgcgcctgaatcgctaattagcttggcactttcgaatattacatataaattagccctctcaaattttccttcgggcctcagaaaatggctatctctttttcggccaattttgtaccgatcaaagggaaaatgatttaattccgggtccgaccccccccccccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaactagcgggtgcgtgaaccgtcggctatttagctgggataaagcgcttcgcgcttcttgagcttcgctacctagactgtgaataagcattgagtttttttagagatttggaatttattttaaaatcttaaggggttttaaggacgcttcacggtctcagaagggaattataaaaacggctgtttctctaacaaacttattttctatcaaattaaagttggaaatgtttgagcatattcaaaattttgtttctccgctgcttttagtgcttttgtcggtcggtggaatttcagcttcttctaattctccaagttcaagcgacattagcaatttttacactgatggtccgaagttgagcaggtcaaccatggccatgaaatgatctgtaaacaatttactgtaaaaaaataactttattagaagttgtttgggataatttataaaatttcttcaacctttcccaaagaattttaaattttgtttggccctttttcac

SEQ ID NO: 32555 - DNA, 1011 bp, Heterodera glycines
  misc_feature (40)..(40): n is a, c, g, or t
cttcggcatcgcaatcattgggactcattctccgacattncaatcactgggactcaatctcaccagcattccaatcactggaacttaattctattcaattctccatcattccaattcccgggactcaatctcaccagcattccaatcactgggacttaattctattcaattctccatcattccaattcccgggactcaatctcaccagcattccaatcactgggactcaatccttcacttttcacggattcttcggcatcgcaatcaccgagactcagttctccgacattccaatcactgggactcaattctccggcattccaatcaccgggactcaatccttcactattccaaacaatggactcaattttacggattcatcggcatttcaatcacgggacttaattcagacctgttaagcataattttggaattttaaaaacgtatttcaattatgaaatacaatttgcgtagaaaatccttttcattataaatacttgttctctttcattttaataatttcttttacataaacatctacatacaaaaaaagaacaaataaattgaccttatatcgttaaaagtaacttctttttgtcaaaacaaacaataagtgcgataatccatccaattaaaccgtatccagtaaaagaggcataattgacatccgctttaattacaaaaacaaaaaaactccatttcaaagtcaaaacaatttctcaaaccaaaactttttcaatacaataccaaaactaattgtaagatcatttccattgactttgcatatacaaaaacaattctttttctttcttttttacaaaaattaagagcattcatttccatatgcactttgctaatataacaaaatacttttctcttaacaaatgcaatagaaagcaatcatttctattacattattattaatataaaaactattttgtcattaaaaaagaaaaacaaaaaagtagacatttatttaaaattgtgctttttgcaaaaactgacaaaaca

SEQ ID NO: 32556 - DNA, 1088 bp, Heterodera glycines
aaaattttgaaatccattgtttccccctcccttctccccaggggttttattttgaaaagttttttttccccccaaaaaacttttcaaacacccttttttcccacgggaattttatttttttgaatttcgaaccgtttgaatagattaaatagaaaaaatgaaaatttgaaatcagtttccccctcccttctcccaggggtattatttgtaaagtcttttttccccaataacttttcaaaccacatttttggcgccgtgaatgttattttatcggatttctgacccgttttgagtagattagactagaaaaaattgaaaattttgaaatcatgtttcccactcccttctcccaggggtattattttgtaaagtcttttttcccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttcccccaataaacttgtcaaaccccatttatcgcaccgtgaatgttatttttattgaattctgaaccgtt

SEQ ID NO: 32557 - DNA, 972 bp, Heterodera glycines
  misc_feature (945)..(945): n is a, c, g, or t
aaaaaatatttcatacccaaaagttttttacacccacatattgccaaatataatttctgcaggatggaaagccatccattgcctgccggttctcggcacagcaaagcaataatagggtgtttgactcacttcaaaaaataattccttacacaaaagttttttacaaccacttattgccaatttaatttcttgcagatttaaagccatccattgcctgccggttctcggcacagcaaagcactaatagggtgtttgactcacttcaaaaaataattcattacccaaaagttttttacaaccacttattgccaatataatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacacaaaagttttttacaaccacttattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatagggtgtttgactaacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccanaaagttttttacaaccaccatattgcc

SEQ ID NO: 32558 - DNA, 1622 bp, Heterodera glycines
atttcatattaaaatttgttttgttttttttggtagatgaaatgttcgttatgcgttagttaaatttcatcatccccaaccaatacctgtatatatgtattataatttaatttctcaaaaattaacctgttgaaaaaacagtttgactgctttgacgcgcagacttctctcattgagaggaaccgaacttttcttttgtccagcagaacaatgattttttgcagattgttttgatgcggataaagaaaataactaagtaagggttttagcttttacattgctaacaaaaaaatatataaaatgattttatttgtaatgcataatgctaattaaaaaactattaacaacaacaaaaccaaataatccatttcatcacttccaaccatcgaagaaagaatccaaggcgttgcttacaaattaatggattgtaaccaacatgacaatgaaaatggaaaaatttattcgcaaggaataaatacatatgaagaaaataaacagccccagacagcgacgaggaaggaggaaagaagagagagtgataaaatcagttttactattaatataagcgtagcgaaaaacaagggtttcacataaaggtgcaaaagctaattttaatttaagcatttcaaattatcctttttttaagaaaaaaatgaaaaaattaagccccctacgggtctcgatcccgtgactttcagattaaaagtctgacgctctaccaactgagctaaggaggcacgctaagtggtttttttagtaacttaaataatttatttttttggtataatttgaacttaaaatttaaaaaatgagttttaaatgtaaaattaatgtatttatgtataacaaacaggaaataaatttattggggattaaacgaaaatcaatcacatctttaaattaccaaaataaatattttcaaaattaacaaatacagtaacattatggaattaattctttttttttgttataaaagtatcaataagtgtcctctattgtggtgagtgagcaaatgcattgaatgcacttcttaagtggatggaacttctcaaatgagcggcttggccattcatcagaacattctttcggttgttcgcatggcaacgtttaatgaagccaaagcgatgccgagcaaagtgatgccaaaaagggcattcattggcactttctgcgccgaattacacaactgatcaggacagcagcaaacatagccctaaaagttgcgaaacaaaataaactgatcagtattggtaattgctagtgctgctcgagaccaaaatttccgagactctcgagcagcaccgtaaattgcgctgaatgcttagaatggctcaccagactcggcacagtttggcaagaatcgattatccgataggtggagcaaattgaggaaaagcccgtcccatcacaatagcgcacctaaaccaatggaattgtgttgttgttttttgtcaaaatgctttttattaccgtatccagcccaagtgtctgcttgatacagtaaaggctgggacattcgacgatggaaaattggttgcccgaataacactggatggcgtcggtggaggggaagaatccgatcagcaaaatgagcaccaaaagcccaagtgcaattcgaagcg

SEQ ID NO: 32559 - DNA, 1582 bp, Heterodera glycines
  misc_feature (54)..(54): n is a, c, g, or t
  misc_feature (82)..(82): n is a, c, g, or t
  misc_feature (93)..(93): n is a, c, g, or t
  misc_feature (140)..(140): n is a, c, g, or t
  misc_feature (173)..(173): n is a, c, g, or t
  misc_feature (182)..(183): n is a, c, g, or t
  misc_feature (193)..(193): n is a, c, g, or t
  misc_feature (232)..(232): n is a, c, g, or t
  misc_feature (243)..(243): n is a, c, g, or t
  misc_feature (248)..(248): n is a, c, g, or t
  misc_feature (281)..(281): n is a, c, g, or t
  misc_feature (286)..(288): n is a, c, g, or t
  misc_feature (296)..(296): n is a, c, g, or t
  misc_feature (316)..(316): n is a, c, g, or t
  misc_feature (333)..(333): n is a, c, g, or t
gagccaattttaaaaatttaaattcattttttttatccttttttcccttggttnttatccaaaattttctattgtcgatttntaaattttatntaaattatctaaatatatgtatagatatgcttatcgtgccctgcctntagttattcatacaaaaatattttaagcaaaantacattgannggacgaaganaaatgaagcgagctttgaggaaaatgtgagccatttcgncattcaaatgncatgnatgagcaaaaaggagggatttactgaaataagncacgnnncaggaatntgggaattcaacaaattttntaaaaatagatttgtantagaaaatgtgatttgaacacttttaaaataggtttagacgggtccgggtatttggacaaaaacagggtccgggtattgccggatccagaaaagccgagtccgagtccatgtttttaaactgggtccggttgaaaaaatttcttattaaaaaaacataattaagtttttatatttcggaagatggtctcagggatggtccaaagattttgtcttggagagggtaccgcggcgaccttttttttattgctttttaaaccctttttcgcggctcgcttttttcaaatgaacttcgtggaaatggggggtgggggttcggtccgctgttaattaaattaacaaattttcaaaatttcagctgggtgtgcaacgacatttggatgtacattttccccctttttgaccgtcctcaactcggcctcaaattggcacggatttcgccccgtttcaatcacatccacttttcaggtacgttgatcacttgctgatcacttttctccgttccaataaacatatttgggacagcaggggcatcaaatttgccttgcgcacgtccgccgcggtcgggccaatttgggacattgtggcgcagcaaatttggcccatttgtgcggcaaatattcgtcatttggatttttcaagtgatcatttgaacaaattgcgtcgcatcatttcgccaacaattctgactgatctcgatcagttgaattcaatcaattccggtcgtttggtgcccgacgtaatcgctgatgatgggccatatgcaactgctgagcaagcgttgtccaaatggttgcacacgccgaccatcagcgggcaaccgaagcgattgtgttgccgattcactagtggttttgattcagaagcaaaagaatggatcaacgatttcaaggaggtcagtgcagatcgccccacatttcggttggagtcaaatgggcgccaaactgtttgggggctataactccgttcataatttatcgaattgaataattttaatatcattagatagccctaagtgttctatatttgcatacaaaaatttcgaaaaattagttaagcttcaaaaaaattacggtatagaaaaccagttttttgaactttttggtcctcaaaaattttcggactttcgtagacaaatggagaacattatttactggctatcggtgatattaaaattattcaatttcggcaactatgaaaggagttattccgcaaaaaccggactgacgcccatctggtcgactcccattc

SEQ ID NO: 32560 - DNA, 1519 bp, Heterodera glycines
  misc_feature (746)..(746): n is a, c, g, or t
gcggtaatggaaaaaattttgaagaggctatgcggaacggagtagcatcggggttacgagatagaaaattgtcctaaaaagagatagccatttttctgagaattaattctcaatttccgcagctcttgcggtaatggaaaaactttgaagagtctctgtggatcggattagcatcggggttaggagatagaaaattgtcctaaaaagagatagccatttttgtgagaattaattcacaatttccgcaactcttgcggtaatggaaaaaattctggcgaaggctccaccacgaggccgcgaagcggccgagtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaattttatntacaagttattttaggcactcagatgctttcaatatcaaaaagggagatgaataaaaaatctaaaaatttttaatactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatttaggcttatattttaaaaagtttcatcgaacctagcgcactaaaatcgataaaatctctccaaatgttgcaggccttctccattgtaaaggactaacttaacttgaaaaaatgccaacgcttgttgtttttaaaatttttcgaaattctgactttttcattaattatttattttttgcaaaattaattcttaaatattttttcagaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttattctggaattgatcagaaccgcaatcaagctttgcagggatactgaaaggtagagaaataacctattttaaatattatctagtcagttcatttaaataataatagccaaaaaattttctttgggttttaggggcagtgaattaagagaaaatgcgccctagatttatggggagacaagaatccttacggg

SEQ ID NO: 32561 - DNA, 1065 bp, Heterodera glycines
actagtaaggtttgggtccacatttttggtcaaaatttttttaaatttttttttctcttttattgtcagaattgcttttagattaatggaaaagcttaaaaatttcactcttaacgatttattcaaagtattggctcttcaagacaaagaatttggcactcacagatcacttttttccacatacatttctgattttttgtggcgtaagcaatttgaaggaccggatattttttataaatcgagggctcaaatcactgaattgtacccaataaacatgtgggacaagggggataaatgggggacaaccaatggggaatggcacgggagcagaggagggttaaatgggggacaaccaatggggaatggcacgggagcagaggagggttaaatgggggacaaccaatggggaatggcacgggagcagaggagggttaaatgggggacaaccaatggggaatggcacgggaacagaggagggttaaatgggggacaaggggaatggcacgggagcagaggagggttaaatgggggacaaccaatggggaatggcacgggagcagaggagggttaaatgggggacaaccaatggggaatggcacgggagcagaggagggttaaatgggggacaaccaatggggaatggcacgggaacagaggagggttaaatgggggacaaggggaatggcacgggagcagagggggttaaatgggggacaagggggttaaatgggggacaaccaatggggaatggcacgggagcagaggagggttaaatgggggacaagggggttaaatgggggacaaccaatggggaatggcacgggagcagaggagggttaaatgggggacaaccaatggggaatggcacgggagcagaggagggttaaatgggggacaaccaatggggaatggcacgggaacagaggagggttaaatgggggacaaccaatggggaatggcacgggaacagaggagggttaaatgtgggacaaggggaatggcacgggagcagaggagggttaatgggggacaacaatggggaatggcacgggagcagaggagggt

SEQ ID NO: 32562 - DNA, 1287 bp, Heterodera glycines
tttttgataaatggaacaatcaaaatcgcaagttatttcattttttctcaaaaaacaaaacaaaatttgttaaagaattgtccactgacggattgccccggaccccaaccacgggtcgggactttaggctcggggttttgcaagcatcgggatcggggataaccccgaaaatggctaaaaactcaagatccaaacccaaacaaacaaaaaattcaagagtctcggtattgagcaaccctcaaacattcatacatattaatacaaactaaattcagtgctaatataaaacggtagcacttagtacgaactaaaatcgccctgctggcttgataaaatcgaaatttggaacgagtcaaattcttccgctgataattcattaattagtgattgaattcctgctattggagatttatctgttttatcccacatagcatccgcccgcccaatcgattgaaacgtgtgccgctggcctacttcttccacacactaatcgtcattcatcgtcaccacaaactttttggatcccagccccccccccccctccacttgcagcatgtggctaatatgtgtacggaaaacaactgtctctcctcattttcttcgcttaatgtctccatcaatttcagtcagaccaccccccccccccgcgcaacgggagccggaaaattcgacactggaaaatccgacaccggtggaaaatccgacacaagcagtaaatccgacattggaaaatccgacacaagcagaaaatccgacattggaaaatccgacacaagcagaaaatccgacattggaaaatccgacacaagcagaaaatccgacattggaaaatccgacacaagcagaaaatccgacattggaaaaaccgaccccaactttaaattttaaaaataatttttgattgtttgagttagtaaatatttaaaatacatataattaaaataaatatttttattgctataaatagatttaaggtaggcatataataatcatattatttcaatgcccttttttgatcatctcaaaaaatttgtaaacaatccggcaaatggaatcagaggaaagggcatgaagcataagaaagtgtcgtggtgcaagacatgaatctcatcacagagatttatgcgactcgcaacaatcgacaacccttttattatttgccatcaatatcccatcgaagggcagaatcaattaatttttttaaatccaattcgaaaacttgataaacatagccagatattaactcaataatcaaaaaatattttttaaatttaaagttggtgtcgt

SEQ ID NO: 32563 - DNA, 1614 bp, Heterodera glycines
ttttcactggggactcagtagtccaattgggctctggtgcccccccgctcgacttcattccctgattttttgacctagctcgtcccgagctttcgaatgataccaaatttgtcaggattcgatcgttaaaaaaagttataatgccaaatctctcaattttcgagttttgaaccggttcaaaaaccggtttatacttgtcggatcaacttcacccacccctagatcgatctgtctcatcgagagctatcgatttgtaccatattcgtcgagattggtcctcgagaaaaaaacatcgtataagtcaagagaaccaattgcaaaaaagaaagaaagctacctgtacaatgctcattaacagtgaagaatatttctccgcttcagataataacaatttctgtgcctggtcactaagccctggcgaaactaaaaatttaattgaatttgtcattaattatataaattttcttgtagaaattttttataaaaaacttctaacccatatgggagtaaatgattgctcgaataagtacaaattcttcggtgctcagttttaaacggcggaatggttctatggctttgcacaacaatgtgtcacccattcccatggcactgcaattaaatgttatttcatttatttataattttatatttgggtttttcaaatagtttgacttataatgcaccaaaatattttaaataaagtcctaagatgggaggattagcctcacccacctgccgataggcgctgttgaaaaaatattgaaaataaattaatttaaaaaatgttcataaattgataaatttggtaattttgtttcaattttataaaatgaagttttagtggttttttcttcactcataataaaacggatggagataaaaagtaattttggccaaaaagaacagggatttcagtcaagcgattttataattttatccgggaagaatggttttaaaaaatgttttaagaaccaaattttttagaaaatacaaaaaattaaattgattgctttattaaagcaaaatgcttccgcctatccgataccatttatacttacactggatcttcattgtaatatgtatttgcaaagatatttatggtaagcaccccagaaggattacaaacgatgtcacaattttgttggactgagtagaaatttttgaacagtgaatacaatggcatcgcaatattactgcacagggcgatctttgaatggaaattaaaattgaataaatttttaatttttataaatatttcttaccttatcattggcgtcaagcagcccaaagaaaggaaaagttttgccaatttcgaatacaaataacaaatctctgatcatgggcgctggctttgtaaaaaaaggcccaaattgacgcactttttcaaaaaatattgctttaggcgcgtgcggcaattttgtctttaatttataaaatagtacacattttttgataattttaactcaccgaaaatttatctgccaattcgagcaaatttaatttccgtgcaaaaattgcctcaaatgaatcgcattgtttataaaaaaattccggaatcggtgtctctgagaagcgtattcggcgcactttttgctcaatatccagcaaatgttt

SEQ ID NO: 32564 - DNA, 1257 bp, Heterodera glycines
ttttgtttttatcactcttttcttcttcctccaaatgtctctttggtagctttcgttttctgctaatgaaattgtaatgttttcggcgcggagggtccgcacagttcggcacggggcaaaattcgcagaacggctcgtttgacgctcagcgaaattttgcaatcgaaataaatactaaaaattaaaaataattttaaatttttttggtttcaataaatttgaattcaaatggaaaatctcatttttataatatatataattcatttcttattttgaaatgtcaaatattttttaaaataataaaaagttaattaaaatgctttgaaaaaaatatttttaatttctgttacagagattttcggcttcaaccagatccataattattatttaataccaaatgatcaaaaatttggcatttttaccagtgtaaaagaataactcactcaattttcaaatttattgaaaaatatttttcaaaatatggtggcatttttgccagcaaaaatcctagtcccaacaaattattctccatacttttgtctgtctgcatatttgtagacgtgcgcttctttgccgaccatcaaatccgagacgtactccaaattttgtaacaaatatttgtcacgggcgcagctaacatatattttttaatttaaaataaatttaatttaaaataaacatttaaatttatttattccattgaaaaataatcaaaattgtttattaaacttaaaataatttattttatttttttaattccccccccccactttcccccaccctttttcgtcgattaattgcactttgtctccatttccatcatcggcaaagcatgaatgctgtgagagcaactcatttttggataattaaatgaatgatttgtttaattatttttaccacagtcatgcaaaattggttgggcccattcgcttcgcaagtccatttgtgataaatcgaaaatgacaatttaaataggatttaccaaaacatatttttttaaattgttttaccatttggccaaccgttgcgtaataaacgggcggaccgtgagggccttcgcttaacacctgcaaaatttgacaatgagtattcaagatgagatttttatgtaagaataacttaaaaaacaaatttctttttttgacagtcataagtagggagtgtaattatatggatataaaatcgcgaaatatggccataaaatatggaccaaaaatacgcgaaatatggacataaaatggcaaaaatctcaaaata

SEQ ID NO: 32565 - DNA, 1803 bp, Heterodera glycines
tttcatgaccattactaatcctattaaaaataaatagtttacaattttaaatggaaattctcttttgagcagtaagttttttaatgaaattaaaaaaattcgatcatttcctttttaaaaatagttgaaaatttttaaatagaaaatgcttaaaataatttttgaaagaaattcaggaaaataatttttatcttttaattgtatctaaatgatgtattcataaacatagaccatgactgattgtgaacaaataattattttcattttctgttccatatggagacacttcaattggttctggctatgcttttagcatttattttgcgcacctttgcgaattgaatgtgtgcaattattgaacataattataaaaatcaaatagataaatatgcataacaaaataataacattttgtgaatttcaggtttattttttttcaaaataatgtctaaatttttatttttgttcctttccaaatctaacaaatttggtaatttgtttacatgaactaataaaaaatgagtgaaaatttctctgtcatttagaacccattcattagaactcgaaaaattatatattaaatattctttaattattagtatctaatttcgtaatcaaaatgagggattaaaaataaaaatttgctttcggcggagacgaaaatgccaactgaggaggagtaggataattgtcacctagcaatttttgagagcatgaaattaaattacaaaaccaaaaatgagagaatttgctatttagtttttgcaaatttgttcgttttaatgcttttacaaagtaaatatttttaaatgaggccttactcttaatgccgattttctaacagtcttttgggtgaaaaaattggaattttgaatgagagagtgttacaaaatagaaaatttctttcctccctcgcggacggtttttgatgagatatttaaaaatgaataaaatagaaaatagattttaagaaaaaaaaattgatgaatttgcaaggataatcccagcttttctttagtttttccctgattgcacttggccaaagtttttcaatttaattcacacaaattaattgaaaaaactttgccgggtgaactaattataaaataaatataaaatttgatttcattaattttcgctttttaatttggctgaaccatttaatataataattcgtttttataaaattttatttttggtgtaacgaacagagaaaaaataattttatatttttattttataattgtaaatgggataaaattaaatactactgaaaagtgtgtccctagattaaaggttaaaatattttttgaatttttgactttttttttcctttttgtaacagagcgggcggaattcacatggaaattggaacaataaatgacaataaaaaaaatttagaaaaatgaaaatttattgtccatcttaatttaaatggtccttccgattttcaagaattcagcattttttttgtcacttaaagaaagattttctttcttcattttataataaatattcattttggctgttttttcttcatttaaataagcatttcctttaaaaaatagaaaaatttacattaataaattacttctttttttcgtttcaatgtaataatttttaaatttctttttgaaaataaaaatgcaaaaaaggtatattttgaaaaatgcatcgccaataaacatatagctttttttaaatgatttctcagaatatcgtcctccttctggtgtcggtccttcccattcgcatactgtacatatttgttttcggtagcgacatcgacgacggcccaattgc

SEQ ID NO: 32566 - DNA, 1408 bp, Heterodera glycines
cgattaaaatggtcagtaattaattaccccccccctccccgccggtgataattgctaattgtgccggctcttttccaaggtgattatccccgattcgatcatttacgattcgcagcttctctgcgactttctgcgccaaaatcgggtcacccaaatgcttttcaccccatctctactcgaaatggtcggccgcccgtttcagtccctccgtttgagtcccatccgttcactcctttttaggtgttggacacccaaaatgagcaaatcctagccaatgctttccagcacatgcggttggcattagttcgttccgcttttgcattttctgccattttcgtcagattggtccatctctgtggcgaggtggtcacttgcgcattgctcgaccgtttcttccgccattttccccgcgttcactgtgccaatctctactcaatttccgagacccatggcaaattaattccaaaatgtccctccaattctctctctctctctcagacgtggccgtctccaatctcaacgaattccatcgccgacatgaaaagcgtcaatttgcgccggtcggaaaggtttggcgccgcttgcaaacggaccaatgtcccattttgaaggtgatcgacggagtaaaagtgctcattttggatggacagacaatgaaacgggtgccaatcggagtcccaggcgaagtaaacggaggaaattgcaaggaaagcaaagaattgacagatttacgtcgcgggtccgactttggcaaggggttatatcaaccgccccgagctgaacagagaccgttttgtggaagtgccggccgaactgcgcaaagaagtgggcgaagagcgaatgtaccggacgggcgactggggctatttgatgccgaactcagtgctggaaatatgcggacgctgtgacacaatggtggggacgcaacaaacactcgatcaacagcagattgtccaatgcgcatttgttgttgacaggtgcgcattcgggggtacagtgtcgaactgcaggtactgtaacagggcaagcggacagcagaatcgggggcaaagtgaggccaatgggccggggtggcatttgccatttgccgtgtctttgtgttatggccacggtgtctctctccccctgccccttcggccgtttgtactttttgccttcgaaatggccaactcccccaggcaatcgagtccactttgctcgatatgtccgctgtccgttcgtgcgccgtcatttccattggagccgaaggcgaagacaaacaggtggccggggaggggcagaagaaaagggcatttgccttcttccagttggccgcttacattgtgttgcgcgagcgaagtgtgaacagaaaacagttgcgggcgcagcagaggcgcattttgcccttttatatgatgccgccaattct

SEQ ID NO: 32567 - DNA, 2133 bp, Heterodera glycines
tgtaagcgagaataacagccgcgggagccatgagttattatgacccctccgggctctcttatttactcaatctataattgaactaaatatttttggcatacagcaaatattcgttaaataattttaaaaagaaaatattcaattaatgcaaattagttcaaatgtcgaaaaaatttaaatatataatattttatttcaataataaaattagagaatatgttttatcaataatataccatttttactgttgattgattaaaaataaaatgacaaaaaacaaaaaaaaactacaaaaaatttttaaaaaatgacgaatgcacaatgataaataatttgtcgctttttaatttagtttttttgtttgaaatttaatgcttaatcaagtttttattcagtcaaataataccatatttttttaattttgacacttatgatatttaaatgcatttacattcaatataattaatttaaatgaaaaacaaatactgactcataaataaaaaaaataatttatttaaattaaatttgttcattaataaaagaacaattgtttaaaaattttaattaattatagtaaaaaattacgaaaacttcaatgaaatcaaagtaaaaatttaaaaacctataatttttacctgattaataaaattctaaataaagttgttagaaaatagacaactttacacacatgaaaaattacctagaaatttaaataaatttagatatattagcctataaaataatattcattcaatctaaactgaaataaaatatttttctcttcatctaatttggacttccccatctagccgtgagattaaagagcaaaaagagataattaatattcaataaactaatttgactattaattaaataaaagaaaataatgaaataaataattattcaattaatcatatatttattaataatcattaaagcaaaccattaattcttttgatattttgtatttaaattaaaactattattactaaaaaaatattaaaataattgctataaagtaaaaataaatgatttaataaaataaaatagagacacttgaagagaataaattttgcagaaaattttcaatttttgtaaattacttttacgaaaaaaaatctgatcggaatttgtatttcatttgagaccggaaacaaattaatttatttttattgaaagtcgatataaaagaaagcaaaataattaaacataaatgtaaaaaggcaaaagaattttgaatttatgacattctaacaactacgaaatgaacagcaaatgagcatctacaaacatccgaatcttatgtacataaaattcccatccgtaaatatcagtttttaggtaactttttgaatagtttatctccgctgatcaattaatcataaatgttgtaaaaagcatgcaaattgtcggcattcaaatgcaaaaaaaataataatactgaatttgggaaaggcatttcaaaaaactttggaggcatttatgcttttaaaattaaaattttcgtaaaaaataatccaatcaaaaatctctttcaaattgtcaattcggaattgatcaagatgaaaacgtcgatcagcggaatttccacgcaattgaccaaatacttctcacagcgcttcttcagccattccacctggaaaaagttgacaaaaagttgaccaatttgaacagcaacagttgagaaaattaattcacttgttaaaactctatctttatagtatataaaaataatatatgtatatatatatatatatataattttaattattagggtggaaacaaaaatttaaaaatataataatgtaatttaaagaataaaatcctaaattttttattattgcttagaaatgctttagcgcttcttggccttttatgaaaatagtttaattgtctattatttttaaaattttatgttttgataattttctagaattggctaaatattctctttttggaaaaccgaaaatcaaactgaataaaactttattttcaagattaaaaaaaactaaatgaaataaataaaataaaaaattaatataatatatttcatttatatccattatatttgtttttacaattaaaaattacgaataaaaaacaatcaaaaattatatattttactgaaaaagt

SEQ ID NO: 32568 - DNA, 1053 bp, Heterodera glycines
ccgtcctgaggccgcgatgaattgctaaattacatcactttctagagacgcggcgaagccgcgtccctgagcgcgaagcgctttccccacagcaacagaactcaattgaaatacaacaaagccaactggtcaccctagtttagatataactaaagaaacagatgaactcattgctaaaacaaaaatctcgggaaccgctggcgggagggactcgggatttcgaccttgggggcaacttttgacggcgcatccaggaaaactataggcattccggtccgagggccaactgagcgccagcggcgctgaaacggcttttttaaatttttttttgctgtttttgggattcaaaaattttttaaagtcctaaatgaaaaatcggcctcgataggaaatcaagttgggaggtttggcacatctttttgctcttcaccgacctcgtagggcctaccagtttttccgaaaaactgcgcaaaaattgcatacttttttggccatttcagcgccggccgaataactcgccggggtttgaccggaggaggtcggtgtaagcggcttttttgtagagctcgacgagctctatccaaccatgtttttagatttcagaaattttcagaaattttcgagctaggccccctcgaaaattttccgtttttgaattttattattttttacagatttttccggggaaaacggagaccactttcaagcaaccgtttttcatgctctatcgattggtgtcattttcagaaaaatttttcaaaaattttttggaaatagaaaatttttggttactaggcctcaatttcagttctggcgcaataactcgtcaggagttgattttatcaaaaaatcgtctaagagcttttttgtagagaattttaagcccaatctaatgtgctttatctcatgtttttatcttgaatttaaaaaaagttataaaataaaaatgaattttgaaattaaaaaccacaggggggacccctttggttctgcatttcatgaaaaatttttttgctcctaaattagccaaaatgaatttttatggcctaattt

SEQ ID NO: 32569 - DNA, 1555 bp, Heterodera glycines
ttcatcagtttttggtttaaaaatatatttgaacacttttttatactttgaatgactttttttattaatacagaattttttgaaatttccaaaaatccgcaatcctgcgcaggatcctgcaaattttaaatgcgggatttgcaggattaatcctgccggatcctgtcctgtaaaaaaatttgaattccaatcctgcaacaggatccgcaaatttgaaatttccggtctctatttttaatgaacaaattaatatttaaattttgccccgttaaaaggataaaataaatgtaataaaattggttttcgcacgaaatcagtgaccctctaaacagaagaagatttaaaattgaataaattttctaacaaaattattaaaaatccaaaaaaaaaaaattcatattgatggttaacgcccttatcaaaaaaaaaaatctttttttattgtatacctatttaaattctgcattcctttttcttttcattcttttttcaaattgacagattgcctttttcttttttctcctcctcttttttccatggcttctaacaataattctctgctgctgttcattcttctcatcgtcgcatcgcttctcaacgatggcttctgtcagcaacaaaacaacgacagcagcagcgggtgctgtgattttgcttattttcagcagcaatttttgaaatccaacaattaaatttaatggccctcccatttaaaaaacgattttacataaattccgcggcatggataaggtgggaactttttgttcgaattccggtccggggtgaaaccctcggaaaactgatttctaagagagagggggtcagtcactgctgaacaaaattggtcacatttctaatatcccctacatttttgtccttttttgggtatcaaaataaaaaatgttgtcgtattggaaatacgaccccgaattttcattaaaattccttaatttcccccctcattttcagtcaaattgagccggtgcaggaccatgtcatgaaatcttctatgttcgttttgcgctgttttgtttcttcccattttcatgatgaattccttaattttccccctcattttcagtcaaagtgagccggaggaggacagtgtcaactattttatgttcgttttctgctattttttcttcccgttcattcaacgcacacttagcttttctcatattattcgataaccacgttagttgaaaatttcaaaaaattgaattcaattttaaaaaaagttataaaataggaaattgcaaaaaaaaaaatcgtttttcggcaataattttttgataaatttatgaattttttggaattttgcaggctaataaagaaaactcaagtggctaccgaatgacagcaagactgtttgaaaacgttgtcgcttctgagaaaagtcataaagttgcggtcctgttacctacaatagggccgcatacagtaacccccaccaccacaaacacacacatacagtaattccccattcatttcccaggctgcttttctggtcactaatggtgccattttgcatattttcttgtgtgcctgctgctgc

SEQ ID NO: 32570 - DNA, 1344 bp, Heterodera glycines
  misc_feature (1175)..(1175): n is a, c, g, or t
  misc_feature (1224)..(1224): n is a, c, g, or t
  misc_feature (1315)..(1315): n is a, c, g, or t
  misc_feature (1322)..(1322): n is a, c, g, or t
gtattttttcacttttattgcatttttcttatgaaaatttgccaatgaccgaaatatgctttaaaaacgcaaaaaatgctttatagccctaatcataaggtacagcggggaaaattttttttattggaaattattttctaacgaatctcttcaaaaataaaatgagtattgggggttttcgagggcgctaatcacgaatccgaactgggatttgcccaattccgaatcccggacccgaataaaaatgaaatatttttccagggatgaatttttctgaggtaaaagctttgaatttatttaacaactatttattttggtgtaaaaccagtgttcccaactctgcttatttgtaagcattttgctgatttctaggggtcaaagatgatttttttgttagattctgatttgctgctttttgagaaaatttgctgatttttggaaaaaaatcagcaaaaatatccgtttttatgtaaaattgctaccaaaaagtaccaaattttcaaatttagggcgatatgttgatttttttgtgtgtgactttttattccctagaaattttatggcttcattgtttattaactaattattttctcgattttaagtacatttatgactgtaatgcgcaaaattttcaaaatttgctgatttatgctgatttttggaacaaatctcaaaatggctatttttaggctatcggtccaccggtccctaaaattccactgaaattttcaaaatttgactaataaattcccaattttcagtgaaaatctgtttaaaaaggttcaacatttccaattttttccacggcggcgtctatcggcaccgccggaaccacgccccatgtttccaaaaggttttttttggataaatcgcgccgcaaaaacctttttattatgttttatggaataaaatttaccaaaatgctgatttcaaagcatcaaaatttatgccttttttgtggtgaagcaattaaatcggtaaaattgctaattaaaaataattaagaaaaaaataataattaggtggaatttgttagatccatcgtcaacacaaaaagcagcacaaacacgagtcaatgagttgacaaggattaacgaaattcgacagccacaattattccaaaaaaataataaataaatgaaataaaaaatgattgcagaattattaaaaattanattcgcttgttttttacaaaatatttctaattcgtgcaatatgccttanacaaatttcatttttcatggaaaagtcttgttaatgaaattattaatcacttccccataattaaataaacataaaatcttttttgtttttnatattanagcaaaaaaaaaagaataaaaa

SEQ ID NO: 32571 - DNA, 1193 bp, Heterodera glycines
tgtgtacttttggccataactttgttcttaattgatcctttttttggaattatgcaaaataatagagcatcagaagggctctcgaatgataccaacaatgttagatttggtggaaaaagaaaaaagttatagtccaaaaactgggctggcgccgaaacgagcggcgccgaaacgaggtggacccagtcacacccctggtacataagttatatataaaaaacccgaaaatatgtaaataaagtcccaacttttggaatccagggaaaaatacgtattacataaaatagatagccataattaatatatttcatccgaaaatggttgttaacagttacgatggcaaatctacgaaaactatattaccataaaatggttactttgtcgtcttcccccccccaacctcaactcgttacggtatctttggcttaccgtacctcgaacactcgctgttgctccgcctcactttcgcacttttccgctctccaattcgcaattgcctccgttttgatcatttgcgccccattcgcgtgcaattccaccgccatttccatgtaattgacgaatctttgtacaatgcaaaatgttttggcctgcgttttgggcgttctaagtccaacaaaagcgttcaaacggatttttcctatcgctttttcgagtgccaaaagaatcggctgattgtgcccaatgcgtgggatattgtcagcaacaattgtcctcagtttttgcaaaaggaagggcaaagcgagtcgaactccggcaaaaaatgccgaaacggagccactcttttgttgcagaaaatgattgtagcggatcacctcagtggtactcaccggatcatctgaattttggtaaaataaataaaagccttcgagttttatgtgtattttttgcatttatggctcaatacaatcaatatttaacaattaatccactaaacaaatagagttttaaatattttatgaaaccgagtctttttggcaaagtgattaatccaactgacggatcgattaataattaattagcccaccaaatttcaacacttccgggtggcgttcctccaaaagtagcaacaaagcttccccaacgaagtgtcttcaaaactatcttcacatcttgcatttccgttggcacgcttaaagcgcaaaaaaagcttaaaagtatgccaaatcgccgaatgatgcgccaacacacac

SEQ ID NO: 32572 - DNA, 1032 bp, Heterodera glycines
tgctattctatttctaatctgttctatgcgttgttgtctctctaacacattctcttcagatctttgactgctcattctatttctatttcgttctaaacgcaaagccctttgactttgtgcttcattttctcttctcaatctttcgcgttctctttttcttttcaaatactcatctcttctcatttcttcaaattgactatcactcacacgtgacggtcctgcaacgccaatatctgaattcagagatgcctggctggcaacattcaaaactcttgctcgtttagcataattatgttcagacaaaacatgacaatcaatttcttgttctaaaatctcattttcatcttcaataacaaaaacattttcatttcctaataactcatcattttcaactccattactaaaatcgctctgaaaaacacggtccaaattcatcgctcaaacaataaaggcgcctttaatctgtataatagttaattactaatatcaatttataaaagcaaaggtaaaatattgcattaaacaaatagtgacaaaaaagttaaagtttatcaatttaaaattaactgatgaataatggaaatgatgtgacaaataaataatcaaaccgacctgttcagcgtaatttgaaacctcattattaaacttgcctcaattatgaaatacaatttgaagaaaataatttcattacaactacatattctcttacaatgtcacaaatctattacaatacaaaacaaaaaaaagcttttcacatccttttgtcagtcaatacaaacaactaagttgccttcaattttttataatgaataaaaatcgcaataacaaaatcagatataattcaaaaactcaacaaaccaaaaaattatcttttttctttctttttcagtttgtcaaaaactcaattttaaagcaatatacatacatattttctaaaaaaaaatgaacgtgagcgagtaaacgaaaaatttactctttttttactgttttaaaagaatacaattattggatattgactctttataataaaaa

SEQ ID NO: 32573 - DNA, 1258 bp, Heterodera glycines
aaaaaaggctacaaaaaatattatgacaatttggtccatacttttcttggtaaataattattaaggaaaatgtaagtaagcagcaagtcgccataaacattaaaaaaattaatttaatcctattaaaattgtaggtcattaaatttagaatttgagattgaataataataaaattaattaatgatcaccaataaaaatgaaaaatgaaatcaaaaagagaaaaaataaaggaaaagggcaggatactgtagcttatttaacttaatcggagatcatttaacataaaattgggtttaataagaatataattaattattatgtaacttgtttcgagtgaaagagctgctacacttattcgttagaaaaaaatttgtttgctcccttatgtacccatactaagtaatttatgccgttatcgatggtgaaatttgggtgacgaaaaggtactaaaatggcccttaagaaatgggccgtaaatgtccgggacgcaaaagtcgggccgtaaatgtcgggcgccgcaaatgtccgattttggcttgggacgaaaaattcaataaaaaattgggccgaaaatgtccgaaaatggcccttaagaaatgtgccgcaaaagtcacgccgcttatgtccgattttgtcttggaacgcaaaattcaataaaaaattgggccgaaaatgtccgaaattggcccttaagaaatgtgccgcaaatgtctgggacgcaaatgtggggtaaccaattgggaaataaaggaaagagagaggatacggtagatcaaccaattagtcattatcttattaaaataagaaatattacataaaagaaatgatgaaggatacggtaaattaacgcgatttgatctttgctttatgataaaagtaaaactatttagaagtacaaacaaaaaataataattaaaaatcgaattttggttttttaaaaaagtatttctttttgaaaaatggaataaaagggaaaaattactcatcgacttttcgtagggttcaaaattgactataatcctcgaaattgttttttataacaaaatcggcgctaattgtgctcatttttcagcacaaaaatcatcgattaagcaacgtcatattctaggcgttttcaagctcaatgcttcattaatttttctaataaaaatattttaaattttccaaaagcaaataatttattcaatatttttcggtaaatttacatcaattccaaaaatgcattttgcagttaaaaggtcaattttcgaaaaaaaat

SEQ ID NO: 32574 - DNA, 1374 bp, Heterodera glycines
tgctttcaacacacgacaagtgagcaataatgatctcaattaaaaaatttttttgtaatgctcaataaaatgccaatgatttcaagaaaaggatatgggataattaatcacttagttttttttaattaaaagcccgttttcagcgcgattgtctgaccgccttcgtccgtctggccatgatcatgccgttcaactgccagcccaccgctttgcgtgtgctcgtccaccgtttgctgtccccgctgctcaccccgccggcgtccaccaaagaggacacggccgccgctgctgctgctgctgcagcagtttccttgaccattggcgttgcaaaaagtaaaccaacggcactaccttcatcaccacgaccagcgcatcagcagccgccaaagtcaccgcttctcatccaattggaacacgcgctgagcaccgaagttggcatcatgcaaagcggcgcgtatttaatgttgtttttatgcttatgccaatgcacgtgtcagcaaagtgcccatccatttaaggaccctttaaaatgacggcacatttattttgccgattttcttaataacttttctccattttagatatgctcacattggcggttcgtttgtttgtctattttgttttttgactattttacccatctcattgttaggtggagttggtgctgtgcatcggttggacttgggtgttcggcaaccgcgtgctgcatggcattagcgaagcggagaccgtgtggaaagtggcggatggaagtgttgatgagctgtgagtaacacagcataattggagcaatttgtaaatttcttttagttatgtcatccgtttgactctgttggcacatatttttcaagttcgttgttttataatcggaattcaaattggtcgcagtacccttaacgaaaatatttccttccaaaaattcattttatattggcatttccttcagattgtcgaattacatgagcccgagtgcgaagtgttgaaaaaaactaccgccctccgtcgtccatcgtctgccactacttctcggtcttccgtcggcacaaagacagccacagcatcctaatgcctctcgattttgtttacactattgacgcgttcaaccgtctttttgcctctctatctcttctgtaaagtgaatcctccagtcgagtcggtgtaatatctctttttatatcagtatcaaaagataacatagctatgaattatttcacgggaaaaaaatgagctttaaggtggtttttcaactttgagtcaagtcttttttccgaccttttttgagcaaggttgggtggggagacttattcacgagaatgataaagcggatccggcggggtgttgtggtatatgaaaggcccatatatcggggtaaat

SEQ ID NO: 32575 - DNA, 994 bp, Heterodera glycines
aaaaaagagatagtgatttttctggattaggccggacaaataaaattaccagctattgaaatgcagtggcaagcacagcgagtcgcttatatgcacaccctttgacacgtaaaatattccaaaaaaagagatagtgattttttctggattaggccggagaaatataaattaccacctatatgaaatgcagtgggcaagcacagcgagtcgcttaaatgcacaccctttgacacgtaaaatattccaaaaaaagagatagtgattttttctggattaggccggagaaatataaattaccagctctatttgaaatgcagtgggcaagcacagcgagtcgcttaaatgcacaccctttgagacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgagacgtaaaatattccaaaaaaagagatagtgattttttctggattaggccggagaaataaaaattaccagctatttgaaatgcagtgggcaagcacagcgagtcgcttaaatgcacaccctttgacacgtaaaat

SEQ ID NO: 32576 - DNA, 1357 bp, Heterodera glycines
aagctaaaataaactaaaccaattaaaaagctttttaatttttaaattgaatttgcataaaaagcaatgaaaaggccaaaaaaaatagaaaatttacgtaatgaaagctaattaatttaattaattaatttgaacaatttatcaattgttatttacaacatatacataccaggaaagaaaataattctgaataatttatatatggaagagaaaggacgccgaggcggaagtgccggaacaagagatttaataaaaataaaaatagagacattctaaattataaaataaataaaaatatttaaatatgaagatttaatagaataagaataattttaaaagaaaaaagatttaaaataataagcgatataaaattataaaatgaaagtagaaaggaaaaataaaattaaaaaaagaattaagtggactaaaacatcaattatatttagaaaaatagaaaagaacatcaaaatttattaagcatatcctctgatttgttattattttaatttttatccaaaatttttttccaaaaaaataaccattaaaaattttttaatatatattttagtacatatttcgcggtttctcttacataaaaatggaatccctgtaaataaatatttaacaaaaaataacttcagacatcaattggaaaatataaaaataggaccaaatacaatagttaaaatcaaaaaaaaaattctaattaataagttaacacggaataaaataaataatggatagcaaaaatttatacaaaataaacaaataaagaattttattttaccactttaatacacataatttaaatattctttttcatttaaaatcaaataatagaaaaataattattaattaattaaggaaagaataataaaagaaaggaattcttaattttgaatgcaaaatatttaattaaataaacgaaacataaatgaaaagagtaacaataaaaaatgaaaatattaaattgaataatgaaaacttttattttaaaaatctttttttcatcttgttcaatttttgtaagaaataataatttattaatgaactaattaattttttcgtctttttgaaattttgtaacatataagaaataattgtgaaaaaaaaattgaggaaagatatttcttccgaaattattaccattaaattatagaggttcacaaaataaattatttaatattggaagaaaagcgaaatgttaaaaatggatatcttattttaattggtttcaatttattttttaatatttaataaacataatttataacggtacttgagctcaattaaagtgaagagttgttttataaaaataatagttttatattcaaaatgaaaaatgtcaataaggaag

SEQ ID NO: 32577 - DNA, 1638 bp, Heterodera glycines
ttttgaaaatttttgaaaattttttagaaatttcttgtgaaaaaataaaaaaactttttctttaaatgtaccccaaaaaaatagcaaaaataattttttaaatgttaaaaggtgattctaaacctatttaggtcattttctgccattttgtgccaatttaacactttacgaagatttatttccaaaaaataaccattaaaaaaaatttatttacatattttcgtacatattttggatttttatacatatttcgggattttttttacatatttatgtacatatttttaccaatttctgtacatatttttgacatccctaatgataattttctgtgtaaaccccaaggatttttggcgaagcttttcactaatatcttttaaacaaatttaaaatttttaaatcttggtaactatttttcgaaatttgttcgtctttagaaataattaattttttacttatataaaagatagtgttgctgattttctaatgatttccatcattttggactttaaaaatcagctcattctttctatgttgccgcggaaacgctgaattttccgcgttttgacttcttaacaattttcataaaaattccaaaaatttcataaaaatgccagccctcccccccggcggcgcaacaataattgccccatttttcgcccgcgtttttttggattttggcatatataaacaaacacacaatgttcatgccaatgagaattgtggagtactacaaaatctgggtaattaattgcggtcatccattcccaattaatgtcaattaacgaggacccaattttccatttttaggagtgcttgtgctttaatttgtaccattttaagcaccaattttaccacctgcaatcacttcaaatccttccacaaatgcgattgctgggctctgcttgtagtgccgtgccgtccaaccacctttttggatgctttccggtgcaggatttatgtaatctttatcctctggcgtttgttccaccaattttaaagttgcttctgacagatgacaaatttacacatgcacattcgaattgaactgctccaaagcgggcaaattgtttggcttgctcaatgggaccagaaaatgctgaaatcattcattaaatgagatgaatttgatactaaatttttttttttttgttgatatttttaatggaaaatatttatttttttttgggggaaaataattgttttatttgggcatattttgcaaaattcaattttaagagtcgtaattatcccatcaaaaaaaactgtctttttagccatggttttaggttggggcggcccgaaattttctgatcatgattcgagattagggacgagaaaaaggctgggattcgaatgacaaccctgttagttaaaaagtatttgaaaataattgaatgaaattattaggaatcaattcaaattcgctaacttacaacatgatgaccgttctcgcccaaaagattggcaaaacgcacactcagctcaaaattggtgtccaaaaagtttggcgcgatttgcaaaactttcaatgagctgacaacagcagttagaagtgaaagaacacaaatcaaaacaggaggacagaaaaaatttgtcatttttctcagctaaaagaaattcatttatttttaaata

SEQ ID NO: 32578 - DNA, 1730 bp, Heterodera glycines
  misc_feature (1330)..(1330): n is a, c, g, or t
  misc_feature (1337)..(1340): n is a, c, g, or t
  misc_feature (1346)..(1346): n is a, c, g, or t
  misc_feature (1348)..(1349): n is a, c, g, or t
  misc_feature (1351)..(1351): n is a, c, g, or t
  misc_feature (1359)..(1359): n is a, c, g, or t
  misc_feature (1361)..(1362): n is a, c, g, or t
  misc_feature (1365)..(1365): n is a, c, g, or t
  misc_feature (1367)..(1372): n is a, c, g, or t
  misc_feature (1378)..(1378): n is a, c, g, or t
  misc_feature (1381)..(1383): n is a, c, g, or t
  misc_feature (1386)..(1392): n is a, c, g, or t
  misc_feature (1396)..(1397): n is a, c, g, or t
  misc_feature (1401)..(1401): n is a, c, g, or t
  misc_feature (1404)..(1405): n is a, c, g, or t
  misc_feature (1417)..(1417): n is a, c, g, or t
  misc_feature (1422)..(1422): n is a, c, g, or t
  misc_feature (1424)..(1426): n is a, c, g, or t
  misc_feature (1431)..(1433): n is a, c, g, or t
  misc_feature (1440)..(1440): n is a, c, g, or t
  misc_feature (1443)..(1443): n is a, c, g, or t
  misc_feature (1446)..(1448): n is a, c, g, or t
  misc_feature (1452)..(1455): n is a, c, g, or t
  misc_feature (1458)..(1460): n is a, c, g, or t
  misc_feature (1465)..(1468): n is a, c, g, or t
  misc_feature (1480)..(1480): n is a, c, g, or t
  misc_feature (1482)..(1482): n is a, c, g, or t
  misc_feature (1484)..(1485): n is a, c, g, or t
  misc_feature (1489)..(1489): n is a, c, g, or t
  misc_feature (1492)..(1492): n is a, c, g, or t
  misc_feature (1494)..(1494): n is a, c, g, or t
  misc_feature (1496)..(1496): n is a, c, g, or t
  misc_feature (1498)..(1499): n is a, c, g, or t
  misc_feature (1501)..(1502): n is a, c, g, or t
  misc_feature (1504)..(1507): n is a, c, g, or t
  misc_feature (1510)..(1510): n is a, c, g, or t
  misc_feature (1512)..(1512): n is a, c, g, or t
  misc_feature (1527)..(1529): n is a, c, g, or t
  misc_feature (1554)..(1554): n is a, c, g, or t
  misc_feature (1557)..(1557): n is a, c, g, or t
  misc_feature (1560)..(1560): n is a, c, g, or t
  misc_feature (1562)..(1565): n is a, c, g, or t
  misc_feature (1568)..(1568): n is a, c, g, or t
  misc_feature (1573)..(1573): n is a, c, g, or t
  misc_feature (1581)..(1581): n is a, c, g, or t
  misc_feature (1588)..(1588): n is a, c, g, or t
  misc_feature (1603)..(1603): n is a, c, g, or t
  misc_feature (1607)..(1608): n is a, c, g, or t
  misc_feature (1610)..(1611): n is a, c, g, or t
  misc_feature (1613)..(1614): n is a, c, g, or t
  misc_feature (1616)..(1616): n is a, c, g, or t
  misc_feature (1618)..(1618): n is a, c, g, or t
  misc_feature (1620)..(1621): n is a, c, g, or t
  misc_feature (1626)..(1626): n is a, c, g, or t
  misc_feature (1632)..(1632): n is a, c, g, or t
tgattgattgatcaaaaaccttttttgccattgttcagattttactctttttttgtttggtgctattaaattacacgtcaaaatggtgttttaacttttgtaatttgtccaaatctttaagtctttcagagtcgaaatctcggaaaattgtttgcggttctgtgatgtaactggctcatatttgcacttaaatcgcaaatttccaattttaaaattttgaaaaaattttatttttttggggcgacgtttcggccggcgacgttttgtggtgtatcctaccgagtcaggccgtagcaagaaaacacaaaatttcgtatgggaaatccgaagaccttgtttatcatttgcaaagatttgccatttttctttaaaagttttccattcgccccctgaaaatggacctgaaccaaacatttgcaataatttcaaaaaaatgccaacccaaactttatttctgtgcacttcgttttttctttactttcccttttacgtaattgtttattcaatagaaaatgttaaagatatgggcaatcatcaacaattggtgtcccgactaaaaaaaatgttaaaaatttgaggcatttattctaggcttaaaaaatgtgttgacaacgaatataaactctcagattttgaaaaatcctatcgaaaaatcattaattttttcatcaattatcatgaaaaataaactgcagccaaccgggcttttcttaaaattttggaaaaaatcaagcagttgatgaaaaatagataaaccaatgattttcaatcggcacattttttaagcctaaaaaagtgctgccaaatttttaacattttttcgtcgcgacacctgaaatatgcaaagtaaatatttttaaaaaccatcaatttgggcggtccgcgcaaacctcttcaattgagaacaccgcttccctcatcttatttgtttttgttcgtaaacctcgtcttgcgccaaccaaacgcttgttttttcgcgagcaattggtagttgggctcaattggttgcggctaaaaattttcaataattgttaaatgattgtttaggacagttggccctttttccataaattttagaattcaagaatttagactcatgagcagctgaaattgtataaaagcctttcgttggtttttttaattttagttttttctcttaatgaatacaaaccagggaatagttttgtggccggaactgttggaccccgtggtcacccatcgaactgcgccaacgccaattcggctccatcatttcgtcctcgaggtcgttgtcaatgtccgctgaagtcgacggcctttccgcaatatgccgttttgctgccgccctttnttctcgnnnntccctncnntntgcgtttntnngcntnnnnnncctccnccnnntcnnnnnnntttnncgtnggnnttcccttttttnttgcntnnnttgtnnntgtgtgntgntcnnntggnnnngtnnnccggnnnngtgcttcttttntntnntggnggntngngnngnngnnnntcntnctcctttttttgctnnnttttttgtttcttttttggtcgtcntcnttntnnnnggnatgcntgttctcngtttcgncccttcccttcctcnttcnncnncnncngntnntgttnttcttnttccctttgccccttaaagggcttttgctcgtggcccttgttttggtcagccacttaaacggcggttgtgtgaaaaaggtgtgttcagaaaagaactt

SEQ ID NO: 32579 - DNA, 1321 bp, Heterodera glycines
  misc_feature (717)..(717): n is a, c, g, or t
  misc_feature (728)..(728): n is a, c, g, or t
aggctattgctgaaatggtaatttcacctaaattttcaaaaattgtaggacagaaaggaaaacatattaaatcacaaacgcaaaaagatgaacaaaatgatgaaaacggtaaaaaatatttttaggaccaataactcttagattaatttaaaatttacaaattaaaatttattattacgaggaaccaataattttagaaaaaatgaaacaacatattgcttcatcttcaaacagcgtagataaatgtgatgaagaaaatattaaaaattatatcaaggtaaatgaggaccccgaaaaaattaaaagatttttttttaatttagaaaattcatggtattatttcatcaaaagtgttgaatatttttaaacgggatttcatggaatgcccaatttgctatgaatttgtaatgtatgatcagctctgtttttgtgatcatttaatgggcgacacaatttttggtagcagttcaaacaatgcgcaaaaaggcaaagcaattaaaattaaaaattgtattttaattaataaattattaatttttaagaattgcacatattttgccatgaatgccttaagagctacacaaaagcggcactcgaaacgaaatcattcgcgcgcggttggctgggactgaaatgcatggcggagaaatgtgaaaatccaattccatggcgtaaattataactaattattttattaataaattcaactgaataatntaagaagaatntaaaaaagatgcatcatcggatgagcttgagacaattaaaatgctggaaaattactgcgctgaactgagtgtgtcagcagcgtgtctttgcatggaacggtcggtcatatttacaagcaaacaaaatcattcaatgcatgcattcattcatttaattaatcatttaataattaattaattagcaactaattaagatgccctaaatgcaattatgccgttgaaatggatggtcctcttcccgtcgccgaccattacaccatgaatgcattacaaagattgtttaaattgaaacaaaaaactaatgactcaaaagttgaactgaaatttcattgccccgagtgccatttacgaaatgtgtcgcaaatgcaatgcaaaatgggcagaagagcacaacaatttgacatgcgaacagttcgccaaacagcaaaataagcaaatccaacgaaatctcaagtaatgtaaaaaataaataaaaatagcatttttaggttccggttgtgccgataggcgccgccgggaaaatttttggtatttttaatgaattttattacaacgtatcgccctttttagacttttctcggagacctctaaat

SEQ ID NO: 32580 - DNA, 2196 bp, Heterodera glycines
  misc_feature (17)..(17): n is a, c, g, or t
  misc_feature (69)..(69): n is a, c, g, or t
  misc_feature (2022)..(2022): n is a, c, g, or t
tttatatgcagtaatanagctttgtaaagtgtctttgattattctgtctaagtcaccaaatttttgttnacgggaaaattgaagaaagccacatgcggaataatttttattcattttcaaaaaatagaataggcaagaagagaattagttaaattaatataaaattgtaaatataaataaatatatttctttttaatttttaagaattttaagctatttatccttttaacatcttttgaaggaattccaaattatcagatgaatttaaagaacattgcgaaaacatcataatttattttgttaatgtgaactgtttatattaattattattttttcatagaataattgaaactaccccaaatattttttgaattccgaaaatagtacaataaaatttaaatttgactattaaaaaatattattttcattaatataaataaatctgttttataaaacaaaaagtacaaattaagattatttaaatagttaaatgcaaaaataattttaaatgatattttaaaatgttagcatcttatgtaagatcgataaatataatctcttctggattctgttaatgttattcagtatcattccacaccggaataactaaaaaggtagataaacatttttagtagatagcccttattatacatatataagaataataaatgaaaaaatgtaaaaaaaaaattatattgcattttttcgttttaagattttaaaaaagtcttcgaaattgacttaaaaatcaaacttttatttttatttttacaaaatctagccaaaaaaccttcctgaaactcaaacttgcaaattttgggtatatattttttgaaaataaaaaagtttgaaacaaatcaatttttgtgcatatttttatgacgaggattaaaatctgtaaaaatttgcactttaagaagcacccataattgcaaattttacgaagaaacgaaaccaacaccaataaatcccctcagatgtcgatggtatcttgaaacgaagatttgcgtgcgagtttggtcttacaaatgcacatgttttcattggacgcaaaaccaaattctgtttttttatccgcgcagaattggggaaaaattgttatatttgaagtacagccccattccttgatgaacttttttggctgtgtacctgttagacaaattaggagaagtttccaagattttaatatggtaaattgcaatttaatataaatcaattcaatattaatatgtattaattaattgcgcagttttattatttggagccggaattataatgaagaaactgaagaaacttaaaaatagctaactaaataatggtaaaaattttttaattctaaatttcgcgtttaaaaacaaaacataaattaaaaaatatttcaattaaggaaaaatcttgaaatttttagagtccgtttcctagggatataactttaatgtttttattcacttttattaaaaatttttaataatttttagttaaaaccaaaaaatagtaataatttcgaatgatggatcgttaacaaatcacatccaaaactcagcaaattgttttcagtagacctaggttttcaacaaaaaatactctaacaatttttaaaaaattttctcttgaaaatgtaaaaaaataaaaataaatttacggctttttttaaaattaacatgtgtattttttttttactaaaccgaaaccgcttcagttcccggcaattttaaaacccggtttgaccaattttgagagaaggaccaggaatatgtcgtttccaaaatgtcagtccgaccgacagattcggaaaatccggtctctatttttcataaagcttcagaaaaaatcattaaatcactgaaattgccgatcctaattattatgattaattaattgattcattactgtcattgcactcgatcaaataacataaatccgtgtcaggtggacaatctccagttgaagttttgttgtcaagagtttctcgactaattttgcatttgttttcaatgccttgataaaaaaattaaaaattanaattaaaaaatgaccgacttggagttggaagcacaaggccattgttcgagccgcttacaacagcggaaacgcataaggaattttgcgggattgggccaatgtaagcctgggccaatgctcgtccctttgcatggatgaagtcatcagtgtcataattggcatcagtgcagcccc

SEQ ID NO: 32581 - DNA, 1871 bp, Heterodera glycines
  misc_feature (1767)..(1767): n is a, c, g, or t
cttttgccaccttcgcacatttgaacggatgtttcggcgctttttcttgcaaacaactgaaaccccaacaattaaaactgttcgtacaaaaaagcgacgaacgcgcagaagtgggcgtatgtaatattattttgacgacaaatgtaacaatgagtggcgccacaaggacaagtgacctgtgcagaagggcaaagggtgtttaaggggaagttgatgaccaaatcgaacgcactttgttacaaccgtcatgcttcacgaaggacattttgcacttggcacaacagtgcaccacagcttcagacagacgcttttccctgaaaggaaaaaacaaaaattgctgaaagaccaaatataattttgttcgctcacaacaatcgttcgcggttctgtttcttggcgaactgctcgcagctgacgcccttgtgttcgtcttgccatggctcgtcacacaaacgacaaaacttaagacgacaatcgggacaactgaacaccatcagaacatcgggggaggcacccaattcaacggcacagttacagctacgacaactgacaaaggaaaacaaaataagtgaaaattaaacgaattagagaatgtcatataacaaaactaatttcacatattggtctaatgaaaagattaccattatcgaattaaacggaatacccctaaaaaccaatcgtttaaaattaatttttaaacaatagatttaattttgggtaaccaaaaactaataaaaatatacttttttgtatatattttcacgctcaccgttccatgaatttgaggttggcctgtaccacactgagctcagcgcaacgttcttccaattttgtaactgtcgaagatggcacaaaggcttgaagttcctctacaatattgaaaattcaaaacggcataaattttatttatttgcgtggaggaaaatactaataaaaaatttaaaaaactgtttgactcacgaagagtgatcggattgttgcaatcggcggccatgcatcggaggccgagtccgccctttgccaatggcatttcctcaacagcggcgcgcgcgtggcgttccaaacattgacgacaaaaagcgtgagtttcggtggtcagtttagctatcaattattaatttgaacgaatggttaatttttgggtaatactatcgatggtgcccccttttttggaagaaaattttttgttctaaaacgttgtggaaacatgtttacgggggttttcagggtcgctgatcaggaatctgacattaattttcacttatttcgaatcctggacccaaattcgaacaaaagtcgaaaattcaaaattttaaaaattcatttttatgttcgtacctgtataaaataacaatttcatcgatagtattaccaatttttgctagcagttgctccattgttgaatttatttttgctattatttcattaattaaaccaccacctgagctgctgcttgtcgctgtcattgtcgtcccgtcacaaaagcacagttcgtccacggtggtcgtctcccagcagacggagcattccatgcactctttcaccgactgtcgccgcgggtggtcaccgctttctgtttctaattgatcgagcagcgaatcggtcggaataccggtgacccgtgcaccgaaggaagagagcaacttgcggacaacacggccgcccagccaacgaggccaccacaccgaaagaccgacgaagaaggaacacgcctttaacatgagacgatggcactgcaaaagctgactccgtggaatgtttgagggnggacggaagtaatggcatcatttggacggatggagtcacaacactgaaacacccatccccccaccaccaacgtcctcacttttttgtttctgcatttcaatttt

SEQ ID NO: 32582 - DNA, 1222 bp, Heterodera glycines
acgcgtaaaatgtcacgggacgcgtaaaatgtcacgggacgcgtaaaatgtcacgggacgcgtaaaatgtcacgggacgcgtaaaatgtcatgggacgcgtaaaatgtcatgggacgcgtaaaatgtcacgggacgcgtaaaacgtcatgggacgcgtaaaatgtcacgggacgcataaaatgtcacgggacgcgtaaaatgtcacgggacgcgtaaaatgtcatgggatgcgtaaaatgtcatgggacgcgtaaaatgtcatgggacgcgtaaaatgtcatgggacgcgtaaaatgtcatgggatgcgtaaaatgtcatgggacgcgtaaaatgtcacgggacgcgtaaaacgtcatgggacgcgtaaaatgtcacgggacgcataaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcatgggacgcgtaaaatgtcatgggacgcgtaaaatgtcacgggacgcgtaaaatgtcatgggacgcgtaaaatgtcacgggacgcataaaatgtcacgggacgcgtaaaatgtcacgggacgcgtaaaatgtcatgggacgcgtaaaatgtcatgggacgcgtaaaatgtcatgggacgcgtaaaatgtcatgggacgcgtaaaatgtcatgggacgcgtaaaatgtcacgggacgcgtaaaatgtcatgggacgcgtaaaatgtcatgggacgcgtaaaatgtcatgggacgcgtaaaatgtcatgggacgcgtaaaatgtcatgggacgcgtaaaatgtcatgggacgcgtaaaatgtcacgggacgcgtaaaatgtcatgggacgcgtaaaatgtcacgggacgcgtaaaatgtgacgggacgcgtaaaatgtcacgggacgcgtaaaatgtcacgggacgcgtaaaatgtcacgggacgcgtaaaattttaatccaaatgcaataaagtgcatgtcactgtgtccgaagggacaaggacttcaatgtgccacgactgacgccacaatcatcaccttactgccagtcgatcaagtcaattcgtatgtgatcagaacgctgcaggacgagctcttggggacggtactacaataacaagacactttttttatcgattgatttccaccccaaaccaattggcttcaaaagtttt

SEQ ID NO: 32583 - DNA, 946 bp, Heterodera glycines
aaaaaacatagcctgttcaatgcttataacttttttcagaagcaataaaattaaattttcttattagaatttcaagtccactatttaatctatttatctttaaaatttcaaaaaatttcattgagtttcaaaaaagttatggccaaaaattctgactcaagattttttgaaattttctgaccataactttttgaaaattttattaaaaaaattttaaaattaatattccgttagagaacatctagagctattgaatgataccaagaattattaatttgattgaatttttgccaagttatgaatttatatgtcttacattttttgttttcctaccccttggcggatttaagaaacgcccaatgtggcggaatttaagaaacgacccagcacgatttgctcttgtgtaaatgttctgcgagttcgtcttttccgttctccgccgcttgtcaaattgccgtttttggtgtttctgcagtccattacgacaaaatttttcgtaaaattattcaatttgtccctttttgatgctttgctttgtttttgaagctttcttttttggccaaatggtgatcaatgtgttcaaaagattactcgacaaactacaaacattaagcacaattttacattattccagtgattttgccgattaatcaattaaattttgtaaattcattttctaaattcactcaaactataaaatattaagggattatgttagttggagcttgtaggttggattttaagaattgatgaagatcttcgcccaaagattttcaaaaaaaatttttttacaaaaatttaaaagttagtttcgaatatttttgtactttttctttgccttacgccttaaaaaagattaatatcagagcaaaaaatacataaattattttaatccaaaataattttatatactattttatttagtaaaaggcaattttcactgcca

SEQ ID NO: 32584 - DNA, 1497 bp, Heterodera glycines
taacggtggttttgccgtacccgagacacatatcgattagacacaagtctcgggtttcaacgaactaatatgccatgcctgattagaggggaagtagcattgaggtgatgtgcatggagtttatggaagccaacctgctggtgcatcatttattttttatatgggctttgctctggcccggatcctcttggcattttttggcctaccggatcacagacttttttggccctgacccggatcccattggcatttttttgacctaattcgttcctaagatgtccatctcgaccgttataaatccttgagaattcctgaatttcttgtgtattctcaccccctagggggcgccaaattttgtattattatgcccctctctccgccgatggcaagcaggacacctcctcctccatgtggcagttcaacggcagcagctcgttcagccctcgctccttggtcaccgtgaacgtgccgccgccggcgtcgcaagccgtaccggacgacgacgtcgacggcatgcttttgcgcgtgcgcacgtccatgggcgctgggacaagttcgtccgcgtcgcatgcgtccacctcgtcgcaaccgccccagcgacagtttttgcggaacggacacgccacgacgatgacgcggacgaccgcgactaacggcagccgacacgcaacaaaggtcggtgccgtagttggttgtccacacatggcacaaaggtcacacatcacatcataccacggcacggcatgccacgtgatatcagtcaccacacagcacacggcagcaacaaaatgttaccttgtttctttgtttgttggttgtacatggcactcacaccacaacaacaacaaacacaccaagatggcacaaatgccatcaataaaataaaaaattgttttttgaattttcgtttttttataaattttttttgctaaacgtaaaaataagtgttgatatgaagataaaaattaagactttttatttgatggtctaattagctaattagtatatatgggttggcacaaaacagggaattaattagttgttcaaattagcgaactgtcgtttttacgcatggggcggcacatcttttcatgagatgcaccacacttcaataatgcaccttcgcatattctcggacacatttgttatgtgataacatattttgcaattttaccgtactctcgctgcagcagaacttactgtattaaagtaccatttttacagtgtgtcgcttcttggcgaaaatccgttgcttaaacccgctttagcataataatgtatatatacctacattatgcaacacatttgccattcaatagagagagagctttattgctttttttcttaaaaaattgtaccctttggctgtccttaattttaagtacgcgctttttaaggacgggccacataatttatgggcaggaaagggacagggacggtcaattttttgaataaaaatgaatttttcgactgaaattaaagcatttttaaattaaa

SEQ ID NO: 32585 - DNA, 1603 bp, Heterodera glycines
aataaaaatataatcaattatgttatctatgcaggggcgcagagtgttataaggtaacatggattattcgctggtgattaaattaaacatttcttcgatcaattttcgagccggaaaataaaatagaaacttttaacattagttaaaaaattttaaataattgcaaataatgaaaataataaggccaatatcaaactaaatgaaaaaataaaataaactaaaaaaagcataaataaaaaatatttttaacgaaaaataaaggaatacatgttatgaactatctttattttaatatttaatgaaaatttatcattttttgaattttaaattaaaattgttaccttgattaaaatataattgtatgataattataaataaaatttaaatattaaaaatagaaattgaaacaattacaatttatattaaaaaataatagttaaactataattataaaacaacttattaaaatcattagatttatccatacctaaatcacatgcagtagaaaatcgtcaactgtttgacaaattaagcgaagaactcctagcacacacgaaaaatctcctaggatgcgagatatataaaataattaaatagctaaaaataaccgtcaaaacattaaaataagaaattaatttatatttaatgaaaaaataaaatatctgctttaaaatcacaaaatctgtatttagaaaaaaacatattttgaattagcaaatttttaatgataattatttctacgaggaactcttaacgcttgaatgaaatcatatgctgaaccgattcgtttcctttgtgagaatgaacaacatgaaaaaaaactctcaagcgcatataaatgaaaaatttattaataaaaaggataaaatgaaaattaaaaattaaaaactttatttctattgggatcaaaaagtaatttcaaaaaaaaaaatcaaattaattcataaacttatttattaagtgagaaatttatgttaagtatcgaaaaatttttgaaaaaatacgcttcgaatcaataaattctcttattaaatttaaatatagtaaaaattaaattttagtttcaaaacgttcataaattttctattattcaaactaaaaataaaaacattaagtaaaaaaaatccaaattaattttaaaaaccatataaaaatgaataatattcaagttattcaaaatatatatttaatgtattaaaataaagttcgttacgttaaaaatattaaaatattggacataaatttatttatttttatagaataaaataataatgtaaaaaagaaaaattaaaaagacaacttatcgcccatatgcagtattttttcggaagcgagatatttgaaaataaataaaataattaaaatgcgtgagataaattagtatcaaaattatgtgccgattaataatgctattaacaagttatgtaaaatttttaattctattatattaatattaataatatatttcaaaaaattatatgaggataatagtcgataaatatttgttttagcatttaattatcaattttttcaaaattaattataatcaattgggaaaataatattcaaaaaccaagcttattaaatatgaaacagctaatat

SEQ ID NO: 32586 - DNA, 1122 bp, Heterodera glycines
tgattcgaatattaattaattatttactgcttttactttcattttaggctcagagaaacaaaaacattttaaatgaaattgttttttaataatgttaatctttttaattgcactttgatgctttgtttttgcccattgcattgactgttgtaagccaacattgggtaatccgtttgaaatataaaacacaaacaccgtttccctcctttttacccccggggaattcaacaaatcaaatgggatgatcagtcacttcattttcttggtgaacaactccattttgctttgctttgcttttttgtcctttgcaccaaagccaaagcatctgctggcaatggaagaaagagaagggtaaaaaagcaaacaaagaaaagaaaaaaggggggcaattgtaagccatttttaatttcattaaaatatgtcgaaaaggtcgaactaatttcaacgggtcgaacccacgggcaaaatttccacacttttttaagagagtgagtgccgaaaccgaactgaactggcaaacgatccaagaaaaaaaaaaacaaaattattattttgtttttttaaaatttaattaaatttttttgctcaaattaaaatttaactttcactgtttctgatcaaactgagcagtgaaattttgtggaaagtgaacaacgaataacaaaacagaagggaaaagcggcgggggggggggcaaagggcaaacaaagggaaaataatgaaaatgaaatgaatgaattagaagcgaagcgaagtgccccccccccaaatcacacaaaagtcgtccccccccaccctttccccccttttttccctccgttttttttgtttattttgttggatgtatttgttctctctctctctctctgctgatccgccgccactgccgttcgttttctcgttttcttctgttcccgcactgtcccaaaagcttcgctttgtcctctccccccaattgtcccaacttttcaaaaattgaggtgctaatgaaaaagttgggcaaacggtgaaagaaaattttggtagagaaatcattaaaaaaacgaaaagtttattttattttaaacactgaatttttgtccgaaacactgaactttttgtccgtctttgaccaaattccga

SEQ ID NO: 32587 - DNA, 1184 bp, Heterodera glycines
  misc_feature (1156)..(1156): n is a, c, g, or t
ttcagttccaactttgtccagttcagtaccagtcggataactcatttgcgttggaactgagcggggggtgaccagcgaacttattatagagctcaataagctcgattttccaaatttaaaaaattctaaaattttcaaaatttctcgagctaggcccctaagaggttttggggtttttgaattttatgattttttgccgatttttccggggaaaacggagaccactttcaagcaaccgtttttcgagctctatcgattggtgggatttttggaaaaatttcgatttttttccggaaatagaaaaattttttggcctgagcgggacatttcagtcccaggcccataactcgtcaggggtcggttttagcaaaaaattgctttagagcaaaattgtagagctttttaagctctatcgaatggtatattacatgttcgaaaattttcaaaatttttcgagctaggccccctagaaattttcggaaattttttttggggcgagaaagtgggtgaaaaaattttttctggggtattttgaggtgctgagcatgaatatgatgtttgcttctcgtttcagattttttggaatttttaaaaattttttgaaaatcggtcactttttttgccctcgggattttgggttaaagtttgaaaattcataactcagtttagatcaggtctatattagtgtttagaggctcaaaaaatgtagaaaaaatcggagaattttatgcattttatttggtatttctatcaagaatataaaaaaagttattccagaaattctggaaattttcgaattttcagaaaaaaattcactactcggttctgaaaagatattttgtaaaataaaaatagcccaaaaatccgcaattttttgctctatttgataaattttatttcatgtttttatcattttttagtaaaaagttataaaaataaaagtgattttggaattcgggaccaaaggggggtgcacatggttttcgagtggggaaattttttcgcccaaaaacttccagaaatatgtctttagaggttatttagcacgctgatcacgaatctgaaatcagatttcgtttagctcttcgggaaagcctcagaatccctgcgtatagtgatgaatcctatgatggacaccatccccataccgttgcantaaagagggatggccaccatccccatac

SEQ ID NO: 32588 - DNA, 1620 bp, Heterodera glycines
  misc_feature (47)..(47): n is a, c, g, or t
  misc_feature (64)..(64): n is a, c, g, or t
  misc_feature (80)..(80): n is a, c, g, or t
  misc_feature (107)..(107): n is a, c, g, or t
aaagggattcagatctgttcggccataattattttatgagccatgancagatcagaaagcttcngcacgttcaagtgtgnacagtgcagggtattctaatctttgtnggtatggaatgggtggaaggctgcatttaaaaagaactcttttggtgaaatatttttgacatttttcaattttttaaatatttttgaagagatggattccaaacttcaggagcatattccaataacggtctaacataagttttgtacaaaataatccaaatcctagaagactttgacttaataatccgaaataaagaacgcattcgtaaatatgcattctttattatttgtgtgacatgattggaaaattgcagtttattatcaatagttatgcccaaatccctaattgtaatttttagctatcatcactaggaatcactattttggagctttgccagtaaataaaattattttgggagttgaccactaaaatagttttttgccattattttggcgtaacgcccactatttttgcatttttggaaaatttcccaaaaaatgtaataaaaacgaaaaatacaccccaagaatcgacctaaaaatttcaaaaatacacccctaagaattggaaaattttctcaaaaattcttccccaacttatttttcttgctaaatattcgctaagaaaatatttgaataagttaattattttggtattttttgccactaaaaatcccatccctagagatcagtttcttcggataaaaaaaacctgaaaattccaaaaaacccaagaaaaagtaataaaaaatgctaattgctagggattcttttttatgtaaatacatattttttcctggattctccatagcctaattagtagagcccgtaattttgaaatggccgggaccgggaccgggacttggaaaatggacccgtacggggcccccgggaccgggactcccgtttttccgggacccccggtcccggtcccaatttaggcccggggccccgccgggaccaggactttttcaaaatttttgaaattttgataaaaattcgaaaaaaaattttacaattttttatatcaagcctgtaaattgaccttttttgcttttaaacagcacttttttgcggcgtgtttttctaaaaaatttagggtacaaaagggggggggtccggctgtgccgataggcaccgacggggaaattttgaaaatttgtgtcggatttgttaactgagttacaccaaaaaaaatgacaaagttttgcgatttcaactcaatttttaagaaaataaggatttttatgggccggcgtaagaatttttatagatttttacattcatattaagtaattttccccaaaaatgctatgttcgatctaattttgaatattttaggtggattttatgatctttttaacagtttaaatcgtagaaaatcccaaattccatcttcaaaattttaaataaaagacatttcgccaaaaataattattaaatttttcaaatttggggcagtttcactggtgaaatgtagtcccgtttttccgacccaaatggccgggaacgggaccgggacttggaaaatggacccgtacgggaccccagtgaccgggactcccgttttttc

SEQ ID NO: 32589 - DNA, 1159 bp, Heterodera glycines
  misc_feature (1144)..(1145): n is a, c, g, or t
taatttaattttgggctacggcaaatagacaaaattattcttatttcatgtttctaatatttttcttaataccaagttttgctggcttgataccaagaatgtaggcactgaacaaataaaaaaactgatggccatgcctaagaaactgagaatggcattgattggagcataaaactggaatagagccaaaaaaaaaaattttttttttgaatgggtttggtcattttttgcctactaattttggtacaaaacgaagattggggattttcttagtcagatgtgattatgatttttgagtcaatcagtgatgtatcgggagtctcgatgccagggttttttcaaaactgtcaagatcaggaatatacatatcgaatgaatctctctagtcacaataaaaaaaaaatcgttatttagacaagtccatttccaatttttttttttttaaattcttgattcatttctgacccctttccattctttacatatttaaacaaatgctcagaagaagtgcagttttatgtctgaagagcggcacatatcttgctaaaggaaaacgagttcaaaaaggccaaatcaacaaaataaaggtcttttctgaactttttggaggtgccttgaccgctaaattttcgccagcaattcttttctttacaaaaaaaaaaaatttacaaggcccaatttttaaaattttttttttggccgattttgaaaaataaatatggttctattatacttcactttatgagtttaattgacatttatatcctatattttggtatcatttgaaagcattgacaaatcataaaattcggatggactcataatagaattataaattgcaggatccctacgccagcgctgacgaggagacgtgtgcagaattttttgccggaccaaccattgaagacagaaagagcaaattccaagcatatgtggccaaagttgaatcaaaagaccaggtgctgctgttggctgctcctttttgtgaaaaaaaaattgtattttctacaggtggatttccttttgaccaaaatcaaaggtgtaggaaaaattgcaagagccacacacaacccatacgcttgggcgttttctgatcactccagcatcgaaaaatgagcagcagaaatgccggtgatcagcaacnnaacgggtgatctcg

SEQ ID NO: 32590 - DNA, 1001 bp, Heterodera glycines
ttcaggccccaatgtgcgcctgaatcgctaattagcttggcactttcgaatattacatataaattagccctctcaaattttccttcgggcctcagaaaatggctatctctttttcggcccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaatttagtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaatttagtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaatttccttcggg

SEQ ID NO: 32591 - DNA, 1570 bp, Heterodera glycines
atgtgtgccggacagcactggggcaaaaacctccaaaaatggcattgccggaattggtactcaaacggttgtcaagcttgaggaaaaaggatggaaacaaaattatgccggctagtccaagttcgaaggatggcaaaagtttagtgggaagcgcagaattgccaaaaatagcactgctacgatcattaagcaaacagcgttcaaacagtgttcgaagggagagtgaaaagtcgccatttgatagcccaaaaccccaaaaaacaaaattggcacgatctttgagcaggacaatgttaagccttatacggtagtccgcatacgtatatggtagatttttacctgacacaccgcttttatgttcaattggcaccacattcattcagctttaagagataaagtaaaatttagttctaagaactagatacaaaaatttttgacaatgttacactggctaattttataataggttttcttaagtttacaaaaacattattgaaaattagccgcaaagaaaaagttgttttaaaatttctaaattttcaaaaaaaaaaaaaaaaaatttctctcggctcataagatggtgttaatttgtaaaagaaaattttttttagttttgaatgaggtgcagaaattactggcgacctaaaattttagctttttactgttgctttatatatttgtgtttgaatttaaggtcttaaggcaattttatagtttaatgggaagaattttcttaataaaaaatttagatgtatatatgttagttttggaaaaattattagaaatttttgatttttgttcgagttagattctggagttcggaatttatgcccaatgcttcatcaattaaaaagaatacaattgaaaatattttttcataaaaaacaaattttaaattgtcccacctaaactgtaaaagtgcgattttgctttaaaagtttattttgtttatggatttattattttttttattttaattgagttccgttattactgttaaacttttttatatttgatttttagattttttactgttcatttatatacgtttaagatgtttatgacggattttatgttgttttcacatttatatttggttaaaaaaattacaaaatcttaaaatgtttttgaaatatttaattcttaaaacatttttatttaattttcattttgcttcttttgcccaatcgcttcttcaacttctgccaatgttttgttcttcgtttcaggcatatattttaagccaaaaataatgaacaggcacaggaatattgtgaaaatgaagaaagtatattcgcggaaaatattctaaaaaaaataatttgttaaaataaatttaagaactaccacttgtttaatttaaataaatagttaaatttgagttcattgtataaatttgaaacttttttttaataaccaatttaattaagacgatattaaaaataaaaattttactgaaaaaaacatattcaagaatgaaaattttattgaatttaactaaaatttgaattattttatatataagttataacaatgttcattttaaattgttaaaaaatataaaaataat

SEQ ID NO: 32592 - DNA, 1210 bp, Heterodera glycines
aaagaatcgcacattagtcagatatgcgctggatgcgctccaccgtctcccgtctttaatcgtcatgtccatctccccgagtccctcctgtctgtacccgttcatatcttctgtaaccccgatccagtgctgcctgccgctttccaaaaaggcttggtggagcggatgctcgcacttcccttgggtcacaaagagcggtccgtcgtgtcccctgtaagggtcgtcgggaccgatggcgagttcatgcgcttgagcctttttgaataaggaagacagttcctgaaggtatttaaaggctcggaccaatactgggatgactttgttcacttgtgtgcccagcccttcgccccctctctctcccatcggtcgtaatctttcggatgcccacggatgtaaaccattgcattcagcgaacttgaaccaccccaaactcgtcctctcggccagtaaagcactcgtccgttcatgttctcctgaggcatcgtgaaatacatcctggaatgtggaatcaacaaactccaagctcaaagtgcagcgactcccaaccaattgtatttatcgttgcataaattatacatcagtgccgctggcatatgaatctgagtgtattttgtttatttgtcagtgctaacctctcacaaatcagaattcaccttccaattccaccaattatcttggggaccggcctcgacgagcaaaacgcgattgtccggattctcagtaagacgattggcctaattgttaggtaaactattctttctatttgttggtaccttcccaccaaaacacagcctgctgagcctgcgcccacaacgatgtgcgtcggtttaacgccctcggggagatggcgaacaaactttccatacttgaaaaatccttctctccaacttcggttgtgatacaaattagacgtataatacctcaaagaggaaaccaaaattgaattttgaataaaaggcgaagcaccacaaataagcaaacgcattacttaaatgaatgtttaaaaaaatcttattcaaacaaagggaaataataactgacagtgtcaaacacttaagaggaaaacttcagaacaaaagcattttatcgcgcagaaatatacatatgcatatgtgactcctattaaaaaccgaatctcacgatatatctaatctaatcatttcttcacacgatgaccagtcggataggaagtgggagcaccatgaaccga

SEQ ID NO: 32593 - DNA, 146 bp, Heterodera glycines
ttttttttttttttttttttttttttaaacaaaaaaaaaaaaaaaaaaaaaaaaaaaaaaaaaaaaaaaggggggggggggggggggggggggggggggggggggggggggggttaaagaaaaaaaaaaaaaaaaaaaaaaaaaaa

SEQ ID NO: 32594 - DNA, 1801 bp, Heterodera glycines
  misc_feature (1792)..(1792): n is a, c, g, or t
cccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaattttttggataaaaattatttaaatgaactgagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattaacaaaaaatatgagtgatcgaattttcactaaaaaagttaagcctacattttttggcatatttaaaaagcaactaaaaaatttttaaaatttaataattttcctgcaccgaaggtactcactcggcctcttctcggtctctggggggggccctccgcccctcccccccccctcctcaagcgctactgattgatgatttataccaacacctcatttgcttattattaacaagcctccctcattagttaatgatcattaattattttctacccgacgtctcccaaagtctctccccgcctcggcagctcacaattcaaatttatatttgccctttcttgtgtctctattccctcaccggcggggtattaatgctaataacaatttggataacactcactcattaggccgtccaaattgcgtttgtttcttctaatcacagacacttaattatgtaatcactagagagagattactttgtgacgcctttttaacattttctcaccatgttgcgctgctgttctattttggcctaataaaagttgaatttttttttccgtcaagactctcgagacccacaaatttcttggcactattgtagcaggccaaacaacagcgcttgcaatgttagctttttgttttccttttcggtcttctgccattgtttttgtttttcataccatcgcctttcccatttgaccaccgccattcatttttagtaatttaataattattattatatttacatattttgcttcacttattctatttttatattatattatttttgccattttcgttcgattttgtccatgcgttaattaatcctttctcggagaaaggaacagagataaataaatgaatttgataaatatgtaaatacaattaatttattttctgtgttcgccccctcccccaaaaattttattgttttatttttccattgccacccaaaagaggcaaaaaaagaattttgttttaaacattccccacagattccgttggatgaaatgggcaaaaaaggcaaaaagaaaagataaaagctgataagggaaaggaattacaattacctaatgaaaataatttaataataatacgataacaattcatcatattttattagtgctgtattattattttattatcgcccatcanaaattatga

SEQ ID NO: 32595 - DNA, 886 bp, Heterodera glycines
  misc_feature (872)..(872): n is a, c, g, or t
agtcgggattgccgcggaacgagaccaaagttcgggattcgagtagggagggccaaaaatagatgggtcgggatcagggacgagaaaaaggaaccgggattctggcggtaatgcttttacagtttaggcttgttaaaattgggtcgggaatgagccaaggacgtagggatcaatgcctgaagggctaaagcggggtcgataatcagtagaaacggggacaaaaaaaacgggtaaccaccagcttatcggggaaaatccagacagacgggaatgggctgggtttgtgaaaatgattgtaaaagagggagaagctaggccaagctgcaataaaccagtcacagattattcaaacggtggattagacggggattataaaaaaaacggggacacatgccaagcggggggttggaaaagagcaacgcgacaatgattgattgatatgcaacactgatgttgatcggacaaaggagagagtgagttgggagctgttcctagtgaattctgatcaagagcgcgatcactgatcaatcgatggaatcactgactgattgatggatcaagggacggaaaaccagattcggaaacgaacctggtttaaactgagatgagaaagtccagtttatacaataatcttttgtgtttctaacccgagcctcccgagctaaatttggtcatggatttttcaaaattcatgcaaaatttaaaatttacaaaaatagtaaacaaatgttaaggcattttacaacaacaaaggttggctgctgctggagaaaaattgatgaaaatgatacacacacataaataatttgagcaccagagcaattgacttgtgcgggctgaggttggagggaggaggaggaggaggagacacnccgggggggggggg

SEQ ID NO: 32596 - DNA, 1912 bp, Heterodera glycines
  misc_feature (34)..(34): n is a, c, g, or t
  misc_feature (645)..(645): n is a, c, g, or t
  misc_feature (1006)..(1006): n is a, c, g, or t
  misc_feature (1666)..(1666): n is a, c, g, or t
aattttcaaataaaaactaaataattataatttnttttaacaaataattttttctcaaaaaattaactgaatttcgctagaaaattaaagagtttttcgctaaaaaaaattagataatttttttttgttgttaatttttgaaaattttttccatatttttataaaaaaattttcattttttactagtcaaaaactcattaagtttttttgaaaattcgagattttatttgaaactctaaaaagtttttttgtttttgtctacgagttgcctattattagctttgctttttgtatgagttgtcatgacatcgggccaaacgatattttcgtataatgtgttgttcattttccatctcctttcttggcaacgcattgacgtattaatgttaactgtttggggtttgtacctatttgttatccatgccgaagttactaatttgctaatatttattttatttttatgggaatttaaaatttttgagaaaattctttcaaaaaaatattaaaaaattaaagattttttattaattatacagaaaatttaaaacttgttattaaataatacagcttttacctcgttcgatgacattataataaatgtatggtaaattattttaaataatttatatatatttttgattgttntaaatgaagaattcacaaaagaaaagctgactttatgaaatcgccagagaataagccgccattattattaattttttctgtgcattgtgaataacctaattcaccaataattaagttaattgacacctttgcttttatcaaataaaaaaaatacagcatgtaaacaaaaagtgcaagaatattatttagcttccaatcaaatgcaagcccgtagccagaacaaaatttcggaggcggaaatccgaagaccttgttgttttttttgctcgccgggccaaaaaaattttgggactaaaatttcaaaaaataagatataataaggatggggggggggtggggggatctggcggttaaaaatccngattcctgtttttatcagtgatccaccaatcaatcacatattctatatttttgaacaaaaatccgtgtgtttttaaaatttgtaaaatttcacataaacattttcttcgaaagaaatgcaaatttaaaaaaaaatctacgttatcgcgaatttttaacttttacagaatgatagcccttctactaagaaggtatttagttgtctgtgctgagccgaacctaaaaaaatctcaataatttaaaaacttaggaaaaattcataaaacttgtaaccaagaattttttaatgtcgagaatcgactgtaacttttttagaccctacttttttttattaaaaattatggagtataatataaaaatagagaaatcttatgctattgaattagataaaaagttatggagataaattaatgtgtcattttttatggaaatacaaaaatttaatgacgtttaaatacatgaaaattgtgaccggaaaatgcgtcagtggaaaatgtgttagtatagagtagtataaaaattttatcagaacttcgttctggattccgaactccggacctcaattttaagccgtttttaaaccaaaaatgctaaattcgaaaatctggtctttcgactttttgttcgagttcgggccggccggggttcggtattagcctanatggatgccggattcgtgatcagcgaccaaactcgaaaacccaagaaacttgtttttatggcattaaatcattgtcattgacgcattttctactgacggtattttcctggaagcccatgaaaattgttcaaaattcacaatatccgatccgatttccaactgatcaatcaatgatcgatcaccaatcattgttgcccagcataaaacggacacgggaaacaatgtaactgatacaccaatcaatga

SEQ ID NO: 32597 - DNA, 1354 bp, Heterodera glycines
  misc_feature (75)..(75): n is a, c, g, or t
  misc_feature (80)..(80): n is a, c, g, or t
  misc_feature (94)..(94): n is a, c, g, or t
  misc_feature (151)..(153): n is a, c, g, or t
  misc_feature (169)..(169): n is a, c, g, or t
agcttattccagaaaatctggcatgattctcattttaaaatttttatagattttaaatgtttgattttttttgcnttacnaaactttcatcganactgctcttttctattctcattcaaatcgccccaaattttttttacagctaattagnnncctattaagctatttnccagaaaatctcgcatgaattctcatttttaaattttttatagatttttaaatgtttggatatttttttggcttaccaaaacttcatcgaacctggctctttctattctcattcaaatcgccccaaattttttttacagcttaactaggccctattaagcttatttccagaaaatctcgcatgaatctcatttttaaattttttatagatttttaaatgtttggatttttttttggcttaccaaaacttcatcgaacctggctctttctattctcattcaaatcgccccaaattttttttacagcttaactaggccatattaagcttatttccagaaaatctcgcatgaattctcatttttaaattttttataaaaaatgtttggatttttttttggcttaccaaaacttcatcgaacctggctctttctattctcattcaaatcgccccaattttttttacagcttaactaggccctattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactaggccatattaagcttctttccagaaaatctcgcatgaattctcatttttaaattttttataaaaaatgtttggatttttttttggcttaccaaaacttcatcgaacctggctctttctattctcattcaaatcgccccaaatttttttacagcttaactaggccctattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactaggccatattaagcttatttccagaaaatctcgcatgaattcacatttttaaattttttataaaaaatgtttggattttttttggcttaccaaaacttcatcgaacctggctctttctattctcattcaaatcgccccaaattttttttacagcttaactaggccatattaagcttatttccagaaaatctcgcatgaattctcatttttaaattttttata

SEQ ID NO: 32598 - DNA, 195 bp, Heterodera glycines
aaatagccttgtattcttaaaccccagaacatatgcgaggtgttttgacaaatctatatgggtgacggcagaggaaagatagacaataaatttttgatcaatactgtcgtagttaaattgaacatcctcattgggtaatctctctcttttttgcgagcctttttcagcttctgaaacttgtgtatattgaatatc

SEQ ID NO: 32599 - DNA, 1158 bp, Heterodera glycines
  misc_feature (1070)..(1070): n is a, c, g, or t
tttattgcggtatttcaccaattgttaatcaccaattgttaaattactgtcactaattagtcctaattaatatgataatatggccatttactcccacccgtcccccccccccttggaatgccttttttgttctgccgccccgcgcacggcgtttgttcgttcgtttggtttaacgcattttttgacagttgcagctgttgttaaaaattcagcagaaaatgcatcaatgagaaaagcgttcgctgaaagtggagagaagaaaagaaaaagagcaaagtgaaatataataaaggattgccttttgaatagagaaaagaagagagagaagtgagagagaacagaaagagagagagagagtgagacagtgaacgagagatggagaaaaagaagagagacggaagagagagagacagagaagaagaaagaagagcggtacgaaagaacagaaataacacacaagcataacgcagagaaaaagagcgagcgaaaagaaccaaaggaagcaaaattagcaaagagagaaggaaggattgagaaaataacattaaaggaagagaaaaaagggaggggaggtgaaagacgcagtgtgtaattaaaaaaggacagaaaagccgggagaaagagagaaagaataattagagagtgtgttgtaacaaataagtgataaaatagtggtggatagagagcgcagaattgggccaaatgtgaggccaaagtttggagttgggcaatggcagacagacatacagacagaagcaaggctaaaagaagcacaaaaggggctcccggggtcagttgagtccgacacagctaaatttactttgtcacaactccacaaaaaagcaaccaaattgcgcataattacgattatttaaaagcgcaaagtattctctataagcattgcaaaattttcaaaatatttcatcaatttaaaaaaagttatggcctaaagaccagaaaaagccaattatttgagatctttggccataacttttttagtaaaacgaaaattttgacattttagaagccattcgggcttatctaaatttatttcttttggttgccacatntaggtaaagtgagacaggcctttccgatcacaaaatatctccgctcccccagtttttaattaaataaataattcaaaaatattttttt

SEQ ID NO: 32600 - DNA, 857 bp, Heterodera glycines
aagcgcttttgtggaggtataaaatttctcaaaaaaaggagatagccattttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctacgtctcatacgcaagcgcttttgtgaggtataaaatttctcaaaaaaagagatagccattttttctgggatagagtataaatttaaaaaattccctcaaaaataaaa

SEQ ID NO: 32601 - DNA, 1015 bp, Heterodera glycines
tttttaaaaaattccaaaaattccgaaacaaaaaacaaaggtcatattcgtgctcagcacctcaaaataccccagaaaaatatttttcacccccattttcgtccgaaaaaaaatttccgaaaatttctagggggcctggctcgaaaatttttgaaattttctcgacctatcctacaccattcgatagagcttcaaaagctctacaattttgctctaaggcaatctttcgctaaaaccaacccccgacgagttatgggcccgggactcaaatgtcccgctcaggccaaaaaatttttctatttccggaaaaaaatcgaaaattttctaaaaatgtcaccaatcgatagagctcgaaaaacggttgcttgaaagtggtctccgtttttctggaaaaattcgttaaaaaatcataaaattcaaaaaccaaaaaatcgttttttaggcctagctcgaaaatttttgaaaattttcgaaatttttaaacatggttcgatagccctttgaaagctctacaaaaagtccgctggcgactacccgctccgagcaaaccctggcgcggcattcagctggtactgaagtgtccaaaatgagtaggcctcgatctgccatttttccaggccaggcctttggtctgatcaaaaaacttttgctggcaaagttgtaggccatagttggggcatttcgcttttggggtccactaagcgctgaaggcaaaagcaaaaaatttcgtaacagtgagactgtcggcaaagtcggtttttgagccgctggtactcagttgggcctcggaccaaaaaacctatagttttcccagatgcgccgtctcgagctacccccctgtgcaaaatttcagccccgcgcgcttagccgttcttctcaaattagtttttgagatgagttgccttatcattctaacgtatatataactagccggtgtgtgcttacatgtttatgggtgcttaaagcgcttcgcgctttgggagcttcgctacctagattagctctggttgtggag

SEQ ID NO: 32602 - DNA, 1371 bp, Heterodera glycines
ggcactacaacaaattcgtcaatttgtcaaaaatacattgcctgaacccaaaaattttcaacaaattgaaggcctggacagtgacaaattcacacaattttatcggcgccgcgacgacatctcaatcgtcaaagactgcctgatgttcggcgaccggacaatcatcccaaaatcggtgcagaagcaaattttaaaaatgcttcatcagggccatccgggagtcaaacggatgaaatctttggcccgaatgcatgtctattggccactgatggacgctgaaatcgaggcgttcgtccaaaaatgcacttcatgcgcagctatcgccaaaaatccgatcaaaacgacactgcagtcatggccaaaatctgatggcccatggaagcgcattcacatcgattacgccggaccatttcatggaaaaatgtatttgattgtcgtcggctcattttcaaaatatccggagatatttgaaatgaattctacaaatgcatcggccacaatctccaaaatgcgctcattgatcactcactacggcatcccggaaacaattgtttccgacaacggcactcaattcaaagtcaccaattccaaaatttcgtcaaatcgaatggaattgaacacatttttactgcgccgtacatgccacaatcaaatggccaagccgagcggatggtcgacaccttctagaggacatttgcgaaaataaaaggggagggagttgacggcaatgtgctcgacacttttctactcacctatcgcaccacgccatcagaactcttgacggaaaatgcccggccgaattatttcttggccgaaagcctcgaattggcctcgaccttctccggcctccgccgtcaattccaatcataaaggacggtaaaatggaggaccaattcaacaggaaacacggcgccaaattccgatcatttgacattggacaattggtcttcacacgccggcacaatacagcggattggcgacccggcaaaatcatcgacaaaaagggtgtaatttacaccgtcgaattgccgaacagttctcgcggtcgatttcatgcaaatcagatccgcacacgtcaaattccggacgaggacatcgaagatccgattgacgtgatcaatggcacttttggccttcctattccattaagggaaaataatttggaagaaatcccgccagccaatgatccaccgccagcccgccgatatccgacacgaaatcgccggcccgttgatcgccttcaaatcgacccaagccgatcgtcctatgtgtgactgatcatggcactgatcagttggacttaaaaggggaggtgttagagaggcaaacattcaaatgtttgtaattttctcttcttgggaactttgacct

SEQ ID NO: 32603 - DNA, 1080 bp, Heterodera glycines
ggctcgaaattgtatggattaacatattttttctgcgcatatgctatgaagaacggggctcaaaaatagcatttttacgttaaattttttttgatttggtgaaggtttttagtccatataaatccatattttgggggttttcgggaataaatccatattttatattttaaaaatgtttgattatcgtttttgcataataaactttgggacaaattgtagaggcgatggggtttttttttgttcattggctttacaatgtgctttttttcttttttggattgcatatttattcaaaattgtgcctaataatccccattttatatattttaaaacattaaatataaaatgtatcattttattactgtgattggcatattactaaatatttttggccttaacttttttgaaaaaaaaacaaatttttgaaattttgcagatgataccaagaatgattaatttcaatgcgtagaaaaaattagtgcattaaagtcgtcaaatattttatgataatttattagacacaattttttaaattaaaaatctatacaaatattgataatataaacagaaaaagattatttaattatatattttttaatataattaattatttttcaatttcaaaataaagttaacattgtttacttaaccacggttaaagacgagtataccggttaaggtcattcgttaaccacggttaagttaaccatggttaacgcgttaaccttgatttactaaaccgccgcgagacgagcataaataaggccccagctttcttcggtcaaattaagagcgtgtctatgctcagcagatttctcttctttcctcggccagattgagataaacatgttggatttctcagcaaaagactgcaaactcagccacgtatttgttttgaccgtgattgcttttccatgtccacgtcattttcattggcgctgcttcacatcattcgaataattaattttggataaaatcatttataatttttaccaaaatgcttctttttcttgcttttccacttctttttagttgggcttgcattgctatgctttcaatggggcgaaattggcaagcgga

SEQ ID NO: 32604 - DNA, 1044 bp, Heterodera glycines
taaaaaattttgggttattgaattattttttgaagggagtcaacccccctttttagtggtttgctgtgccgaggaccggcaggccaaagggttggctttaaatttgcaagaaatttagattgccaataagtggttgtaaaaacttttggggtatggaattattttttgaagtgagttaaacaccctattagtgctttgctgtgccgagaaccggcaggcaatggatggctttcaatctgcaagaaattagattggcaatatgtggttgtaaaaaacttttgggtatggaattattttttgaagtgagtcaagcaccctattagtgctttgctgtgccgagaaccggcaggcaatggatggctttaaatctgcaagaaattaaattggcaataagtggttgtaaaaaacttgtgtaaggaattattttttgaagtgaatcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctttcaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctttaaatctgcaagaaattaaattggcaataagtggttgtaaaaaacttttgggtaaggaattattttttgaagtgagtcaaacaccctattagtgctttgctgtgccgagaaccggcaggcaatggatggctttcaatctgcaagaaattagattg

SEQ ID NO: 32605 - DNA, 1368 bp, Heterodera glycines
  misc_feature (82)..(82): n is a, c, g, or t
  misc_feature (118)..(118): n is a, c, g, or t
tttgaattataccaaaaaatgttgggtttattgattttgaagatggcccctcctaaacaatccccctccatttaatttttgnaggaatttattttgaattttttaacaaaaaaaaatntaaaaaatttcttccaggcaaaggcatccttccctcttttaaaaaagtgttttttttggctgtaaaacaccataagccaacattttggaatcgtccctgtacccccccccgccccactctttggacaacttgaacgctttgcaattagttaaaaaaaacaaaaacgcaccgttgccctcatgtaacggaccacccggttgatttgtgccgggcacacgtccggcagctgaaggaaaaatgagcgccacacggcggcggccaacacgcggtcatctccgaaaaatccctgcaattttagtcatttaacgcaaaccatcactaattgattgggtgcattataccgcccccatccccgttaaaaaatttaaaaaaaaagtaaaaattttcaatatacttttttaatttttcgagagggagagaattcttcaattaattagggtaattacaactgattaggggtgagtaatttaattgatgattgattgagttgttaccaccacacctcgtcatagtcgtgcaacgtgctgatgtaaatggcgtgcaatgccatgccctccttgcgcttgttcaccgacatgcccatttctttctgaaaatgtgggcgaattgtggtggggttaattaaaaaacacaagggaaattttttttcattttttcgcagattcggggaggctttataaaatttggaaaaaatttacatgaaaaaagtggcaccatggcaaaaaaaaaactgaaaaattctgccataaagtctcaatttttgaagtccccgtatcgttccctcctccccccatttagagaacatttagacctatcgaatgatactaaggttgttgaatttagttgcccaagaaaaaagttatggcacttaaaaactgaaggcgccaaatttagctgaaaaaaaattttttttaatttttttaccgctgctttgtccaagcgagtgtaccagtccgtgttgaacacctccaacacttggtgcatgaagtaaatgtaggccattgcctccagcgactgttggacacggcacaatgccatcctaaggcaacaaatttaattaaatttggtaaaagtttttaaaaagtggttgcacatatcagggagctgtgccgagacgcctaaaaaaaatttcggcaatctgaaattggcattccgagggaaccaaaaaattgtggaaatcggtgaccgacgatgccgtcggaaaaatttggagagtgttggctgatttgttaattgattttgcgttaaaa

SEQ ID NO: 32606 - DNA, 461 bp, Heterodera glycines
gccttatttaacttttaattaacatttggtgcgtttcatagcagtttctgaaaaaaatttatgaattaattttgcaaaaataaataaataatgaactctcttccttaataattttcctgcaccgaaggtactcactctgccgcttcgcggcctcgtggtgggccttcccccccccccccgtggtgaacatataatactcttttaattgacccgaaacacgaatcccgaaacccgacctttttctcgtccgcgaaacccgaatcccgacccgatgttttttcggccgacccgacccgaatcccgacccgatatttttctcgtcccggaaccaacctggcatggaataaacgattataactaattaataatataattattttaatctattaattagatttgttgaccatatttaataagtgcgattgatgattttatcttcccataccaattacatttttatg

SEQ ID NO: 32607 - DNA, 1985 bp, Heterodera glycines
  misc_feature (20)..(20): n is a, c, g, or t
  misc_feature (87)..(87): n is a, c, g, or t
  misc_feature (152)..(152): n is a, c, g, or t
  misc_feature (186)..(186): n is a, c, g, or t
  misc_feature (272)..(272): n is a, c, g, or t
  misc_feature (1937)..(1937): n is a, c, g, or t
cgtactaaaccgaccccganccggggatttcgcttcaaaaaaaaattatgacgaaattaatattttaaattgaaaaaaatcatattntgaaattttcattagtatctgcatgaaaaaagctcgcactagtcagggcttcccttttttggtgnatttgattatgtgacccataatgataaatttctnttatttctttgagccacttcaaaatcatcgtcttattataaataatcgtaattaaaatttcctaaaatagtatcgggattccttcnagcatatcttcaaaaaatgatcacaaattttggttcctgttcctctgttaaacacaaagttggacctacaacgaagcgtaaaaatgtgcaagtggtcgtcagaacacgtcctctcagtgaaatggaacggaacgagcggtgtaaaaatattgtttcatgtgattccgtctccaaagtcgtttcattgaaaacaaacacatgcgacaaatacagcactggtcagcgccaatttggagtgttcgataaggtcttgataaactcgaattgaatatttatcattaacttataaaaaggcagcttttaggtttatggccacgaatcaactcagatccaagtctatggtgatgtggttgctccattgatgaaagaagttttgaatggctacaactgtacagtgtttgcgtgagttatttaaataatgttacttttagagggcactttttaccaaaaaaaaattctcagatatggccagaccggaagtggcaaaacctatacaatggaaggccgccacgacgaaagtggagctttttcttgggattcggacccgacctctggcattattccgagagcactgcatcaaatattcacagagctcagcaacgaagtctgtctaatggagaaaagagtgtaatatttgcgttgcaattatttcttttttttgcaggacatcgatttcaccgtccgtgtctcttatgttgagctttacaacgagcagatttacgacctgttgagtctcagtgaaacttctcagtgtgaatcgctgcgtatttttgatgacaaaaataaagttttttttccaaattttggcggcaatttattttcccttagggggtttctattgttggcgctgaagaagtcattgtgcgcacacgcgacgaggtgtacgacttgctaagacgcggtgcagacaaaaggcgtactgctgccactctgatgaacatttcttcaaggttttgcttattttgttgcccattcacaacgatcattcgtaatgccttttagtcgctctcattcggtttttaccgtttcggtgatggtccgcgaatcggggctggtcaatggcgaagaaatgttgcgtcaaggaaaactcaacttggtcgatttggcgggctcagagaatattggacgctcgggggcaactgataaaagggcacgcgaagcgggtgagtttttgtcttcgaagtatttttatgctaacttcagtcgcttgatttgtgttgcttcaggcaacatcaacacgagtttgttggcacttggcagagtgattaatgcactcaccacaaatgcgccgcatattccttaccgcgaaagcaaattgactcgaattttgcaggattcactcggcggcaaaacgatcaccacaattattgcgacgctttctccggcatcgtcaaactttgaagtggaaataaatcggaggcaagcaattaattggcttaagctcatttcaggagtctgtcaacactcttgaatatgctcaacgtgcgaagaacatcaaaaacaacccggaagtgaatcagaaaatcacgcggcgtggacttctcaaagaatacaatgaggaaatcgaaagacttcgtcgggatttgttggctgctcgagaaaaacacggaatttttttggacaaggaaaattatgagtagtttaactttgtttatttggttgttntgagtcatgtttagccacatggtcggagaaatcgatgagaaatcagcg

SEQ ID NO: 32608 - DNA, 1008 bp, Heterodera glycines
tgttatcaatagcaatgctatggccggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaaccgacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgatgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagtttatataccttagaacaacagtgcaactcattgctaaaacaaaaatctcgggaacggctaatcggggggacctgaaatgttgacattgcttaagcaactttttgaggcgcatccaggaaaactataggcattttggtccgatggccaactgagcgccgacggcgctgaaacggctttttgggggaaaatgccatgcattttttgggcgcttttcgtttcagtctcactgttacgaaatttttttcttttgctttgatcaaaa

SEQ ID NO: 32609 - DNA, 1843 bp, Heterodera glycines
  misc_feature (884)..(884): n is a, c, g, or t
  misc_feature (1382)..(1382): n is a, c, g, or t
  misc_feature (1693)..(1693): n is a, c, g, or t
atgctcttgagggctctatgaggagtaaaagaaactcttaattattcatagaattctctatgacatttaaagacaggcgcaaaaggcacctttgaagcgtgcttgtccttctgcttgcacataatttggcacatttcttttgccaacactcacaataatttccctaaaataattagttaaatatattttatttttatttaaaaaatagaatttaggttttcgtttttgatttagaaatccttttttctcacatattccccgccccggcctttgccgcatcgatggtaaaagtgcacgagcgaccgaccttaaattgggtaatttaaatccaaatacgaaacaattaatgactaattgcctttgctggttggtcaagtgtcaatttgacacattcggcatcaaaagctttcactgtaaaaggcgaaccgggcacagattgaccatcaaattgtacagaaatctaaacaaaaaagagaaatttttgtgaaaaagaatttaaggaaaaaacaaacaaattaaaaattaattttataaattgagaatttaacgaaaaaatgaatcaaaaattatttttggcatagcaaacaaagacgaagagactaggttatttcacagaaaaaagttctcccaattattggtgtttgagtgtgtttgatggcaccagcggtgccaaaaattccgtcggaggatttgaattattggcgttttaattatttaaatatattgaaaatcatgtattaaataaagtgtaaacatttcattcattttacctgatgattgcccactgtttgcggtgtataacgcacaacggaacgcgacggctcttcttcataggccgcaacgtcgacgggcaacagatcaccacgagggtcctaaaagtgatncaatttggtgagagcaagtgataaattaccagccaattgtcttgaattaatttaaatatttttacattaccgtaatttgcactttcggtaactgttcaatcactggtgctgaagcagtgtcgtctccctcatcggacggaagaacatcgacgataaattccgtgagttggccgacgggagcttaaaacatttaaattagttttaaaatttatatgaaagctaactccgttccaagcctggccctgaagcgatcactgaaaagctttggggggcatgccgaatttgttgaggctgttgttgttgctgcggcagcagtttttgttgcaacactttttctggcaccaaaagatggcaagtgaacggtgaaccggggacaggctaaaatttataaaattagagaagttgtgagcaatttgaatatctattcttttgtggaaaaatctgtgaaaaaaaatctcacaaaattttcaaaaaaatttttccaggatttcgaccggnctggaacccccccccccccatccctttcaaacacttttttgaaaatatctccgtaacagggttgttccgggtcgagaaaaatatcgggtttcgggtcgataaaaaggccgggtttcgggtatcgggtttcgggtcaattgacaaatttttaatttgtttaaaaatcaaatggcactgcaatatttgcagcgaattgcgccatttataggacgatggaaataaaaccaaatggaatcaggtttttcagccatttgctttgcttaaattcaagaaattcatacaaaatatctttagaaaaaggataataatgnaatagggatgtcaaaaatatgtacaaaaattggtcaaaatatgtacataaatatgtaaaaaaaatccccaaatatgtaagaaatatgtataaaaacccaaaatatgtacgaaaatatgtaaataaaatttttttttaatgggtatttttt

SEQ ID NO: 32610 - DNA, 946 bp, Heterodera glycines
  misc_feature (13)..(13): n is a, c, g, or t
gtaagtttgagcncaattttggacatagtcgcaaatgtttgttcatgaccaaaatgcgctgccggcaaaaagaaaaaaaaaattatgaaaaaattggaactttttccgccgacctttgcacttcgtttgccttcgcattggtgaacgccaatccccgctttggcatctctcaaagttcactcactttgtgcaattcgttcgcctaaattgggatgcatttttttcaattttaatttacatccaagcgtggggggaaagagttctattatttttttacaattcaaaaacaactctttttgttagcaaattccaatttgttgcccaatttgaaaatgatccttaagagaaatttggattttttttttgagtaatttaatttaaaaaaaatttccacacaatttagcatgcgttaaacccaaaaaaattccaaaattttttctgccagtgtgtccggggatgtgttgaaattgggcattttgccatggctctcaaaagttactgcttattaaaatatttttcttatttgaaagcgtcttccatgggctagcacaaaatcaacaaattccaccgcaaaaacgacattcaaaactttagtgattttcagaaaatatggcatttacgaaagggggacaattggacgacagacaagtataaaaggaaaaatacccaaaaaatcgcccattgtcgcccatttgtcccacgccaaaaaagtgccatttatgcccgtccgacccgataatttatggaaaaaagcaattttttcaaaattgttacctccgtcagcctcgcagagcgcaaattctccgtcgagaattttgacatttgcggaagtgcgggaaacggaataaaaagaattgaaattgaaataaaatagctgtgaataaaataaaaagtatatacaaaaattaataattttatggcaaaaaattcagaaaacattaaaaaa

SEQ ID NO: 32611 - DNA, 997 bp, Heterodera glycines
  misc_feature (97)..(97): n is a, c, g, or t
tgcaagggcatcaaaaagacaaggaaaaagcacagctatgatgctacgccagtaattctgaattaaaattttttattaattttaaagcgtcactatnttatttttttagcaaaattaattcataaatattttttcagaaactgctctgaaacgcaccaaatcttatatacaagttatttaggcactcagatgctttctctatcaaaaagggagatgaataaaaaatctaaaaatttttaattgctttttaaatatgcgaaaaattttaggcttacttttttttaataaactgatcagaagcgcaccacatttcgtgagggcatcaaaaagacaaggaaaagcacagatatgatgctaactccagtaattctgaatttaaaattttttattaatttttaaagcgtcactattttatttttttagcaaaattaattcataaatattttttcagaaagtgctctgaaacgcaccaaactttatttacaagttattttaggcactcagatgctttcactatcaaaaaaggagatgaataaaaatttaaaaaatttttaattgctttttaaatatgcgaaaaattttaggcttaacttttttttataaactgatcagaagcgcaccagattttgcaagggcatcaaaaagacaaggaaaagcacagctatgatgctaacgccagtaattctgaatttaaaattttttattaatttttaaagcgtcactattttatttttttagcaaaattaattcataaatattttttcagaaactgctctgaaacgcaccaaatcttatatacaagttatttaggcactcagatgctttctctatcaaaaagggagatgaataaaaaatctaaaaatttttaattgctttttaaatatgcgaaaaattttaggcttaacttttttttataaactgatcagaagcgcaccagattttgcaagggcatcaaaaagacaaggaaaagcacagctatgatgctaacgccagtaat

SEQ ID NO: 32612 - DNA, 1954 bp, Heterodera glycines
ccagaattttgatgttggatggcatattgtgccaatgtttcttgatgttccaaccttgccttttgccgccgacttttggctaagcttaaagttttgattcaatatgttgctttaaaattttctgttttcactgatcgtcccagtggtggcccagcaacagcctttggttgggcaatgccatctccgtttgtttgtccgttttaatgccaacaaaaagcaaggacaaaatggagaaggccaacaggaaaacagtcattttagaaaagttgaaaaacatttttaatagataaatattttaaattacggattaattttaattaaaaggatgcgtttccttgcccccctttgcctatttatacatttttggcaccaaagaatgcactttcgcatatttttttggccacgaaaatgactgattgaataaatgcgtgtgtggccacagataatgacttcgataaatgatgttgttatgaatggaaaatttattagtctacgcttttcaattttgaaaatcggcgcaattgtaaatattttgctcaataaattatgaattcggaccgaaattatttttaatgaaatttgatcaattagcataattcgcggttaagcgtaatggaatagaaagttggtggtaaagtaaaagaaaaaaagagatggttgaataacggtcggtggttgcttgttgccccagaagaccgtcttctcagttggtgtttcggtgaaataatcagtttttttataaaacccgtcggcggagggtcggcgaggaaccctaatttcttttattattattttaattttatgctaatgggagaatggcgaagaatattttctgtatcaaattattataattttttgttaataagatttagaaatttattttttttattaattaaaaatatatcacttatttggatttttcgataatacgatcgttttggtttgttttacaccacgaagcgctgcttggtaaattttagcatttagtttcttttttatagaagttgaaacaaaataattaatttttaatgttttaaggttgcgtttaaatattatcccctgttttaagacgttttgggggtatcccgcgataaatctaatagaaaatcaacagaacccaatatgattaaaataaatcttttggcattagttttttttctcagtgtaattataaattttttatttcattgtctgctggtgtgtttcctggagatggcttttgggtggcaattttgttcaatgtttctgggccaattatcgtcgtcccgcagagctttcaggttcctccccccccccccccccccgcaaagcatcattaagccgatttatgcaatcgctaatttttgaatgtgcttttattacatgggatcaattgttatttattattagttccatcattgttataattctttgcaattttacaatgattaataaacaaatttttgtttattttggtcaaatgttcccatcataatctgtccacagcaatggcgccaacatttttgggtttgcttacgtcccaacaatttacaaaaaaaaaaaccaaaaattattatttatttacatattatgttaaatagttagattttatattaattttgttgctaatcaaataaagtaatttggatcaatctcaacaaaatgcatttgaaggatttttattagttttattttttttctgccgaattgtttctgaacataatatagaaaatacctacttttgtttttacaccaattaattttttaaattcataaaaaaaaattaaaaatcaaaggactattcaaatttattcccaatcaaatcctaattttcataaatattattattaggggtggcaattttatgtaaatacatattttttcctggattctccatgctctaaatagtaggaaaaacactttcttttttttttgtgtttgcgaacaaaagttgtggcttttatttacatatttt

SEQ ID NO: 32613 - DNA, 1374 bp, Heterodera glycines
ctcctccgccacctcctccgcatccaccgccgccacctcctccgcttggcccaccgcaactgactccaagcgtaatgctgcctccgcctcctccgcatccaccccctccgccaccgcatccgccgcctccaccgcatcctcctccacagccgcattgacggctcacgcggttggcgctgggagcaaggctaaagcgaaacgcgtaagtttacgcctgcaattgcgcaacgcgtgccgcgccaactcactccgaaccgccgctcatcagcagagagtgggccattccgacgcccaaaagggtaagcacgaacacactacacctcgtcattgttgaagtctgaaccgaatggggggggaggtgaagcggctgaacggatggttaagcggtgcttccgctgagtctgtcacctgcgctcttgctgctgttcctttgatgagtgaatgttcactgatcgatgtgtgctttgctccgtttggccctcccttttatagtgcccccctccttggccaatctctgccgttcaattgcgacacaatcggatgcttcttccatgaaaccgatttgatttgtcccgctaataaacgggttttgtcgtcccacgcgccctcataaaaagggccgcgcgtctctggcggtgatttgtgtgaccttttccctcccattttcccgtttttcgcttcacctcccactttcacttgggcaaatttatttccttcaccgattttaacgctttcatatttgcatctattctatattttgtgtaaatgatgagttttgtttttgttcaaattctttctttacttttcaaattattttaatcatttttcgattgaataattttataaattgtaacaaattttagctaaagttgggcgataataggagatttttgccggttagggaacttaaataaaaaaattctaaggaaaagcggaaaaaacctaatcagaattatgtaatggattgtaattttactttataatttcgtcgctctttacttttctttttccattagcttctggccaacggtatcaaatcagcagctgattcgaatctgccttgggccagattcggactcattttgtccgattgatagggccgacgatgccaatgggtgcaaattgggattttgatgatttggttaaaagattgtaatcaaaatgacaactttgtggggttttcagaatatttttaaaaatttagtgaaaatatttttaaataagggtaaatgaagtcctaatttatctttaaacaattaataattagacaaaaaaatgaaaatttttaatagaccaaaatcatatcggtgattatttataaatttctaatgttttactgtgtttttctcacaattcttccattttcaattccac

SEQ ID NO: 32614 - DNA, 1204 bp, Heterodera glycines
gctgtcaaaaatatgcacaaaaaatggccaaagtatgggcataaatatgcaaaaaaaatcgtgaaatatgcacaaaaatcgcaatatgcaccaaatataaacaaaaaaacttgaaaataaggtttaaaataatttaaaaattttattcctcataaattttatcgattgtttttgtaatttcaaatcaaaaatttttcaagtttttcggcagtgaagttcactcttgactcactcgcccattcattcagatttggatttaatttttggcataatcaaaatttttcttaagggatattcaaatcggaaaatatttgacgaaaaatggcaaaatatgcaaaaaatctgaaaatatgaacaaaaaatggcaaaatatgcatgaaaaaatgtacatgacttatgcgaaaattttttgtttggtcgattcttaagggtgtattttttaataccaaaatttccttgatagagatcggacttttcaagttttctgccttcttctccaatcctaatatcaatgtcttctttcactactacccatttgactcttattttattcatatatttatttttttctgttatcatacatttttttacttactctagacacttttatctgaatattcgtcagagaagtggttttcgcccttctgatgacttaggaagcctcaaaccctgctagaaatgcgtttttcatgcttattttcatgcccaaagttagcaaaaaattcagcaaatgctgcagtaaaacccgggctctattgattactcagattgaaaaaatcaatttattttttctaaaaatcgctaacagattcttcatgaatttatcgcataactcacaggagcatgtggacatggaaaatttgtgcattcgctatatctactgggtttattttattattgaagcccttttcggcgcggacagaattgattttggtcggggtgacacctgaaaaaaacatattaaaaataaaaatcaaattattattattattattatttttgcttttcacccaaagtaattgtggcagaggaactccaaaagttccaatttcggatcaaggccaaattatgataatatttaagctcttgtttcagttgcttcgcgagtcccatgagcgggttcaatcttttggtgtcctcgtcccgccatttccttaacagaaaatatttcaagtagaattttgagaaacaaaacaaaattttg

SEQ ID NO: 32615 - DNA, 1021 bp, Heterodera glycines
gagaggcagggggagagagagaggaagggcgagagagagaggaagggcgagagagagagggagagagagcgagagagagagggggggtgggagagagaggcagggcgagagagagagggagagagagcgtgagagagagggggggtgtgaatagagaggcaggtggatagtatagtggtgggtcgattgtgtgaggaatggcttgagtatagatgtagagtctttttttgttcgagggcggctgcgcatgagaaaattgcgacgtcagtattatctagttccatgttccttacggacatttgcggacaatttcgggaaaagaataaaaaattcataaaaaaaaattattttttttctaaaaaaacgaatggaaactgcaagactaaacaaaaatttgtttttgttttttgggctttggaaggcctcaatatctcatttttatatttctaaaattaatttcgcaggtcaaagtgaggttctagtttcttaaatgatgagttttattggtctccaaataactattttttggattttatgaaaatttacttcccaaagagtatttgtcaacaacattttttaaatttctcgagctataccgacaagtcttgtctggggatttgctatcagctcctcaacttttctatcccagagaatcggggaagaaacctagataaatcttgctctagggttcagcgaggatagcattccgaggccccaaaaattttcggaatggaaattcgagaccaaaaatcccgggaatcggatgccaaaatcggaattcgtgaagctggtgttcagcacttaaattatcttgttattttgaaattataaaataaattttgttcgcaattaagcatgtcgcaaactctttccttatatctgaaattagaggagacgtattatggggccaaattttccctctctgttttaaaaaaaaattttaatgtttttttaagaaaatttttattttttcccattttgtatgcaaatgtccgtccgcaatgccccactgcgttccctg

SEQ ID NO: 32616 - DNA, 1628 bp, Heterodera glycines
cgcaagaggttcggcctcaagtggcggcggcgagggcgagacagagcgacggcgacgcgaccgcgagcgaacacgactcagctgcggctcaaccgccgtctgaggtggcgattgcgcaagaggttcggcaccaagtggcggcggcgagggcgagacagagcgacgcgaccgcgagcgggcacgactcagctgcggctcaaccaccgtcgtaagtaccggttgcgcaagaagttcggccccgcgtggcggcggcgatggcgagacacggcgatgcgaccgcgagcggctgcgacgtcgacgcggagagcgggaacggtctcgggacgtgcgacgcggagagcggtcacgtgacgagcgacgagtacgggacggtgtgcggcgacgtctaaaagagcggcgagttgaattatgtcaattacggtaagcaaaaattatacattagggattttaaatggttttatgggattggaatttaactgtgattcagcattttatttttgtaataaaattttgggtaggtgaaaggaggcaatcaaaataaggcgcccagtgaagctgtatgtgcgtcgccagcaatagatgaactttttgatattgttcacctaatttatttttttttaggaggggggggggaaataacaattcgtttttgacccccatttcattttaaacggggattcgttttcactgatactactagtcatacacacctgcccggagaacgtgaccgatccgtggcgcccctcttgcgcggcggcgatctgctcctgccacggtgctcccgtcgatggtgatgatccaccgccatcgactgatgttgctgctcttcacgaccacgaccaccattttctactgctgtcgtcgttgtttttgaatgctgatgatgtttactgtacgattgccgaattatggtgccgttgttatcagcgcttgtggcgccgatgttcatctgcggtgcggacgacggtggcggttgtgcaaaaatgttacggtagccaaacgtctcaatggtttcgttgtgcacttcaccggtggcgtaccgttcctgctgacgcttctgggcacgcttttgcaactcctcctcccgctccaacttgatcttgatgcgctcgtccagttccctggtgaatcacgaattatgagtgggtcaaaattaatacacattaaaacaataaaaacaaaaaactttttttgaattttttttaaatttccggagggaaacgatagaaactgatggtcatggttttttgaaatatgtgcctaaactcaaaaccaacttcaatgtgatcagacggcgttcttcgcgccgccaatgcggcggtgttgcgctgcgcgagcgaccgccccgaaacgagtcatcctcgggccggaagcggatggcaccgcggcccttcacgcgcatggggccgcgctgacgcgtcgtcgacgcggaaccaccgccgccggtggtcagactgcgccgttgcggcacagaatctttgccctcaggcgttttggacctgtgaaaagtgacgcaaaaattaagtggcgaaaaaattggtgaatcattggtcggcggtatatagttataatatcaaattgtatcatcaaaaacgtagtattttttgttgaaaattgaaattgctcat

SEQ ID NO: 32617 - DNA, 1539 bp, Heterodera glycines
gggctctaccaattacatttgtttttatttttggtttaaaactatcaatcacaaatacacaaagtaaatggcacggaattccgactttcgaaaatttttggggcctcggaatgcaatcactggtatgcattcttgggtcattcagattaacgaagtaaatccgatgcagagctgcacgtaattacggattacgggtttttggagtacgggttacagatttttgggatttttccgtaattttgacccgtaactgaaacttttggattattttcgagacgatttcttgtaagattatttttttacaaaaacaaattttctattttcattgaaaggttacccgttttgattttttttgaggattcaaagtcatttttgctagtttttaaggcgcattttagtgcatatttgtgcatttttcgggtttttagggcctatttgggggatttttaatgcatattttatgcgcatatttgacattttttagtgcatacaacttataggggaggggtgggggtcgcaggcgaagggaaaagagggaaatttctaaaaaatttcgctattttttgcaaattcgtttcataaaaaacactcgaggtgcggaaatttcaaaaacagcttttgaaccgatttaattacaagcaaaagtacccataaacgaaaaattttaaagaaaaatttttcgaacaaatttggtatcattcgtaagtcttgacgagctaagtctaaaaatctgtggatgaggtcgaaccgaccccatctaagcactggacactgagtcccagtgaaagtagacacttcagtggcgtactttttatcataaaataattttttacgataaaaaaataatttttaattttttaataaattattaaaaaaataaaataaaataaaaacattataaaaatagggacataaaatatactctaaatgcagtgtttttttggtttgagtttttttattaaaagatatagacttaaggattcaaagtcatttttgctagttttaaggcgcattttagtgcatatttgtgcatttttcgggtttttagggcatatttgggggatttttaatgcatattttatgcgcatatttggcattttttagtgcatacaacttataaccctagtcattagagattgattggagctcgttttaggcggctttttagcgagcccaattctatactacagcctatttacccagttttccctgagaaattaagttccatgaggcataggtagcttctaacattagacctgcagattccaaaattgacatcatgtacagacaccctataagcatttttattgcctttaagccggaccaaacacatgtctatccgaaaaatgactagtttcaggctttttcttcattcttgtaccattaattttcttcaactttctcaatttataagaaaaaaatcctaatttattttgaaaattttattattttttttaatttaattattttcatgagatgaaaaagtcatttaaaatttggtaaaaatttcttcgaataaaagggatttctcaaaaaaaa

SEQ ID NO: 32618 - DNA, 1764 bp, Heterodera glycines
  misc_feature (31)..(31): n is a, c, g, or t
ataggaaaattctaagaaaaaaaattttttntgagaaattttcagcgattttttggaaatttttttgaaaaatcttttgcaattcaccataaaaattttagaaaatttttaatttctcggggggggggggggaacgagctgctcccctccgtatctcccaacgaaaattaaaattttttttttttaatattttaagtttttcaaaaaatgtaataaaggaaaacaaaaaacatttttatgaagaattaattgctgatttgagaaaaatgttcaaacaaatcacaaaattttttatatgtttttttcttgaattttttttttttgaaaaaattatatatttgtgcccttttaattttttggaagggttttaaaacaaaaccagaaatatacaaaaaattgaaaaatccttgaaaattgatcaatgcacaaatcaaataaatgcccattttgcacaccaatgaatgagtttggcaccggaattttaagccatttccgatcccgaatgtcgagccccgagcgcgggtgtgccatccgtcgcaaaatgacgctcgcctccatggcggcatgcaacggcacgggcacggacggtgcggtggcatggcacggagacggcagaggcggcggattgtttttggcattgtggagagacgaagggaggacggtgggctcggcagcagcagcagctaaacattggcaattataaaaaaatttccaaaaaaatttattataaaattttaaatgaaaattttttatttttaaaaattttgaagacattttagggaaattttttttaaaacgcttgactttttctagcgattttttcaaattttatgtttttttcaatttttaaagaatcgcagaaaatcttttcaattttttaaatatttaaatgcaagtttgagtgtgtgtttttttaatttcaggggatggggggaggggggtgaaatgttgtgcagccctagtaataaatttaagaatttctttaaaaatgaatggtcaccatttttgttgccattgttgttgttgttgacttctgtcggcaccatttttgggtcgttcaccatcaataatgccttttgctgctctttcgatcttgcctcaaagtggaatttatatatgggtacaccccaaaacgtcgccgccgaaacgtcgcaacaaaaaaaaaattactagtattttttcaaaattataagaaaattaaaaattattttagtttttttttgaaaatctaagttaataaaaactaaatttgatgaaaaaaaaacttgaaaaaaattttttttccttaaatttcttaataaatttttttgaattcttcaaaattttcccgaagcgggataggcaactactatttttgataattaaaataaaaagattagtgtgacgtgatgtcccagcgctttgactgaccggctccgatacacttctctatgtatgtctccatgtatacgtatatatatacattaggaacacacatatcaaaagcataacatcatttgcgaaacgaacaaaaaggtcaaccttagttagcggacacgatttggcaatcacttaattgtcaacccatccgctaactaatggccaaacattcgaatcagtttaggtctcgaccggcaccatttcgcggtgtacctgcgccgctgtaagttgtagctccttttgcggtgtgagccggagcacgcgagcgcggaattccgagccgcggaatggcgatggagcgacgcgcgcatttgcgacggagaatggcaccgatatggactgata

SEQ ID NO: 32619 - DNA, 1723 bp, Heterodera glycines
  misc_feature (843)..(843): n is a, c, g, or t
  misc_feature (860)..(860): n is a, c, g, or t
aaaaacagagaataattgtataaaaaaaggtttcaacacctaattaaagccaataaaaaattaaattttcgaaaatgagaaatattgtccagaaagaaaattacattattttacttttgtaattgtttattctatcctacaatttttaatttatactaattcctctttttattagttaaataaacaaaatttaatttgaatgatttttttatgagaaatttaaaaaaaattactttttttggctgataaatagggcccggattcttagttttttaactattttttctgcgttttattttgatgagaaatgcacgaaaaacacatttttaattcggaaattcttcgttttaacgccactattcatcactcggaatcactattttggagcttcgccactaaaagaactattttggaagttggccactaaaataattttttgccactattttggcattttgtcattatttttgccactattttggcattttttaaaaaatttcccaaaaaatgcaataaaaacgaaaaatacaccccaagaatcgacctaaaaaattcaaaaaatacacccctaagaatctacctaaaaatttcaaaaatacacccctaagaattggaaaattttcacaaaaattcttccccaaattttttttttcttgttcaatatttgctaagaaaatattttgtaactgcaatcagtgcaaaagttgtttgccttattttaaattattttcaaattaaaaaatagcctatttaaaaaattacacccctaaatttggaactttttcgccactattttttccactattttggcattttttgtaactatttagttaaattatttgnggattttttatcactanaaatccgggcgctactgataaaaaacaataatttttcagaccttaaggacgacatttgtcgatacaaattgatcatttgataggaatttttcggcaattatccctgctcggccaaagatgtaaacgataagcgcaacactatgactgatcagaatgcttttcaggttgacatgtaaaattttggttggataaatcactgccaaattcaaaaaggcaatggccaacacaatgccataggtgaaaagttcaaaaaaggaaaatatataagcaaaaacgtcgactatgacggatgggaatgccatttgaacaaaatctgttaaaaaattttcacaatttattaatttgtttgaattatacctacatatttgaatgaaaaaataaatttaaaacggttaaaaaaaccaattaaaatttttgatggcactattagagagagggatggatgacagggttgttgcgagagcatacataatcaaataccaaattcgataaaagcatttaaaacgctaccaaattaaaatacaagaaccagaatgcgagaacgagaagtccaaaaaaatagcaagtaaggataagcgagacttgcaacatccctggtgggtggcatattttttaatcatctaacatttgcgttggcataaatagagggatgggtggaattattttttattgcaattaaaattttgatggcactaataaaggagtggttgatttactttttttaatgcaataaaaattttctgtggcactattaaaggagtggtggtattttttaattaagtttttcgttggcactaatagatgggtgggtggtacttttatggtgtaatgaaaattttcagtgacattattaaaggggtggg

SEQ ID NO: 32620 - DNA, 1186 bp, Heterodera glycines
  misc_feature (19)..(19): n is a, c, g, or t
  misc_feature (40)..(42): n is a, c, g, or t
  misc_feature (51)..(51): n is a, c, g, or t
  misc_feature (59)..(59): n is a, c, g, or t
aagggggaggacatgattntgagtgggaaaatttcaccannnatcttccanaatttttntagaagttattaagccgctgatcagtgatcacgaaaatataatcagaaggatcttaagattcgttaagacctaagaatccatccgtatcagttgattctgaagggatggcgctggtcaggttcggattctttcgatataattttttgtgcattttgggtcttgtaaactttattgtgaatttttaaccattttcgtctgcttcaaaagttgcagggccttaaaaatcagaaattttttttggcgccgaaacgaccctggcgccgaaacagcggcgccgaaacgaccctggcgccgaaacggcgtcgccgaaacggcggcgccgaaacgacccgttcccggaactgacccctactgttctggacaactcagctcattttaatttttcaaaaatttttaaaataatatttaaatttaaacgacagaaattaatatttttaataaactttaatataaaatatttttaataaattttaaaactaataaaaaaaaagatttatgataaaaatactgataatgaaagataaatgtaagatttttaaaaatagtaatttattcacggctaaaatttaaaaaaatatttttatttttaatttaattttcatttttatgattattttgtaaattgtcgtaagctgagttgtcccccccccagcagctgaatggtcccgacgcggggataaactatatgaacgccccgtgaaaaaatgggtcaaataatataccaatcgattcgtctcgaggagctaagcatggaaaaatatgtctcgagttgcggaaatgccaaaaaaccggtttttgaaccggttcaaaacttgaaaaattgagtgaaaaggggggcggctcctgactctaaaatgatcaaatttggacaaatttggtaccattcgaaagctcttgatgagctaagtctaaaaaacaaggtataaactcgaaccaatgccatctaagcactgggacaactgagccccagagaaaatggacacttcagtaccaagtaccaaaataaataaccatttaaaagcaaaaatttcgcaaaagtgagcatgcgaagacggagcaagtactggggcgagaaggagggcggagtaagaagtctgacgagcgccacaggcggttgactgcgggg

SEQ ID NO: 32621 - DNA, 990 bp, Heterodera glycines
gcacgggcgccacgcatgcccattcgccaagccctcgggttccaactgctcacgggtgccacgcatgcctattcgccaagtcctcgggttccaatgctgcacgggcgccacgcatgcgcattccaactgctcacgggtgccacgcatgcccattcgccaagccctcgggttccaatgctgcacgggtgccacgcatgcccattcaactgagcacgggtgccacgcatgcccattcgccaagccctcgggttccaatgctgcacgggtgccacgcatgcccattcaactgagcacgggtgccacgcgcatgtgccggtagctgctgctgcacgaacatccagacacgcatctttcggtagctgctactgcccagtcaacctggactgtgcacccgttactggctacaactcgaccggctagggtaagcaagtgcacgctccccacgcatgccctcagagcggctagttatctatatataaaaaaatggggggggctctctgcaaatgtggtcgggaaattgcgaattctgcacctatcgacccaattctttttgcgttagccaactgatctcccgctacacatttgtgaccaacacatttaaagtgccatcactttgcgctgagatatgctaacctgttttcgctaagtgttgcgcagcgcccggcggcgcacagatagcggctgggcgccgcttggcgaaatgcgtgccatgccgtggggagcatttaaaaaaaaaatttggcccgatccgaccacttggcgccgagattgctgtctttttgtggaccagctttgcgctatagacagcaatcttttgggccatcaatgctggggagtcagaatttttttccccgcacgtctgctgacctgtaaggcttggaaaaaaaattgccgtctctcgccgggcgcaatgcgccgagatatgctaccctgtttttgctcgctctcctcaaggggcgcctagcgcctcgcgctgcagagtagctgtct

SEQ ID NO: 32622 - DNA, 1177 bp, Heterodera glycines
  misc_feature (1119)..(1119): n is a, c, g, or t
aacaaattataaatattaagaacacaacataaattctcaaaaattgacaaaggtcgctttaaaagttaaagtcaggaaaagacgaggaataataaaataattattatataaaataacatgttaagatcatttcgtaaagattctttaaagattgaacatttttgaaaagaacagaaattatcattctgaaattgaatagctaaaaagggaagaaatgattaattgaattattgtcttctaaattgttaaaaatacccttaaacttaaaatttatataatcttaaaaaaatttatttcttccaaaagcattagcacttaaacaattaaatataaagaagaaaaaataagatataaatgcaattaattcatttaaaaaaatcaaagggaataattaattttagattttagtatcagtgtatcattaaaagcattttaaagatcggaatataagataaaaataattattaaaaaagtgacagcaacattcaaaattacaaaatttaaataattaaaatattttctagttttgagaaacaaggaaaaaattaccaatgggcagtaaaaataataattatatatccttaatcataacttatttcattaaaaaatattaaaaaaaaatcaaattaacttaaaaaaatttttttttgtattagaaaacagaacaaagcatgacaattgattggcatatgaaagaacatcgctgcaaaaagcatgaatctattaaaaacatttaattaattaatagatagacttttaagaattctccaaatgaaaatatgtaattcctataaaagatttataactaaaagaataaatttattgccttttgatgaaaaaaatatccaaatttacaaaaatataatatagaaaggagtcttggaacatttattgcagtttacacgactataaaaaagactttcgagtaaacgagataatttaaatgataatggttaaactcattaaatttggcttttacaatatataaaatataagaaaataaaaaaatgaataaaaaatattgaaaaaacctcttcagccttaataaaacattctgacaatgaattgtgaaaacattgaaatgaataaaattaatttatacaaaggaagaaatctaanataatttaattttaatcattttataatttaagcattttgacataattttgctttatgg

SEQ ID NO: 32623 - DNA, 1389 bp, Heterodera glycines
ataaagatagagacctaaataataataatttttattgttatatgctcaagttaaaatataagatatatgaaattccttatttatcacgatagaatttaactaattattttaaattattatcaattataactctactaacatgagcctgcgtagtttttcagacttcagttgaagaattataaattcacaaatattttcttaaattcgcgagtgttttaaattatttgcttttaaactaatgaaataacttttttactttggaaaattccattagttgtcctctaatagataaataaatgtttatttaaagaaacccaataattatttgaatttaggttttttattttcaatttttaaataactatcagtatgcaaaaaatattttattgatactttttgaattggagtatttataaatctttttttatataaattatattaggttttcatttttgcctaatttatttaaatctgaatatatagatttttattgatctccacctcattattgttttattatttgcttatatgaattgtatacaaaaaaactttttgccttatctttattgatttgtcttatgctctagacttatttatctagtaatctataatcagttcaattttagaaatgattgtttttcaaattttagttttaaagttttatttgtttatttaatttatcgactatatttttttgcatttttgaataagcaatttgtgccaaacttcgaagaactgaagcgagcggttggccaattgcacggttcagatcgacgtgcgtgtcttgctataaatttagttatacgcaaattttttaaaattcactcttctgtaataacaccctattatattgtattcttttaaattataaaataattttcactgcgtttgtgcattttttaatttttttcattcttgatattactatcgcattgttacgcttttccaactcatttaggtttgacgcttcaaatgttttttgaatatacatttttaaattttttgatgcattgaatccatttacttaaactagaagtatgtttttttaatatcacaaatcaaaattatattaatataaccttttcgatgttttcgtatattgctttggatttagttttatatttttatgcttaaaatttttcttaattttatcgataaatttgtaaataattcattgccacattttctagttaaaagcatatacgaagtttaataaatttattcaagtaatttattagtttaatttaatttcagaaaattctggagtcaatgatttgtcgacaatgtatgtgatatgaattaaccaatattgttgcataattgtgattagccgcatatggatccaaagattatattcagcgcgagttcatctgaagcctaaatatgact

SEQ ID NO: 32624 - DNA, 1235 bp, Heterodera glycines
acgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaattaagttgtaaataaaatctggtgcgcatcgagcactttctgaaaaaaataccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacggagaattaaagtacaggctatagggaagctattcccgaaggattcggtctccccataaatctgggcgcatcggttcggggggactgccccgaaaacaaaaaaatcgattttttccagtgtccgtttggggtactcaaacaattatggggagcaaaaatccaaccgaaaattaaagtacaggctatagggaagctattcccgaaggattcgggcctccccataaatctgggcgcatcggttcgggggggactgcccccaaaac

SEQ ID NO: 32625 - DNA, 1119 bp, Heterodera glycines
agggggcaccgcatggtcttgcatttcatgaaaaatctttatgttcctaaaatagccaaaatgcattttcatggcataatttcaggtgctgaatacgtatatacacgatattttgcgtctcagcctttttggaaggtggttacagagtgttcgataaatggtcactatttgggcttcgggaaatgcagtgaaatttagaaaattcataactctcttcttttttgatcagatgtagtggaataaggtaagaaaaatatcaaacaattaggagaattttatgagatttaattggaatttatatgttgcagaaataaaaaacgttattccacaaattctggaaattttcagatttttcagaaaaaaactcagatctcggttccgtaaaggtgtttttgaaattttaaatactgaaaaaataagcaattttttgctctagttttataaattttaatttatctttttatcacttttttaaaaaaagttatagaaatagaagtgattttggccttcgggaccacaggggtgtgaccatgatttttgagtggaaaatttttttcaccaaaaatctttcaaaaatatgtctttagaggttatttgcgccgctgatcacgaatatgtgatcagattttacttttgacatcgttaagacctcagaatccctgtgtgattggggattctgaggggtggggcggcatgttcggacccaggccgtgattattattttttaatttattaaaaaacgggcgcgaagcgcccgtcctgaggccgcgaagcggccgaatgtcccccaaaaaattaaaaaacgggcgcgaagcgcccgtcctgaggccgcgaagcggccgaatgtcccccaaaaaattaaaaaacgggcgcgaagcgcccgtcctgaggccgcgaagcggccgaacgttccccacaaaattaaaaacgggcgcgaagcgcccgtcatgaggccgcgaagcggtcaaatgtctctcgcaaaattaaaaaggggcgcgaagcgcccgtcctgaggccgcgaagcgaccgaatgtcacccaaaaaattaaaaaactggcgcgaagagcccgtcctgaggccgcgaagcgaccgaatggtcccccaaaaattaaaaaacgg

SEQ ID NO: 32626 - DNA, 866 bp, Heterodera glycines
atagcatgggaatctttggacgcattaaggaagaaaagtgggaaattgtaaaaattggcacaaaaaatttgggaaatattgaccctagcagggaggaagcagcactttcccccagaaaatgtttttaataagaaatatcgagaaaaaaattctgaaaaatttatctagcattttttcaaaattttatggtaaattgtttaattttttcaaaaattttcgggggggggggacagcgggggttgggggaaagagcacccagccaaggcttcaaattttttttgccagaattagggtggcagattttacgaatttttcgcttctttaggttcaacaacttttccaagacggttccatttcattgcacacgcgaagtctcaagtacggaaagcttggccaaggcgtacttgttaaggtgagccgcagcattagcaaagagaacacttttattattggccggaaatttttcaaaatttgcacagaataagatcatattttattggtcgaaaaatttttgaggtaatattttcaggagggtaaaaattttcaaaaatctacccatttttatccattttttatgttttcgttccttgatccgttgactaataaatttgttttttcaaatccctttttatgtgtgctttaggtactgccccatcttgtccgacatcgcaagtcccatttccacaatttgccatgcggtgcctccgtcattcttggccgaaatgggtcggtccgatttgctgtttttgtattgattttccatttaattgggactttcggtccatgggatttttggtgaaaaaattgggccaaaacttgggcgggacctaagcaaaggcgaaaattctaacccccccccccctctt

SEQ ID NO: 32627 - DNA, 1274 bp, Heterodera glycines
aatcagagtcagtttgataaatgatcgaaactgaaatcatttaatcaaaaatattcgtttgatttcccctgtagcaatcaatcaccattgagaaatttaaaaatttcaatcatatctgatcgcccctaatgcttcatcccattgtcagtttcagcggattcggactcgggaaggccgagaacagaattggaaagtgaaccaattgttggacaagatgaggaggaagaaggggaggaagaaaatcatctttttgttgaggatgacgagaaagaagaggaggattatccggaagaaccggaagaactgcgagcattgagaagagaagcggaagaggaagaagaagaacgagagcaagagagagaagaggaagaagcgagagcggaagagggaggagaaagtagtcaaaagaaggaggaaggaaaagatgaagaggaagagagaaaaagaggaaaaggagaggaggagcaaaacggtgaagcaacggaagaagagaaaggcgaccaaaacgaaatggaaggccgaactgaactcgatgaagctgctgctgatcaggacgggacaaacatggaaattgatgccaaaaaagaagccttagttgaacatgaacaacatggcaaagaaaagaaaactgaacgggtcgcagatgaacatggcaaacttgggcatgaaaaatcggcacaccagcagcaacagcagaaacccttcatgttgggcgtgtattcggacgaattggaacagattctttacggcgaggcagctgtcaaaattcagagtgcatggcgagggtatgccgttttggattttcggcatgactaatgactagggcatccaattatgcatatttttttcctggactgtgggaggcctgaaacgcacgaaaaacatgtttttagcttggtttgaagcttctaggatgactttccatatgcatatttgtgcatatttcgcgatttatgtgcatatttggacagtttttcaacaaaacctctattaaaacggtcccctctattaaagccgccattttggcctctaatgaccgaaaaattttcaaaaatgtcattttttgggtattttctaataaaaaagtaactttttaaaaaattgaaatttatgccaaaaaatagtcaaaaaatagaaaattttccattttttctcaattttcttcaaaataaataaattttatatttattttctatttgtggttctaaattgtttattcatactacatttagctattttcgagattgtatgctgaaatttaacaaattgaagag

SEQ ID NO: 32628 - DNA, 1861 bp, Heterodera glycines
tggccatactgtgaccatgtttgcctgaacactatgggtttggcaaattttttaaattaatatttttattttatttatgtaaatatcatttaagtctgtccaatgacacaaatggttgcaaacattgtgactgtgatcttggcggctctgaagtcagtgcctttaattgaaaattaaaaaaaattattattaattaatcattaaaaatgaaaaagtttattattattattataaaaataaattccgaattttttttttattaataacttaaaaattcaccgcattttttattttatttattaaatattttgtcaatccctttttgaagagtacccattgcactgctgaagaaggcaaatgcaagtgcaaaccgaactttgaaggacgccgctgcaatataaccaccagtggttattattgcccaaccatcgacgaattcactttcgaggcaaaaaaaagcaaaacacaaaaacaaatttccaattttatttaattaaattgatatttaaatatattttagggttgcttcccgaccgaccctccgggagagaaaaaaagtcgggaaacggggagggaaattctcacaaaaatttgtcggggatggctgtaagaacttaaaaaaagatatcggagaacgacagcaacagtgttggggaataatttcataaaaagttgaaaaaaagagaaccagaaataatttatttaataaatttctaatattatgtatgattaaagctttggtaacaacctaccgtgatcttgagtcgagagtttcggtcttgactcgaaaaaagtctcgaattttcagtctcgattcccgagacttttccaaaccacaatatttggctgttttcagccaattaaataatttaaaaaaaacaaattatttttccaattttttatttgttttcatcttcttcaaaaaaaaacatttgcaggcagaatccatcctgtcaataccaaacaatgccgaaagtgtggtgcgcgaatcttcgccggatcggcctcggacatggacgggcgaaggttttgttcgagtgcgcgagaacacccacctaacatttgtggtaaaaaatgaaatttaacaacaaacaaataaaaataactgatttaaaacaaactttgcaaaatatttaagtattttttaaatttaatacaaattagcacaattcccaattaaaaggtggacggtctgacgaaaagtggccactacaatttggttgtgcgctatgagattgcgccagacggtgttttttctaattttttacttatccaaattataattcaaatccgattcatgttttcagacccaatcggatgggaggacctcaaaatcaccattgtccggcccggagaaccgagccctgacagtatttgtgccaatgccttgccatcggacgatttcatatcggctaggtgtatacaaaaaatacacattttaattttaaaaaattctttttttaagactgcctcctcggtcccgcttttacgaaattcaccctgccatttgtctggaatccgacactcgctacgaaatacggctttactttggcgagaaacggcgcaacgcaccggacattcgtgcgcatgtaaattttataacctcgactatttatccaccaacttgtccagggtcaataatttttatccaaaaattcttttggattcgtatattaattacagactgcgaagaattgttcgatatatttttcgaccattcctccacttttagacattggatagtcccaaaaagatttttggccacttcattcctctggatcggataattcggtctaaaatgttttccataaaaatttacaggaggagaggtaaccaaatgatctaatatttatatatttag

SEQ ID NO: 32629 - DNA, 1104 bp, Heterodera glycines
tgaatctgggcctgggtttcctagacaaaaaatcaaggttctggaaaaattcaggttgccgaaaaatggcttggacctgaacttgggatccaggaaaaatccatgtcgagctctagtaaatacaaaataaatggcgtttcccattgttttagatgaaacacaaggaatggaactatgaaatgcggatgggatcagagttcgcatgacgggatgtacattttctttctttctttttttgtcttgcatcattacacccaatgaattttttgcatctatttttgtcagtcaattgtaataaaatatatactggtgaagcacgtcaatttataataattgagaaacaaataaataaagacggagccgacgaaagtctgcttgacctatccccaaatgggtaatccttcggaattggtgtcccgacgggaaaaagagataaaaattttctttaaacttttgctagggtaaaaaaatgcactgatcacgaatccgagcttggattttgcaaaatcattgattttatctatgatttttcatcatgtacttgatttttttgaaaatttttgttttcggcaatttcggtattctgaatgttatagaatgcataaatagttttagaatgagccactaaatgtatatgaaagacaaaatttttgaaaacaaaaaatttctcaaaaaactacaaatcctgataaaaaatcgttgacgaaaatccagtattttgcaaaatccgcaacttcggattttgatcgcccattttttcctagcaaaagcgattttgtaagaaaatatttattttttttttgtcgggaccccaatttccgaaaggattacccagcttaaagagatgccaccttttttgccgtattgagaaacatcttgcttggttaatctttttgtgttccattttctaaagaaaacctaaccaactaaaactgtggaaaaagccatctttatctttctttcatttaaactaatataccgtgagaaaagaaaatgattgctaattgctctaattaattactaaacgcgcgagtgcctatttaaaaacgaacacgaacccttcactgagttttagttttcgacatttctatcgaattgtttcga

SEQ ID NO: 32630 - DNA, 1705 bp, Heterodera glycines
  misc_feature (1633)..(1634): n is a, c, g, or t
  misc_feature (1642)..(1642): n is a, c, g, or t
  misc_feature (1645)..(1646): n is a, c, g, or t
  misc_feature (1651)..(1652): n is a, c, g, or t
  misc_feature (1656)..(1656): n is a, c, g, or t
ggatttatatgtgctaaaaaaactttttaaaatctgtatcaaaggaaaaaaaatagatcaagccggttttggctaatgtttacatttatttgatcataaggcagttcatctgcaggaactcaataaaggacacctacctttgggctattaagttgatcatattttgttttagttttttattttctaaaaattaaataaaacgcttttatttaaatacttttttcatttgaaaaatgaattaattacataaaaattttatatttacaaaaatattttattttattacactaataaacataattataaatataagaaattgatgaacaaaacaccttgtcaattcaaatcattctacagctcacgcaacatgagtttaaaagatgaaatataaaaataataaagtatttcttatgaaaaaattaaaaattataaaataaaacaatgtttaattacaaaatttgaaaatataataaaaactttgtataataagcataatattttgttttaaaaaaatatgatctgaataatttattttttactattattaaaaaaacaaaaaattttttattaaaaaaccttacatttttataaaaatatattaaatttaattcatttttataataaataaaaatatttattaaataacaacttttaaatttttttaaaatagtaattaattaaatcaaagatggtcgagaactttatttaaaattataaaaaatataagttaaaaatgattaaacgttgaggacttagcagctatatatttatttatttaaaaatcttataaaaaacgctatttatttaaaaattaatataaatcacaaaattaattgctattgttgaaacaagcacttgatttctacccataattttcaatctattattaggttatttaattcaaaaattaaaagttacctaattaatatgtgtggaaaaaaacatcgaaatgaccggcaatttgcaggagaaattgtacaagagaaaaatgcgattatattaaaattcttttcaaaaatctattattatttattcatattaatgtgaatcccaaaatataatatttattgttaaataaaatttaagataattaaaaaaaatacaacgcattaagaaaaaatttattatttcttattaatattataaaacaattacattgatagaaaatgagatttgaagatgagcaggaaaaataaagtaattaaattaatttttttaattattgaaaaatagaaaaaatcaagtaaaagaaaaaattaaaaaaaaatatttttaattttttaaagtgagaataaatattaaaaaggcctcaaagatattttaattgcaaagattattattcttaatgagtctcatcggtaaatttgaagaaaaacaataacaaaacaaacactctttgtaatgaaataaaaatgtttatttaatttaggtgtaattttttattttttattctaccaatttaaaaacaaaaactgatttaataattctaagtaaattataaatttacagtttcttcatctattagtttcaattttcacgaacagaacttaaaaacacatcaggaatgtgaaatttcttttatataaaatacaaaaatataaattactttaaaattaattaaatcaaaagaatnnctctctgnttnnttgcnncttnaataatcaaaaagggaaacaattaaaccaaaaaaacaataatgttttca

SEQ ID NO: 32631 - DNA, 832 bp, Heterodera glycines
tgggcatttgtttggccacccggaacgtacgaattgtgccatctcctgcaacaaatcgtccgaaatcgtcaattcgctcacttcttttgcatcgaccggcagccgctccaagttgacaagaagagcatattcgacttcttcagtgctgtccacgtcgttgtccgatgtgtgggcaacaatgacttcttagtctgtccggtgctcagaaatcagtcgagacaaaacgtcggcatgtccaaaatttgcagatttaaaattttattgtaaaatcataattggacaaaattagggcccaacgctgcaatcgggaagccgtgtagatcgggatcccatttttattaccgaatatagccaagagaggcttatgatccgttaacagagtaaaattacgaccgtaaatcatcctgtgaatttttgaacagcgaagatcaaagacaacgcttctcgttcaatttgggcgtaatttcgttccgcgggggtgagcgttcggctggcgtgctcgatgacgcactccactccgtttggaaacacatggctgatcgtggctccgattccactttggctgtcatccgcagcgacaggcagaacactggcttcaccttttgcttaaaatgcagcgtggcgttcgtcttcacacaatgtccgaagccaggttgaaacaccttcgggaaggaagccttgaaactggctgttgggtggcacgctcgaaagggatgatccaatccaatcccatgatgctcggcgcttcggtgtctgccactgaaagttcaagccgcattgtgactcctctgaacagaacgtcacacttgaaacttccccaacaacttcaatt

SEQ ID NO: 32632 - DNA, 1154 bp, Heterodera glycines
tgctatttttcaactttattccactaaatttgatcaaaaacgaagagagttatgaattttcgaaatttcactggattttccagggctctaattttgacgatttttcaaaaatttgtaaccaccttccaaaaagtctgaaacgcaaaataaagcatatattcatgttcagcaccttaaattatgccataaaaatgcattttggcaaacatatgagcaaaaaatattttcatgaaatgcaaaaccatggggtcccccctatggttttgagtttcaaaatcacaattaattttataactttttttaaactcatgctataaacatgagataaagcacattagattgggcttaaaattctctacaaaaaagctcttagacgattttttgataaaatcaactcctgacgagttattgagccagaactgaaattgaggcctagcaaccaaaattttctatttccaaaaaaattttaaaaattttttctgaaaatgacaccaatcgatagagcatgaaaaacggttgcttgaaagtggtctccgttttccccggaaaaatctgtaaaaaataataaaattcaaaaacggaaaattttcgagggggcctagctcgaaaatttctgaaaatttctgaaatctaaaaacatggttggatagagctcgtcgagctctacaaaaaagcctcttacaccgacctcctcccatcaaaagcctgggagttattccaccggcgctgaaatggcccaaaaaagtatgcaatttttagtcagtttttcggaaaaactggtaggccctaggagttcggtgaagaagcaaaaaatgtggcaaacattccaacttaaaatcctatcgaggccgatttttcatttaggcctttaaaaaatttttgaatccaaaaaacagcaaaaaaaattttgaaaaagccatttcagcgccgctggcgctcagttggcctccggaacggaatgcctatagttttcctggatgcgccgtcaaaagttgcccccaaggtcaaaatctcgaacccctcccgccagcggttcccgagatttttgttttagcaatgaaactcgatgttgctttagttatatataaactagcgtgtggcgcagtagttactcggtgtaggcagtatgctttgcactagtaattgctcggtgt

SEQ ID NO: 32633 - DNA, 2353 bp, Heterodera glycines
  misc_feature (74)..(74): n is a, c, g, or t
  misc_feature (120)..(120): n is a, c, g, or t
  misc_feature (177)..(177): n is a, c, g, or t
  misc_feature (215)..(215): n is a, c, g, or t
  misc_feature (237)..(237): n is a, c, g, or t
  misc_feature (2314)..(2314): n is a, c, g, or t
cagggagaaggcacgaagaaaaattttgatgttttgccgcaaaaaatttttgggcatcatttttctatagtttntaattaataaaatggacaattaaacgcagaaaactgtcaaaacaanaatttttcactatttataggtaaactgtgccctcaggcactcactgcttggtgaatnttctattagctttaattagtgtccctcctcgaacttcntgttgcacaccaaataggatgnagagtgcatttaaatgagttcctaagtatttttttgtattagaaaatttcttttgtcctttattcgagtttttatgaaaattttctccccgacactttttaaattttcaccagccatttctaaacaaattttgtgggggaattttctctccaatctccgactccccggggagcaatcctaggatttcaccaaagaagtacagtattatgaaaaattattaaaaatgattaaaaatcaaatttagtggaaattattttactttattggatggccaaatcgtagagagtgaaaataatttatgtgaattttgacgccaaatatttaattaatataatgtttttgatgataagggaaaagtgggcgacagataataaatggtttacgaacaaacacactttatgcacgtatttatgacattttgcaagaatggagcagtgtgtcaattaggtataatgaaaacaaaattaatatttaatttaaatgtcaaaaaataaattaattattgaagcattcttaatgaaaaatgatttgaattagcgttggtcgggaccgggccgggaattcccgcccttttcagatcccattatcggttttggcaaagccaagtcccggtagggtcgtaatgaaccaggaaataagcattggtaagaatggggtcggaaatgaaaaattattggtggaaagctaaaatatcgagaacggtaaaaattacagggatggtaatgagaaaaataaaaaacatcccgcctttgtgccgttcctgtaaaatcccatccgggcaaaaaagacaggaaacggggcgggatacccaggtttttgggctatagtaaaatatttttcatttgttaggtgaaattattattgctaaaatttacaaaaatcacttttttggctgggaacgattgaaggattggggtgggggaggggggcgccaatgggcaattaataaaatccatttactaatttattggatgtaaaaaattaacaaatcctatatatatattagaaatttcttaaaaatgagtttttccaaaattaaatttcttaattcttaaaaaaaagtttttcaaaattaatttaaaatacaaatttggtgttaatcaatacaagtaaaaatattaaaaaatgggaatccggtgtgggccgatttagatgccccaattggaggctcgggccaatttttttttaatgggaccaattatttttttaatatttataaatcgcttctcaaattagaaaaccaatagatattgcataaaatgaatttctgacgatgttaaaatttatacagcattttaaagaaagagtactacctccgttgagaaaaatgtaagcaagtgaatgcgttcgagatttaggattaatagatcccggattcagtttttcagaatatgtaataaaaatattaaaactgcctttttaagaaaagttttattaaaacaaaagattaaaaaatgatatcagcttaaaaagcatacataagacctacattagaatattgaagtctgtaaacactaatttaccttacaatgaacggcttatcatttgaaaattaaataaattaactgaaaggcttaatggtcaaaagcagccaacacattcgtatttatgcaaagaaaacaacataaaaaatttccgataattttggtctaaatttccatttttactccactggtcggtgaccattttcccaattagaatggccttgccctacggtttggtgcatttttcacggcgtaaacgaataattgttacaatccaatcatcaaagtcattgttaaatgttgcgcaaaagttcaccaatcatcatttggtgcttaactggttgcattaaggcagggatgcgatcgaaaatttttcaaaatcaggacatcgggcccaaaaaatcagattttggggtcaaaaatcagaacattttgcaaaattgcttcaaatcttttatttttacaattaatttaatcaaaaatcattaaatattatatttttgcctccaattatcatctttaaaaattttggtgaggaaattaacaaatcgtaaatttcagtgcactcgggatcaaaaaatcagatttttaangaattttttgcggcgcatttttccaaaaacttttgggaa

SEQ ID NO: 32634 - DNA, 1383 bp, Heterodera glycines
  misc_feature (65)..(65): n is a, c, g, or t
  misc_feature (1168)..(1168): n is a, c, g, or t
ttttatcattggcaccactgctgaattgtgcattaatcagtgcccataattctttgagctatacnagcaatgggtgcattttaaatagatctgaccctttaattaatgcctaatatggtgaaagtttgtaaggataaaggcagattttcggaacatataagcgcccctcatcgtcttatcaagggctttcgagcagtttttcaaactcttttcattgtttgagtgtttttattattgtctagcaattcacgaaagtgagcgcttttggtttacctttagaaattcttcagtacattacaaaatgatttttaaaaaggcatttatatacacgagcattttacgggggctggaatttataaattctgagaatctcgtaaatttgctaaattttcacttttatcattggcaacactgctgaattgtgcattaatcagttgccataattctttgagctataacagcaatgggtgcattttaaatagatctgaaccttttaattaatgccgaatatggtgaaagtttgtaaggattaaaggtagattttcggaacatataagcgccccttatcgtcttatcaagggctttcgagcagtttttcaaactcttttcattgtttgagtgtttttattattgtctagcaattcacgaaagtgagcgcttttcgtttacctttagaaattcttcagtacattacaaaatgatttttaaaaaggcatttatatacacgagcattttacgggggctggaatttataaattctgagaatctcgtaaatttgctaaattttcacttttatcattggcaacactgctgaattgtgcattaatcagttgccataattctttgagctataacagcaatgggtgcattttaaatagatctgaaccttttaattaatgcctaatatggtgaaagtttgtaaggattaaaggcagattttcggaacatataagcgcccctcatcgtcttatcaagggctttcgagcagtttttcaaactcttttcattgtttgagtgtttttattattgtctagcaattcacgaaagtgagcgcttttggtttacctttagaaattcttcagtacattacaaaatgatttttaaaaaggcatttatatacacgagcattttacgggggctggaatttataaattctgagaatctcgtnaatttgctaaattttcacttttatcattggcaacactgctgaattgtgcattaatcagttgccataattctttgagctataacagcaatgggtgcattttaaatagatctgaaccttttaattatgcctatatggtgaaagtttgtaaggattaaagcagattttcggaacatatagcgcccctcatcgtcttatcaagggctttcgagcagttt

SEQ ID NO: 32635 - DNA, 1235 bp, Heterodera glycines
cgaaatctagaattttttgaaaaaaattttttttttttttttaaatattatattaatttttttgtaaaaataacaaacgagtttatgaaatgaaaaaaacagatcatttacaattgaacgcgtctaatgcaatcaattcaatttttaaaaaacccgaaaatacccctctaaatattgaggtttacaaaaacgaaaaaatacccccctaagaaccgactttttgagttggcccccccccccccccgaaacgaaggtcctggctacgcccttgcgtgtaaccctactttggtggcagtggcaaaggtgttttgatgatcactgtgtgttcagtgggcggcggtgccgcggactgctgaagttgtcgcaagcgaatgtttgtcgccgatggttcgcagcagtcgtcgttgttgttgccgttgtcctcccaccgttgcgtctgctgattttggcaccgtttttggccaattacacaattcgggtgcaagaaaaagccgtgctccgtttgcttctgctgctggtggtggctttgagtataattttcggcacttatcgaagaggaggaggagggagaagcggacggaggaaggagcacagactgagagttacccgaagagatgtgatgggacggtgaagatgacggggagaagaagggaggtggggggatgcttttgcttttcgagagatcgttgttgtgttagggaatgctgttggttatggtaaagggtgaccactgtaaagtgagggattttttacagtaacgcttgaattgttcaaaaatgacgaggaaaaaaggaagtgtaaaatttattcgcttgttaataacaataattttaaatcacaataaaccaatctcataaacaattaccgttgggttttcggtctgacaatgagtcaccccgaacttcagacgcatcacaacgctgtctaaagggatgagattgaaaatggcatggggacaccataacacacaccccccaatctataaaaattcttcaaaataaatttttatttttcattttttgcatttcttttttcaaatggacttgcaagaatatggaaaatatgcaaaaacaatgccttacttcttctcgccgtacactgccgtcaaggtccgacgacgtttgtccctcaggcaaaagctctcccgcggagaaggattaattgaagtgctaaagctgaatgacggagaacaaaaatgaacaaccaaatggatattgcacataaaacgcgactaa

SEQ ID NO: 32636 - DNA, 1080 bp, Heterodera glycines
tttcaattaatttttgccactatactgctatagtggcttggccttggcttggatttttttctgtagctcagctccctgacagtcgtttttgatttgaaggtaccattcgaaagagctcttttttctaggcctaatggctaaggtggcgtcattttttacggaagaataaccggaatacaaattaatattttcaattaatttttgtcactatactgctatagtggcttggccttggcttggaatttttttctgtagctcagcttcctgacagtcgttttttgatttgaaggtaccattcgaaagagctcttttttctaggcctaatggctaaggtggcgtcattttttacggaagaataaccggaatacaaatcaatattttcaattaatttttgtcactatactgctatagtggcttggccttggcttggaatttttttctgtagctcagctccctgacagtcgttttttgatttgaaggtaccattcgaaagagctcttttttctaggcctaatggctaaggtggcgtcattttttacggaagaataaccggaatacaaatcaatattttcaattaatttttgtcactatactgctatagtggcttggccttggcttggaatttttttctgtagctcagcttcctgacagtcgttttttgatttgaaggtaccattcgaaagagctcttttttctaggcctaatggctaaggtggcgtcattttttacggaagaataaccggaatacaaatcaatattttcaattaatttttggcactatactgctatagtggcttggccttggcttggaatttttttctgtagctcagctccctgacagtcgttttttgatttgaaggtaccattcgaaagagctcttttttctaggcctaatggctaaggtggcgtcattttttacggaagaataaccggaatacaaatcaatattttcaattaatttttgtcactatactgctatagtggcttggccttggcttggaatttttttctgtagctcagctccctgacagtcgttttttgatttgaaggtaccattcgaaagagctcttttttctaggc

SEQ ID NO: 32637 - DNA, 1321 bp, Heterodera glycines
agagagagaaagagaaaaaaagaggagagagagtcggggaatgagagagaaaaaaaaggagagaggaaaaaggagagagagagagacgggaagagagagaggagagagagagagaaagggtagagagagacgggaagagagagagaagaggagagagagaggagagagagagacgtgacaatatgaaagaagggtaatttagttttcaaatcacctgtttaaacttttgaatccaatcgtcgattcgcattaatggatcattattaaatttgcaacgcaatcgcttcggctgtccatctttggtcggagtgtgcaaccatttggacaacgcttggctagtagaagttgctgttggcccagtaaaaccaattatatagagcgaaaaatcatcagattcgattaaattaatgttttggttggagagaattatcggcgcattgaaaagtaataaattggtgagcaaagacatattagtgcgtgaatcaatcgagaaacaaaaactgatgccttttttgccaaaaatgtgtttatttgagcggagaaattcgatgacggaatgatcaatgtacctgaaaatgggataagcttttaccagtcaacaataatatttttaattagtctttaatcactcaatccgaagatcattaaaacgaattttgctgggcaaaggaaagttgggcaatggaaatggcacagttttgccatcaatccgtacagatagttttggtttcagtccatcgtccttgccaattgttaattctctccaaattgtcaattcgcttttgccatcaaaatgcgtgtccactaaaacatcgaaacgtggtgaaagaagtgccaatttgaggccgagatgaaatttttttcatacatcgctggacgttttccttagcaaaagcatcggttctggtctgttttatatcccacaattggccatcctgtttcttaggccatagcttttttcttatttggtaaatactagagcccggcaaaaaataatttacgggagcgggaatcccgtaaaactcccgctcccgtgaaatcccgtccatttttaacgggagtcccgggcggcagcgggagtaattcgaaaatttaattaaaaactcacaaaaaaatatttttatgcacaaatttgaaggacaatccttttattaaagaaaaaatatacagaaaatttagtaaacagaaaacttgaaataaaaaatcagattttgggtcgaaaatcagaaaattttttcaaattggttcaaataaattatttttataatttattcaaaacaaaaaattttaactttatattttcgacttcctttattaattg

SEQ ID NO: 32638 - DNA, 1824 bp, Heterodera glycines
  misc_feature (1156)..(1156): n is a, c, g, or t
  misc_feature (1788)..(1788): n is a, c, g, or t
atacggtaaaaacccaattcgttttttgcggattcgtttttgtaacgattcgtttttgacttagttcgtttttattatcccaattcgtttttattatcccgattcgttttttgtttaaaaacttcattttcaatgaaaatttttatgtattacacgctaccgcttaataaaacaagactcagcgctaatgaattgcagtctacatgattctgacccaattttcatgtattttaataataatgtaaaatttaagcatcttcataaaaaaattcaggctctactgcagtttgcgcgtccaatcaaaagtttacgcgtccaatcaaaaatttatgtgtccaatcatagaaattatttaattgtccgagaacacacatccacaatgatgcgatgcagtgttttcaattgtggcgcagaatgcttgtagatgtcgttcaattgaagtcatttgttggccaaattgttaataaaaaatcacaaaaaattttgatatcagaggttatcgaaaccaaaataagcacgcacaaattagtctctctattattaaattttataacaattgattgaatgcgtatatacctatcgatactttgataataagtgatcaatgacggatttaaattttattaaaaattaattagtaattttttatttctcttggtgttacgtttttaatatttaaattattttttgcaatggttggtaccttatgtcaaaaggatgttcgatttaggaaaattttgattggacgcgtaaaagtcgattggacgcgtaaacttttgattggacgcgtaaaagtcgattggacgcgcaaactgtgattggacgcgtaaaagtcgattggacgcgtaaaatgcagtagagccaaatacatcctaagaattgaaaaaaatattcacaaaaattgatccccaaaattcaattaatttaaaaaatgccttattcgacaaaactaaaacaattgaaatataagcaaaattaagttttttttttattaagtttttgcgtgatttgctacctaaaaagcgttaataaaaaaaattttgtgcctatttaatgcctaattttcgattcttttatgcctttttaggtgcctatttcgcgatttttgtgcctaaaaaaggaagccctaataataataataaataatttccccccnccccccaaaaaaataaacaaaattcagagattttcttcgaataatattttcaatattttactattctccttttattccttcttatttatctcaccaaccattttttcacatttgccattttgaaagggcgtcaaaaagtgttgtgttcccccgtcccgtctctccccccccccttttcgctgttcttctcatttttcgcctctcccccctaatttttccggtgccttttttcactccgctcactgcgggagacgacgacaacggcacatttgtacaacaatcttccgctccctttctcctcctaaaattttgttgtatgaaaattggggaggagataaagaaaagttagggattttttgttttgttttccgacagcgtttgaaaattggcatttttcactgtcgaagaaatgcctaaaagcccgcttaaatccatcatatacactaacgaatagttcactttccagcaccaatttaaaaaaatgccatacacccgaaagaattaaattaaaatttagattttctaaccaaaaaagagatactcaatggccaagaaaattattcacaaaaaaatttaaacaaattttggccaaattttcttttatgatatccgataaattaattgaattcganaatatatgaattttttattatctaattaatattaaa

SEQ ID NO: 32639 - DNA, 1230 bp, Heterodera glycines
agcaacttcttcgactgccgaggcctctcaaagttcaaaagaattaaaacttaataactagaataaatatagtctataatcatattgaaaagaaaaaataattttgctattgtaaaatgcattcggtaaaaatcttataatttttatttttataccaaatatttcatcactttcaaaaagcatagttttatctaacatattaatgacaaagttggtataatccattttaaaatattgatctccatgagggctattgattaaattttaaatatctcgttatttagtcgctgatcggattatcttagtgaccagtgatcaacaaaattcacaccaaaacgacgccttctgttcttcttccactttctcttccattttctgttcctcttccattttcttttcctattccactttctgttcctcttccactttctattccattttctgttcctcttccattttctgttccttttccactttctgttactcttctactttctcttccactttctgttcctcttccattttctgtaatttaattcatgagttttgatttttaattctttttgggttatcattcgagaaaaacttttatctagttttaactatttgtactaactaatcataattaaatgatttctttatttttttaaatttatacatcatgtttgggttttctttatacataattgatattatttattttattttataaaaattttgatcttcttttagtatcaattatttttacaagaaattaaactgatttttgaaattttgaattttcaattatttattttcaatataataaacttttataatgaaataaaaatcatcccaaaaacatacacattctaaatgtatttcatctattaattattataaataaactaaattatcaattttaattttttttaattgtataaattataagatttttaccgaatgcattttacagtagcaaaattattttttcttttcaatatgattatagactatatttaattctagttattgattatagactatatttattctagttattaagttttaattcttttgaactttgagaggcctcggcagtcgaagaagttgctccctgcattctataaattgctcaaaaacaccgtgcttcacttcagccatgtttccttttaataaaatcaagtaataaaagttttaattttttataaatttttaagcttattaacgcaattttatttatttatttgg

SEQ ID NO: 32640 - DNA, 1533 bp, Heterodera glycines
atttatttatttgcgtattttccatttttcttgataatatggcacaatcggtccccttcggggatggcattttcttatctttttgtgtattttactgtcgaattgtcctcactgtcggattgtccagtcacgattgaacattgataactcatagggatgtgcgagaatgatttttaccgaaaaccgagcccgtgaccgagaaatgaatctttttttgcttaaaaaccgcttttttacgtcgcattattttcaaaaaaattggggaacaagggggtccggcggtgccggtaagcgacaccgagaaaattttttgggatttttaaagaattttgttaagacaatctatttaaaagttcaatattttttcctcttttcacccttcgccggcgacccccagcccccgaaatggtcatccttaacacaagactaaaaagccgagcccgagaacagagaccgagaagcgaaaaacccgagaaattttccaagtcgagaatcgagaaccgcgtggcgctacatttggggacagagatttggggacccgacttttgggattttaatgaaaatattataaataatgaaatattttcttacaaaattcgacaaaactacgtctgcttttgtcagagttaactccattttgtgaaaataaaaaattattttaatattgaatgaggataatcagtgtgtatttataatagcgaaccgcttaattagtttttatgtttgtttggtcatttaattgacactcagtttggaagtgaaaaatacctttgccattgagtgaatttgaaacaaaaaaagtccaattaattaattgatttgatatattatgcaataaaaatgctaatttgataacacaatctgaattgttgcatggtaattttcaacttattcaatcatttgaaaattttgcaataaaaaaagtagagtgccacgggaccgagccgggaattcccggtcatccgaggtcccggtcccggttcccggtcccggattttgaaaagctcaggtcccggtcccggtagggcaaccgggaaccgggaaaacaagcactggtaagaatgggggtctgagtgaaaaattctgaattttagttttgtatactcattgttttcctatcaagaaaatatcattcctcatattttttaattgatatatattttatcattttttaaatgaaaatccgtacaaattgagcctaataatcccatagaagccatttttgttgaaaatctgttaacaaatcacacatttccccccccggcggcgcctatcggcaccgccggaccccctttctttcccaaaagttttttgaaaaagcgctccgaaaaaaagtgatgtgaaaatcaaatctgaatttctattaatattcgatgatttagtccaaaaatgattaattgtttgaaataattaaagaaatttgtttgaaaattttcattaatttaatttagctttaacttttggattttattaaataacaaacaaaataaaaatttaattttgtattattttcagtttaaaaaaataaaaatt

SEQ ID NO: 32641 - DNA, 1567 bp, Heterodera glycines
taggaattcaaccgagaaactgaacccgtcttccatggacttgactcggccggcgactgttctcggaactatcgcaacgatgagaatgttcttcaggtagtgtaaattaattgtcgtttgcttctgttctgctccgtccgttcattgccgcttaaggactcttctcgtgtcatctcatggaccagaaaaagtgccactgttgttgctgctgctaataatgatgacaatcaaaacaacatttctacctcctctccgccggtcgactgacctcgtaaaacgaccaaaaaaaaccacaatattttccttaacataggaaaatttttaattttccgtactactcaattgttttaaaaaaggtactttgcctagtttacaggacagatttcatatacatttttagattcatatatgtgttttagaaattaatgaaaataagtttttaaggggttttcgaggtcgctgctgatcacgaatatagcacccatttttgtcaatttcgaacccctgacccaaactcgaacaaaaattaaattaaaaaatttgtatggatgatatcctcattggcatctcacccatgagggtaaccttggtacaggaagcataaaattcgaaaattgtatggatggtatcctcatgggcatcttgcctatgagggtattattgctacaggaagcctatcaattctttgtccctgtacagctcatgtactgatctgagcccggatttctgatcagcgaccccaaaaacctcataaaacttattttcattaatttatataatacatttatagaatcttttcaagtgtacaaatggtccagtggttaatcttcctgcttgttttctacttctttcccttggttcaatccctcttctgtaattaaatatattttattttatctttttatatacttatgggtttcatatagacaaaatatgattcttcatatacttttttaagtgccgataggcgccgccgggaaaattttttgaaattttggctatatgtttaacagattttcaataaaaaatgattgcttttacgaaaaaacacaattcttaccagtgtatttttactcccgtatttggataaaaatttacgggagccgggagcgggactcccgtaaactcccgcgggaccatattaaaaacctagaaaaattctcaaagatttttcggcatcgaatcttttgaaatttaaaaataataggaagtttcaacaaaaatagttaaattttattaaaaaaaatttaaaaaattttgggaatccgaatcagtttttgccggtaccgttgaaaaggtttgtactggcttttaaataaatttttgttatttttgtccattaaattaaaaaaatactcaagcatttaagtttatattataatattttcacttgaaaataaaaaagtaaacattaaaaaaaaatcattttttaataaaaaaaatttttcccgtttctcggcgggattcacgttaaattgatgggattggaggggaacgggaaaagccaggaatcccgttcccgttctaaagtgtctatattcctgtttctcgttaccggaaatttttt

SEQ ID NO: 32642 - DNA, 524 bp, Heterodera glycines
  misc_feature (324)..(324): n is a, c, g, or t
  misc_feature (330)..(330): n is a, c, g, or t
  misc_feature (333)..(333): n is a, c, g, or t
  misc_feature (335)..(335): n is a, c, g, or t
  misc_feature (359)..(359): n is a, c, g, or t
  misc_feature (361)..(361): n is a, c, g, or t
  misc_feature (391)..(392): n is a, c, g, or t
  misc_feature (396)..(396): n is a, c, g, or t
  misc_feature (400)..(400): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (411)..(412): n is a, c, g, or t
  misc_feature (415)..(415): n is a, c, g, or t
  misc_feature (418)..(418): n is a, c, g, or t
  misc_feature (420)..(422): n is a, c, g, or t
  misc_feature (451)..(451): n is a, c, g, or t
  misc_feature (454)..(454): n is a, c, g, or t
  misc_feature (458)..(458): n is a, c, g, or t
  misc_feature (460)..(463): n is a, c, g, or t
  misc_feature (469)..(469): n is a, c, g, or t
  misc_feature (473)..(473): n is a, c, g, or t
  misc_feature (501)..(501): n is a, c, g, or t
gcctctcgccgcgcgttggccgtttcctttttgccgctggcgcggccggttccccgtctggtgagcgggcggtgtgcgccgggcgtttcctgtgcgttcgctctctccttgggctcccctggctcttctctctctgcttccggctcgtgtgttgtgtggcgttgtgtgcggttcgctctttctctctggcgtctgctgtgtccgtgcttgcgttttcgtgctcggtccccggggctcctctcgggtccggtgtcctctctgttcctcgttcggggttcgttccccgggcggccgctcgtgcgggtcctgccgccgctcgcttgntggggntcngnttgtcgtttcccgccttccgtttntnctctcgcgcgcgggcggcgcgggttggcgnnggcncggnccnctncntgnnggnggngnnngggtggggggtgtgtgtaaatggtggtcnttntggngnnnnggtcgncgtntttcccaaaatgggttcaattcaaagantgtagatgtcgcagcgttattat

SEQ ID NO: 32643 - DNA, 1227 bp, Heterodera glycines
  misc_feature (126)..(126): n is a, c, g, or t
  misc_feature (1207)..(1207): n is a, c, g, or t
tagagacatatgcgctatccatataaaagatgaatcattttttgaaaaatttatatagttcgactaaatttgctaatcgatttatggtgtacaggatgtttgtcgaaacataactcgtcaggcctntaagatagacctgccattgctattcctgcaaatatggagtctagtcagcccaatcgattgctattcgaatggtttggggtcattggcccaaacaaaagttgtgctgcttcttgcaaataagacttagccaactgtaaacagcaagccatccaaatgcttcagtgtaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctcaaaaaagtagttcctcgcagattcggggaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcattggcccaaacaaaagttgtgctgcttcttgcaaataagacttagccaactgtaaacagcaagccatccaaatgcttcaatgtaaaaaaatttacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataatgatctatagaaattctcaaaaaagtagttcctcgcagattcgggaaccgtttctataaagctagagacatatgcgctaaccataaaaaagttgaatcattttttgaaaaatttatatagttcgactaaatttgctaatcgatttatggtgtacaggatgtttgtcgaaacatactcgtcaggcccttaagatagacctgccattgctattccctgcaatatggnagtctagtcagcccaatcga

SEQ ID NO: 32644 - DNA, 1212 bp, Heterodera glycines
  misc_feature (237)..(237): n is a, c, g, or t
  misc_feature (557)..(557): n is a, c, g, or t
gggaaaactctaaaaatttatgttcatttgctaaataaatttatgaagaatataaaaagatgtaacttattgctgatttaaagattgatttaaaaattaattgacacggcactttatgctcagtcaaaaaggcaaaatcgtcaaattgaattaaaaaattgcattaaaattgtttaaaccgcgggaaaaatttttaaccccccaatttattttttttaaaaaaaaaaaaattttttnttttttttttggtggaaattatcaaaaaatatttttcccccaaaaaaaatatttttttgtaattctctcccccccccccttcttcttctttggttttttttcccgcgaaaaaaaaaaaaaaaaaaaaacaccccgcggggggttttttccaaaaaaaaaaaaaaaaaaaaaaaatttttttttttttttctccccccccaatatttttatttttttttttttttttttaacaccccacgggggggggggggtctttaaaaaaaaagggggggaaaaaatattttttttttttttctttccccacaaaaaaaaaaaaaatnttttttttttttttttttttgggggcgccctattatttaaaaaaaaaaaaaattatttttttttttttggggggggggggtttttttttttttttttttttttttttataaaaaaaaaaaaaaaaaaaaaaaaaaaaaaattttctttttttttccccccccgcgggggggggtttttttttttttttttttttaaaaaaaaaaaaaaaaaaaaaaaaaaaaaaaatttttttttttttttttttttttttttttttttttggccagaaaaaaaaaaaaaaaaaaaaaaaaaaaaaatgtgatttttttttttttttttttttcccccccccccccaaaaaaaaaaaaaaaaaaaaaaaaaaaaaaaaaaaaaaatttttttttttttttttttttttgggtggggaaaaaaaaaaaaaaaaaaaaaaaaaaaaatttttgttttttttttttttttttttttttttttttttttttaaaaaaaaaaaaaaaaaaaaaaaaaaacacaccccccccccccccccccccgcccccgcgggggggggggggaaaaaaaaaaaaaaaaagaaaaaaaaaaaaggaggggggggggggagcggggggggggggggggggtgtttttttttttttttttttttttttttttttttttttt

SEQ ID NO: 32645 - DNA, 1239 bp, Heterodera glycines
ctgaattatttgctttgtatttgttaactaagcattttcctggaaaccctcagcaactaaagatcgttaatcccccgcatgtctgctccacatttcttgaggctgcccgattaagaggtcttattgatgatagtgatgtttggatccgaacgatgacagaggggtccgcctcactcggtccggcacaaatgcgccaattgctggcaaacattttgatttttggagcaacagagaattgtcttatcgacggcgcactgctttgggataaatttctccatcatatgtgtgatttgcgttgtaccgatgccgaacgtcctgcgagaattgaccgtgcattggtccttttagaaaaacttttagtaagactaggaaaacagtgtaaagattatggactcccaacccctactatttcaattatgaataatccccagctcgggcttgatgaatttttctttccacaacacgctaatgatgatgatgcagatgatattgacacaagctcctatgagcgtggaaaattgaatattgagcagcaaaaattttttgatttggtaaagactgcatttattgactcacgatgttcaagattgttttatttgtatggtgacggtggaaccggaaaaacatatttgcttaattatatcctatatcacttgcgaagaattggcgctaaaattattcccaccgcttccactggtatggcggccacccgtttttatgctggtggcaccactgttcattctgcctttaagtttggaataaatgtcgaacctggaaagttaccttccattccatttgatagtttctttggtcgaagaataattgagtgtgatataataattattgacgaaatgacaatgttagagaggaccgttttggaaaatattgatgctctttgtcgtcttatgtgtttgcaaaaacagcacttaccctttggtggaaaatgcgtgattatttccggtgattggaagcagtcactccccgttgtaaccgattcttatggaagccctgcacaagtatccgcatgtatccaatcctctccactttattctctttttacgaaatttaaattgactcagagcatgagagttaacccaaaagagattgaatttctaaagtggcttgatgatgttggaaagaggagtaagtggcgaaacggtcgcaatcccaaaagatattgattgtctactcccgggaagaactgattgattgattatctgaacaaggatttaatatgcc

SEQ ID NO: 32646 - DNA, 841 bp, Heterodera glycines
tccttcccctatacagttttccggatcaggatattccgccttttactagcataaatttcggaacgcgcaattccaccttaaatttccggaatccagaactccttcctctacacagttttccggatcaggatattccgccttttactagcataaatttccggaacgcgcaattccaccttaaatttccggaatccagaactccttcctctacacagttttccggatcaggatattccgccttttactagcataaatttccggaacgcgcaattccaccttaaatttccggaatccagaactccttcctctacacagttttccggatcaggatattccgccttttactagcataaatttcggaacgcgcaattccaccttaaatttccggaacccagaactccctaccctatacagttctccggatccggatattccgccttttactagcataaatttccggaacgcgcaattccaccataaatttacggaacccagaactccttcctctatacatttttccggaatccagaactccttccgctatacagttttccggataggatattccgccttttactagcataaatttccggaacgcgcaattccaccttaaatttccggaatccagaactccttcctctacacagttttccggatcaggatattccgccttttactagcataaatttccggaacgcgcaattccaccttaaatttccggaacccagaactccttccactatacagttttccggatgcggatattcgcgccttttactagcataaatttccggaacgcgcaattccaaccttaagtttccggaacgccagaactccttcc

SEQ ID NO: 32647 - DNA, 1041 bp, Heterodera glycines
ttgaagagtgacaaaatatcattaattcacaaaatccataattaatggacaaagtgcggcagcagcctttcattcccctccctttcatttttcacaatttataatggccactaattggcacggcaattaactaattagtacttgttaataaaattacgacaaaaaatgaaagaaaaattaagtggaaatgggaataaaaatcttcgccaactgtctggctaaaagtggacaaaaattttatattttcttttttaaaatcgcatcgaaatgttttggtaaaaagccaaaagcatcataatctgctgataaaattgttccattttcttttcttttcaacaaatgcaactttgttgtccatacttttcacaacaagctaaacgaccagcacaatttgtagcactgaaataaaatgatcaaaatgcttataatttgaattaccctgctgccaacaagcactcatcaaacccatcggcacgctttgccaccaattttgcaaattctaaacaatttgattcaaaattgtcggtacaaaaagaattattacctagatattattattttaaattttttttatttaacttaatcaccttgttcttgtatcggtgttccgacaactaaaaaaccaattaattatatgtaatgactagggatgcgatttttaggttttaactaaattttttgctcacttgatttgaagaaaggagctcaaaaaacgcatttctgcgttaaaaattttcgattctgatgtcactatcggtcactagaaatcactattttggctacttcgtcactatttcttcaatattttggcatttttactcactattttagttaattattttggaatttttcgtcactaaaagtcgcatccctagtaatgaccctaaatttgactaaccatcagcgaagccaaagaaggcaaaaagaataaaaaatgacaaaataagcatttaaaaatttcttagctgaaaataatagagaaaaaaacaatcacaaaggtttatttttcaatttctaatattaaattggaaaatgaatttc

SEQ ID NO: 32648 - DNA, 1133 bp, Heterodera glycines
tttattcaaaacacgtataaaatgatcaaatgttatatttttgattgtccatgatcaatttgagcaattttaaaagattctgaggattttccccaaagcctcaaaaaccctcaaaatttctcaaaaaaccacaaaaagccgcaaagcctcattttgaaaatttagtctcattgacctatcaaaaaaccacaaaatgaggctaaagcctcagatctggcaaccctgttctaaaaagttatttgttatatcactcgtgaaaagtacccaattacctaaatttgtattgactttggcaaactaaaatcacgaatttctctccctctctctcttatccttatcctctccactcttttgcttacgctctctctctttttttgtacgttatgcctcccccccccatccaacggcctggctttttctccgatgaatcatccccccattcgtttcctttttctttcttttggctttaccccccccccccccgcttttcctccctcttctgtcccgcatatttctcttatttcgctgttggtgatgataaacaacaatcgatacacacacacatcacaaaaataacagcatatgaatgaacacggtctgctgttgtgtgctgtttttccctcacaacgccggggggtcacacaaatacaaatgctatgtttgtgtgaacgaatgaatgaatgaaaagtgaatgtataacattattcatcattttgtatctgacacactgagaagaggaatttctgccattcacttcatcaatttcatcattcaattacatttgtccatttatacataacatttggaattattcactcccgctttgttagtgcgaaattttcatttttagaatttaatttaaccaaatatttattttaataaggagcgagtttttaggggcgaaatagagcaaaattggggcgaaaaatactaagatagggacggacgaaagaccattcttactgccccgactcaaactgtgcaacaaaaaacaccaaaaaaaatattttttaaaattactaaaagatcaataacataggtaaattacatcgtgttgtgaaagtataaatcaacggacaggatccagtgcggaaacaatccgcaaatccagtccggcaaaaatttaagaattc

SEQ ID NO: 32649 - DNA, 1146 bp, Heterodera glycines
ctcgcgttggagaaagcaatgcgcagaataactggggagacttagggttagcgcatcaattatttttttcagaatgtgatcggggtacaaaaaatacgggtcaaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagtcgccgctgctgtacgcccacccgttgctgagttagggtcgagatcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaat

SEQ ID NO: 32650 - DNA, 1232 bp, Heterodera glycines
  misc_feature (169)..(169): n is a, c, g, or t
  misc_feature (174)..(176): n is a, c, g, or t
agaaaatttataagcatttgaagggttctcagcagtttccctgcaaattttggtgagcttctgatcagtctagaacgttgggtgataaaatgaaaaaaataattaaaaaaaaataatgctggtgtggtaagtgtgaagaactgtgttcctccaggcaaaaaattctggnaaaannncggggcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaacttagcagggatactgaaaggaagagaaataacctattttaaatattatctagtcagttcatttaaataatttttatccaaaaaaaatttttttttggatttcggggcagtaccatgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttcgatatacctctactttatttttaccttggatttttgctccccataattgtttgagtaccccaaacggacactg

SEQ ID NO: 32651 - DNA, 715 bp, Heterodera glycines
attttttgacttaatttttgaaaaacttaataaaattttttgaaatttagtaaactaataacgcaattcaagggctatcgtatgataccaagattgtgcaaattggttgagtctgagaaaggttatgagttgattagtcaaaaatttagcaaattttgcacttttcgtcggtcgaccaaccatgggaaaatagtactcgtcaaaccctacgtttatttcgcgagcggaagtttgggcaccaaattaaggatttaaaaaataaaaatgttttaaaaaacatagttttaattaagttaggctgaaaatttcgggccaaactaagccggttattcaggcttaagtcagggctcggatcgaaaaattttcaaaatcagaacatcgggcctaaaagatagattttggggccgaaaacttagcgaggaaataagcaaatctaaattttagtgcattcgtgatcaaaaaaccaaagtttagcagatttttgtcaaaaaaaatgacaaaattttactcaaaccttatattttcttgataaaatagtgacattctaccattcgaaattatgagtatatttaagaaatcagaacaaagagaaagacaataaagcaataaatacaaaaataattagtcaaaattaacagcaagaaagaaattataaggcgcccccacaaaatgtccaggccacgaaatgtgcacaagagtaaaaacccacgaaatg

SEQ ID NO: 32652 - DNA, 454 bp, Heterodera glycines
tttgtctgcgtatccagatcattttgggggtgctcatgattttttaaacaaaagaacttttcggacagacacagctttgtaacctaacgcataaccagctttcggagcaggagttcaggccgtggcacctctgggtggagggggcacagaaaccagccacgcctgcagtttcttcctgttgtggccacggccccttctccccgagatgggcatgcaaatgaaccctgcaaaggacgcaggagcaactccacagaaagggggggccagggctattcgtggggcagaggcctttgaccagcctcaaccccagtggcagggggtagggtcagacccagaaccctgaggcagagcctccctgagccaggactgtctgagaggatgagggtttggggagaggtcggccacgtgggcgcataggaagcaggcagggacagacaccattccacgtccttac

SEQ ID NO: 32653 - DNA, 104 bp, Heterodera glycines
tcctgtgacgcggttgggttgcagcttcagttcttcgttattgagcaggatgcgcccgctgtgcggctgttccagcaggttgatgcagcgcaggaaggtgctct

SEQ ID NO: 32654 - DNA, 329 bp, Heterodera glycines
tacagaaaatataaggaaagactaaaaatcactgatttacacaaattggaagaaagaagaaaaatcaatgatttaacaacagcttttaaaattataaaagggttcaccagcctcgatgctgaaaaaagtttctttttctcggaaaggcccaggaggcctttacttttgcgagtaaagcgccacacggccaaaactcaaaataattttttcaatagaatagtaaaaagctggaataaccttccagtggtagcggtgcaaattaataaggcaaaggaattcaggggtttactaaaagcaatgagttctgagtaggattttccatgttgcca

SEQ ID NO: 32655 - DNA, 955 bp, Heterodera glycines
ttgctcacatctgatcgtgtcaatgaagcgccaaattgttggataagtgcagctaaattgccgctgaagtttgcgatggaatgcctcggcgaagttgttggtacgatcatctaaggtgcgctgatgaacattccattcgtgcgggtggaacagaggcgccgtcattggaacattgaaacgcattcggcccatgcagttgtccaaaaacctagaaaaataaaaataattataaaattcgccttcggacttaaccaattgaaaacgccgttaagttgtggtggaatttgtccttgaagaacattaaggccattttgaaggtggtgcacaggcagaaaggccaatgaagtgatcatcttagacttctcggcgaaagcaggatcagtgttgtaagcctaaactactaagaaaaaaatttatcatctgaaaaattcaattgacatgtgtgaggccaagggttctgatctgcctcttcatgttgcggacaagatgaaaaaaacagtagcggacactgcatgccggaagcctgtgcggaccgcaccgaccattgccaactcgaagtccatcgaaattgtctgcggcgcgaaattcggccatcgttccaaaagaagctgtaacatgcgcgtataaattgcggcacacttcgatgttaaaagacagtagtaaattggaaatacccaaccagcgctcaattggtcgaaatatagagtgcgccgtcatgttctaacttaactttgtttcgttttgttttaattttttgctgctggtccatattatataattgaaacagccttaaataagtttataaactcacttaattataaaataaatattcgttagaaaaaagagtgaaacaaattttcgtttaattaatgtgagttatgaattctcttttatatgcacccacgcgaaacggtcctcacgcgaaaacgtcctcacgcgaaaacggcacgcgaaa

SEQ ID NO: 32656 - DNA, 952 bp, Heterodera glycines
  misc_feature (829)..(829): n is a, c, g, or t
  misc_feature (872)..(872): n is a, c, g, or t
aaaacggaaaagcaaacatcttctccctccccccctccctttgagctcgtcggctgcgcaactgtttgtacgccaccgcttttgtgcccgcctcgttgcttttccttctgttcgtcctcgtctggttaagcgaagttggactgatctgatggggaattaatgcgatcggcttatcaaatcaattcaaattacacataatcaattaattagtaattaaaacggtggtggaatctaatggacagacagggcgaggatatttagttatttaattattttttcttgcagctttgttttggtgaaaacgcacgaaaatgattttttttaacccgaaaattcgttattttaatgtgaatatgtcgtcaccaaaaatataatttggacttttcgcaactaaaataattacgtcattatttttgcgctttgtcaaagcgatttttgaatgcaatataattgttttggaattaatttgtttttatctctttttttattaatataatcttttaaatttgctaaatttgcaatttcttaactatttagggtttttctaattaaaagtcccccattcgactgttatattttccgaaactaatcgcatgttttaataaaatgcattaaaaaaagaaggaaataataatacacgctattttaattaaatcttcattttgttgattaattctgaattttttttgaattgctaattaatttttggaccgttctttacgtaactaataaatattaaaattaaatatataaatgaacaattatttgcgaataaaatgcaatttcaccactaattgatgagtttgtgacgattacagtcaatctttgntcattatttatttatctttcctcgtctcttttctgcacatgtngtcgcatttgtccgcccatcatttcattattatcggcagtcgtcagccgatattgcccactatgccgccattaattgcat

SEQ ID NO: 32657 - DNA, 925 bp, Heterodera glycines
atggttctttagttaattaccaaaacaaatcttaaagcaattaaagtgcacttgaaatgcattcaatattaattttaatattaaccttttgtttgattttcaatttctttttgtttaggccgcagtgaaaaatttgcttgaaccgattgtccaaaataaatttctcctctacgtaaacaaacttgtggaaaaaagaggttgtttattgtttttggttggacaatcatctgttttgaaacttttctgtaaatgccaaaaacacctttttatgagtgttttggggtgccgagtaagaagcaggcctcctttttggctaattcgggccttgaacccgaactcccacatttttcaatttttttaaatgaaaaaaacattttttgaagggtttccgggatcactgaacatgaacatagcatacatttcgaccaattccaaaccctttacccgaattcaaacaaaatcaaaaactcaaactaagccaaaatataaaatacgaaaattgagttttgacttcttattcaaattcgggctttggctttggaatttgcgaaacctttgtttgaatggacagccgctgtaaagttttctgtaacttctttactaacaaatttatgtccttttattgaatagggccgtttggcgccattgaccccaatttagaaaagcggattttgaattctggccgaaaatcgaatttttattttgactttccacttaaaattttatgatcttaaatttttgcttttagcgaacattgtctacgttactgttactatgacggtcactgttgttggcactatgcttacttttggtggtttcttactgagagccaaccaagatctctgttcggatgtccgcaatcttgaaaaggacatccgttcggatctccatgaattgaaggcagaaattcgtggcatgaaggcag

SEQ ID NO: 32658 - DNA, 477 bp, Heterodera glycines
cgtttccactgacaatgcctacgccctgctgatcgccaccattgtttctgtcgatggtctcttggatttctttgaaaaagcacaacatctgaacaaatattcctccccttttcagtcttcgaatgttccgtaacattgcgctccgaaaaggattttcccgccgaatttggtcagcagcagtcggttctttaccacttggacaaaaatgacggcttcagctcctttgcctaccgtcttggctccgttgctgcgctgcttgaaaacgacgaacgggcgtaatttgattaatcaattttcaattatgttcattctcatcaaaacattttttatttaggcaaaggttacgctcggttttgacccttggccactcttcggcgccaaaatcggcacattcccttgctgaatcttcttcgtcatccgcaacactgacaacaacagaaatcgacagggaaacaccggcacaacagaaacaacaaa

SEQ ID NO: 32659 - DNA, 660 bp, Heterodera glycines
caaaatcaaccattttttaaatatttgtatcatttgatagccctaagtgttctctatcagtctgcaaaatttcaaaaaatttcgttaactttctaaaaagttatgcctagagaaattcaaaaaacattgttttttttgaacaatttttagccataagttttttgaagtttagcagattaatagagaacatttagggctaagcaaaaattattatcttcatagtttttaaataacgaaatagtaccattttggctgagtaagctaatcaccttgtaggccaattgtcgtagcgtttccgacaggtcccggcgtaaaaatcaaactcgcagatccgttgcgggattggtactcaaaggcttttgccgaaccggggattcagccgcaaaaaaacccaaaaaatgcgagattttgcgcaccggcgcggaaccgggtctatcctaaccaaagatgataaaccagggcttcgatctcaaaattttgaaaatcctgattttagccataaaaaaatcctcatttgcctctaaaatacctcaaaaaatcctcatttggcatgaaaaatcctcatttttctaaaacatcataaaattcgaacaaaatcagttaactgtcatagtttcgtttgaaaaacatcacgcgcctatcagcgcccgcggaccccaa

SEQ ID NO: 32660 - DNA, 301 bp, Heterodera glycines
tcgtcaatagtacgaccaaaactgtcttgccgacggttgctgctgatcatcatttcactgaaattgattgatgtctgtcggctgataaaaacgcgacgatttttcatttgggaaaatcgccaaatgagagacataacgccaaaaaatcggaataaaatttaaaaaaaacaaaataataaaataacaattaaatcgtccgtcccttcccttcccccatttttatttttaattattgttcaatagagccccccccaggggcaagacggacgatgcgatgaatggtgggccgatcgccggaggg

SEQ ID NO: 32661 - DNA, 100 bp, Heterodera glycines
ctgttgtctaaccctgtttcgtatgacttgggacgggacttgatcgtgcgagctctcgattcgcgcgagcggttttccgagcacaccacaattttgaaaa

SEQ ID NO: 32662 - DNA, 849 bp, Heterodera glycines
aaaaaaaacgaaatcttcggcgatcaattttccgagaaaatttttcaattctcacgggcgtattttctcgaaattttttcagatcatttcttaagggtgtattttcgcgattttatcgcatttttaaggaatttttcggaaaaacgccaaaaaggcaccaaaacgccaaaaaaggcaccaaaatcggcaaaatcgccaaaaaggcaccaaaatggcaaaatgccaaaaaaggcaccaaaatggcaaaatgccaaaaaggcaccaaaatggcaaagtgccaaaaaggcaccaacatggcaaaatgccaaaaaggcaccaacatggcaaaatgccaaaaaaggcaccaaaatggcaaaatgccaaaaaaggcatttaaggcacgaaaatcccgaaaaggcaaaaaatggcataataaagttaatagtagaagcctaaaacaaagtggaaacaatgttttttatgatcagaaaaaaggcatatgccttaaaagttgttctctgccaatgaattatctagtgtatatctattttagtgccacgctttttatttaatttcataaaaaattttttcttttcataaagcgattttctccggaaaataatcaaaaaaattaactaaaaagtgggttccaccttcataaaatttccggcaaaatctctgtgcaaataattaactcttttaataggtttgccgtccgccgattcgatcaatcgtcgcacttttcgcgcacttttttgaattaccactgttaatatcggcggctttttctttacattaatttgttacattctgttaattcccaaaatttcatctccaatcactgcttggtttttacatgcaattaccgca

SEQ ID NO: 32663 - DNA, 745 bp, Heterodera glycines
  misc_feature (647)..(647): n is a, c, g, or t
  misc_feature (662)..(662): n is a, c, g, or t
  misc_feature (698)..(698): n is a, c, g, or t
gcttaatattttctttctaattgatttgctttttaattaatacaatcatttcatttccaaaatttcttgctttctattaaaattaatttaaacataagcagagtaattttgactttgttgataataattttatattttttgccattttatagctgcaaatttgctttaattaaaaaattgtaactttattaaaatattttttaatcaatggaatttaatttctgcttatgctttttgccaaaaatttaattattttcaaatttttataaacattttaacaacccattacattcaaatagctcttcttgaaatattgataaaatttttaaaatatattcggacactaaaaataccaaaagatggtttatgagtactttatatttaaatgattatttcgctaagtatttagctgttttttttttgcatactagctattaattcattatttgtgactgagcgaattttattggttgtaattaaatattagatttatataaaacattaattctaatgcattcttacattaacatcaaaaatctaacaatcagattggtaacgtaaaagtgaaaaagtttgtaaaagttcttaatccgatttaaaagatctgaaaaaagaagaagacgaaatctccaattcaatgcaagaanagtttggattattanaacaaaaaagaatttatctttacaaaaaatggaaanacttttttgatcgatagacaaatttcattatgcattgtcttgctttc

SEQ ID NO: 32664 - DNA, 741 bp, Heterodera glycines
aaatagctttattatgaatatttgatgccaattttcaacaaaatcttaccagttttgcaaaattataaaaataaatacctttatattataaagaagaattgaataaatataacgtaatgaaatcataagtaaaaaaaccatccatagaattaaaaaattttcatttttaaatttgaaaaaagttaatattcattatgcggattgtcatttcaataaattaaatgaaataaatgataaaatacgtacctaagatatttataacaaaacatataaaaatgaatgcatcacaattgattaaaactcaagaaaatcacttaatcgagaaaataaatgttcgcagccttataatcaaaaataattaataatctaataaacaagaatacttggtacgcctttataccaccacattttccgtttttcggtgtatattaaaatccatccctaaaaagtgtaaaaaacaaacaaaaatttgtccttttaataaaatagcaattccatcaaatccaatttatacgttccgtctctttatgaaatattttaatttgaaatccgtctctacaaaaaaatattaaacaaatagaaaagtgtcaaaaatatttcaccaaaagggtattttttaaatgcagctttccaccaattccataccaaaatcgattagaatacctgcaactgccaacacttgagaataggcgaaaattgtttgatctgttcatggcgcataaaattgtttatggccgaaca

SEQ ID NO: 32665 - DNA, 888 bp, Heterodera glycines
cctaattagcataacatttcaaaccattaatgatctgctttgctttgttaattgccatttacttaatagactcatatgaattcattggccaagaacatcttagttttttaataaaaaatattaatgatttttccaaagcaaattctttaaaaatatttttcttattctttaatttcaaaaaatgaaaaaatccactttaaaaaaaattcgttagattttttattctaactaagaatttaagaaactgatatgtttttttaaaaagggaaacgtcgtttattacactcactttggccatcactgtgcttgggtccatacaactttgactgtgatgattcagtgccaccagagtcctttaatatttggtcaattattttatttatttttaacgggatttttcacaaaacatttttttaattaatttcaaaattatgtgtaaatattatttattaatttataatattgtgaagaatttaatcttttataaactctcaaaaatcctgtgcaaaatacataaaaaaatcaaaaaattttatttattttctattgtatttccatataaatagtgctccataatcaaattagtgtgatcataaaacaaaaaatataaataaatataaattttaatttttaaaatttttatatttaattaattaaattgtttgtcaaccaattggtgaccacgccgacaacgtgttgctgttgttgtacgcttttgccagggccttcgcctgtttctgattgttgttgccgttttataatcaaatcttccaccgccgttgcattgaacagttttacatttggctttaattataattgattgcattgttaacatacatagaacaatttttttaacaaaaaaagaaaaaaccaaacagtgcatgttct

SEQ ID NO: 32666 - DNA, 591 bp, Heterodera glycines
tttaccccagaaaactatttttcaccccccttttcaacccaaaaaaaatttttgaaaatttctagggggcctagctcgaaaatttttgaaaattttcgaacatgtagtacaccattcgatagcatttaaaaagctctacaaaaatgtcctaagtcaatttttcgctaaaatcaacccctgacgagttatgggcccaggactcaaatgtcccgctgaggccaaaaattttttctatttcttgaaaaaaatcgaaaattttccaaaaaaattaccaatcgatagagctcgaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatttggaaaaatcgggcttttaaactctacaataagtctgctggccaccctgcgctcaggtcaaaccctaatgagttattcggctggtactgaagtgggaaaaaaaaattaactgagtctccgtgtctgtacaggtccgggatttggtctgatcaaaaaataaaaaatactgga

SEQ ID NO: 32667 - DNA, 411 bp, Heterodera glycines
  misc_feature (353)..(353): n is a, c, g, or t
tataaatataatgactaaattatataaattttattattcttcctagattgcctccaactttgtttctgggttttttgtctattactttttcattaaaattttaatttttcttttttttaatagtttttataatacccttaaatatttaattacaatttaggaaaaaaaagttcgatttgaggttaatgaaacatccaaactcaaatcggaaaataatggcaattcttttgctttaggacgtttaaggcttttgaaagaaataaacgatgctacgaagaacaagtgatgagtgttgatcatcttattttatgatttgatttatggacaggctcgtaactagagaccggcgcggnacgggatcccgcgcgggattttgcgtgatcccagtccgcaatcccgcattttttggaa

SEQ ID NO: 32668 - DNA, 588 bp, Heterodera glycines
cggatgggggtggggtgatcagatgggggtggggtgtctggcatgggggggggggtgatcagtgcagatggtgatttatcagaaaaagtatgatagccgaccgattcatgggaatgatagcgggtggagggggatgatcagaaaacggttatgagaggacaggttttattcaaccaatcgagagctattgccttcgtgtgtgaatattcgtatccgtccgggttcagcaccgggacgatgtaccaatcgatggattcgaccaaatagcgaatgttcgggtcccatgaattgtatccgtcgatcagttgcgccaggaaaagcattgcagtggctaaacaaaaacttggccatttagtccaatgctcaatgggtgtcattgcctggggcaatccattcccgcgcgtggatgccggcatcgacccaaacggcggggcccctgtaggggcggaaacgctcgtccggaaaatgttctcgggcggagacttttgccaccacaatggacctgggcattggaatgtgattatcctattctcgagttcttcctttggctttggccttctctcaattttgcccactgttctcgtgagt

SEQ ID NO: 32669 - DNA, 405 bp, Heterodera glycines
tctcattcttctccatccctccccattttccatcctctatcattcactgctttcctctccgctttcccaactcggtcactctttccctcccttacccccgttttttttatttaggtatataaaaaatattttaaattattttatattttaaattaattaatatttatttctttattttcaaagtgtaaatgccaaaaatggattcatttgatcataaaacggcactcccaacgaatggaccttctgctgctgatcagcagcaccagcctccggcagaggaggtgaagccatcggcagaagaagcagcagcgaatgcttctcccccgtcgccctcttcctccgcggacagtgccaaaggcgtcagtctgtggcggattgcccctttctgtgccaagtgtcctcccc

SEQ ID NO: 32670 - DNA, 985 bp, Heterodera glycines
  misc_feature (897)..(897): n is a, c, g, or t
cgcctatcggcaccgccggaccccttctttcccaaaagttttttgaaaaagcgctccgaaaaaaagtgatgtgaaaatcaaatctgaatttctattaatattcgatgatttagtccaaaaatgattaattgttttaaataattaaagaaatttgtttgaaaattttcattaatttaatttagctttaacttttggattttattaaataaaaaacaaaatgaaaaatttcccggtcccggcttctcaggtcccggcaagtcccggtcccgtttttgcccaaaattcccggtcccgcttcactctactcgaaaccccccaaaatatgcttttatatgcactaaaaaccttcaccaaatcaaaaaattttaacgtagaaatgctattttcattagcaatttcttgttcaattttattttcttgaaatttctctttaaaattgaaaaagctcatcaaactcattttcagatgattcttcgctcaatagttccaattcaatttttggcatttttgttttagtttttatattattattttgttcctccaatgttttttcttttttaatttttatggaatttaaactcagatagcattcgtcatcactcaaatcgattgcttaaaatttaattatctcgtcaataccattttgcttaattgcctcattaaaattccgtagtcacagcctggcatttatttctaagctcaaaagtcattttcttcataaattttagttgtaatttagcaattttattttattgtttcattttaaataatattatgatttttgatgaatattctgaatagagcagggttttaagtttaatctatttttaaatgagctccttcacttttcaaatttcagaaatggaccctcccctaaatattggaactgttcattanatattataaaaatttgacaataagatgggatttaaacttggtgaattttattacttaaattctcagctctattatcactatgccccca

SEQ ID NO: 32671 - DNA, 538 bp, Heterodera glycines
ccgtcaaaatgctctattgtcaaagttcaggaagcgcaccaagacggatttttcatcttcaccaacttcgagcagtatgcctgccaacgatggtgttctggcggagagcaatgtaacaaaaacggatgatgattgtggagggagcgacgaggacattcaaattgtggagacggatgaacagcggaaaactcacgacgaattaagacaaaaggctgccgaagcactgatccgtgaggcgaaaaggtcggcgaaaggagaaaaatcgaatattagaaaaaattcggcgctagttaaaagaaggtacattttgaaatttttttgcacttttggtctaattttttttacacataatgatgaatgcccgggggttttcgaggtcgggatcccggccccgaacttgaacaaaaagtcgaatttagaatttcgttttttgttcgaatttgggttcgggattcggaataaccccaaataattgtcatattcgtgatcaacgacctcgtaaaccatcgggtacttggattcaagacttttgtaccga

SEQ ID NO: 32672 - DNA, 983 bp, Heterodera glycines
  misc_feature (843)..(843): n is a, c, g, or t
  misc_feature (890)..(890): n is a, c, g, or t
  misc_feature (916)..(916): n is a, c, g, or t
  misc_feature (944)..(944): n is a, c, g, or t
agaagaattcaaaaaaccagattttccaaattttttggctcgaacttttttttaaactgaacaaaattttttggaattttgcaggctaatagagcatcttaagggctctcgaatgataccaagatcgttgtatttggttggaaaataaaaaagttatagtcaaaaaatgtgctcgtacgaaaacggcctggtccgctcgttttttgactgtatgggaaaagcagacgtagtttttcgtattttgggctgagtacttcattattatagttttttcattaaaatccccaaatgtcgttttgtccccaagttgcaaatccccaaagtcgggtagccgaaattccacggtaattagttgtttgggaaattaatttaaatattattatcatgtgatttgtatgaaagtgcgaatttcagtgccaatttatcagccaaaaaatatgaatgcatagcataaaacaataattggttggcacttttcaacattaattggtcctttttccgacagaaatttatgcactttattttcatcagagttcacagattaaatttaaaaatatcatttgaagcattaaaaattttttccttcttaaaaaagcgaacaaaaaccatcaaattacttaaacctaagcgatcacataataaatgaattaattgcatattttgaggcatgctttaagcgctcactttaatccccccctcaaaattttctttgatagctattaagttaaccagatgtgctatatttattaccaactaatttgactagcgtctgacacatttttcggtttaatagtcggataacaaaggttcagaagatgcaacaaaataatcataaagtctcanattaaacagcgcctcccgtttttgttttgctatattaaaatctcctnttatatataagttcaatttatattcnaatacaattcgtatttccaccgatcacntttttgtggcaataaaattccgattggtttttgcgtttt

SEQ ID NO: 32673 - DNA, 225 bp, Heterodera glycines
atctatgttactagatcggggatcgatcccctcttaaagggtcgagcaggacccgcagaagctagctcgacggcctttagaagggcggagcccgccaacagaacaaaccatcaagagagggaggggagcggcgcgcagcgggggaggcgggcggcggaagaagaaaagggcggggggagaacgaggacgacgggcaagagggagaaaaagaaagagaaacgacca

SEQ ID NO: 32674 - DNA, 116 bp, Heterodera glycines
atgaggaaaatggcaagggaaaggcaaaggcattttataacgcaaatttgacaaaaaaaactgaggggtgaaaagagaaataaaatcggagcgaaagaacgaaaaacaaatgaaaa

SEQ ID NO: 32675 - DNA, 752 bp, Heterodera glycines
ttaaatataaataatattaataaaataaactaaataattctattattaattaattttgattattattgttacaatatgtacaagatttgtgcgtacaaattattaatgtgtatgtttatttgttctctctccattcttgaagagtcgtcgattttctaatgttgacctttttttttaaattttgcaggctaatagagaaaaagcttagctatcgaatgatactaagaatggaaatttgtttgcctttaagcaaagttatgcctcgttttgtcgaaaaaatcgctaagatggcggattttacgcaacgcctagcaaggttttttgagtctggattttttacagaaaaaataggaactttgtccaggcttttttttttttaaacgaggtctaataagtattgcaaaaagtgacaaaatcatttttttggcatttcgatgtaaatttatttaaaaaatttttccattcatctcttttctccaattttcatcagaaatttaaaaatatgattaatttttttaaaattgttttgttttttttcattaatttgttatttttgcgagtttttacctgatcttctgggctaacctttcttaggtccgacaaatttggccgatatgtattgaccaactcctgatttgatgtggcttgtgtcgctcagatccaattcagtttcgggttgcagattgtccaagttcacacggatattgcgaatctatggcaagagatataaaattattgaaagagtgccaaaa

SEQ ID NO: 32676 - DNA, 761 bp, Heterodera glycines
tcctttctgatcagtttcgtccgggtcgtccgctctcaatcggataagagcagcgccgggcttgacagcggaacggataatcggcgcgaagaaatgacgtcgaataaagcgaggagcattgtcattcacatcggcaacggacagaaacaatcgcagggatgagggaggagaagcaggaggaaaagcatcagcagagagtgaaagtgccgacgaatggcgcgaggggtcggcacaccgttggccaaccccggggcaatcgtccgcttcaatttgcaattcgtatgaagcggccctctctttatcaagtgcttaaaattgtacattcaatagctttgttttgcttatggccaacccttcgacagaaataattcggccttttctggcttagggatgacaaatgtctgcccaaatgaattggcgagtcggtaacaaacggaacgccactgatcagtgccgtcggcatcggttgctcgggcaaagtgcgcaattgggagggttaaacttggcggaaagtcctcactgatgttcacattctatgaaagaaagtgccaatttcaaaggcattgtttggatgccaactttgtccatttttgggccttcaaatttagggcagttgtcatttgagtccaaaacatcgaagcccaaaacgaactgttggcagccgcttcttctgctcccagccgaaacacaaacggacactccgacagaataaaaactctgagtttcgaagtcgaaagtgcgcgaagaattggcgaaggaca

SEQ ID NO: 32677 - DNA, 418 bp, Heterodera glycines
ttttcagcacaaaaaatcaccgattaagcactgtaaacagtaccaaatttatccgaaataagcatgaaaaagcacaaaaaggcaaaatcagcactaaaaattggaaaaaagcataaaaattaagagattaaaggcaccaaaaattgaaaaaagtcgtaaaaaacgtttatttgcaccttgataataaaaaacctccaaaatatgtgctaaaatggtaatgagatatgtacataatttaaaaaaatcaaaatcttgtcaaaaaaataaattaaataaattttggagatgaattatttttaagaaaatttccaattcttagtggtgtgtttttaaaaattttcggccgattcttaggggtgtatttttcgtttttattacatttttgttaataaattttttgaaaattgctgaaaatatt

SEQ ID NO: 32678 - DNA, 527 bp, Heterodera glycines
gtttctgatcaaaaattccccgtgaatttcctttactagttaatcatggttcgatttttttttgaatttttttttatgcttatccccaggacccttcctcatttgttggcacttttatgaatagaaaggccaagaattcctttcacttgttcatactttgttgttgttgttgatgttcctcctcctgttcaggttcgctcagttggtctgcgtctgccacttctccatggccgtctcgtgccccatttgctgcatctcttgcggtgttcgctgtctccctttgctcctcagccgactcttctgaccgcgtcgcatttcttcgtcttctcagctcggaagcggcggcgttctcaccgctttgctcagcgctgttattggcgttgttattggcattttcatcattaatcatttgattttgtgggtagttttatttgtgccgctactaagatataattatgtttattattaaaaagtttgttgtgtatgaatatatgaatccaaatccaccatgacccattccgttgaac

SEQ ID NO: 32679 - DNA, 651 bp, Heterodera glycines
  misc_feature (610)..(610): n is a, c, g, or t
ttgaacaatattgatgcaaacccgagaatattttcgacattttgtgtctaacatcgatcgactgaatgattggactcaaaatgagaatgctccaagacggtgatatttatttggataatactgcccttggcaccccaactttaaaaaacaattttttttttttaattcattaaaacatgttgcacagggtgttctgggtctcgaatttgacgtccattccgaccaattcctactcttggaaatttcccatccgttacgtgaaaagcgaaggacaccatttttaaatattcttttcttgataattttgtttattttatttgcaaaagttaattaattgccattaatgtataaaatcaacacacaaaatttccgtgctgccgtgccgcatttgaagaagcttgtcccatcctacagtttatttttatcattttttaacttttgaccaattaaaaaatatgaaaatacaatgaggcatttgcaaaagacattgtcacagttttttctgcgtttcactgaagatgccatagcagctaaattgaataaaaactaatgaaaaaacccagaaaaacgatttaaaaataataatcaaatcaataattatttacaccanatattaccgtacaactcactcgttatacacatagtcaatta

SEQ ID NO: 32680 - DNA, 829 bp, Heterodera glycines
caaaaagcgaaccccgttcaacgactgccgaagtggaggacaatgatgaattgctgttggcaccaactgccgtgccaactgcgcgcgattgccttccatcgcgcccacttgcgctatctttttggggcgattgggcggtcgggtggcgacgatcagtcggcgatggccgattcagcgcctgatcactaccatttggttgctgattattgtcatcctcatcctcatcattgttatcttcctcctcctcctcctcaaccaatttgtgctgttcatcatcaattggtggtgccgaattttcatgctcagcccccaccattttgccactaccacctgctgctcccaccgttgccattaatagtgtggttgtttttattgattattatcaaagtgattggccagtgatcagtcagcaattgatcggtggctgggcaaaaaagtgattggcaattgaagacagggccaaaacttgatcggtcggaggatcagctactggcggcagagccaactaattgatcggccagtgatttctccaagtttgatcaaattttcaatttttgttgtctttcgtgctgctgtttcattcacaaatttacggcaggtggacaaagccaaaatttggccaaaaaagaaaagggctgggatttgtatggccaaatggatgtaataataaagtattattgtggaattgagaatctgtggaggaaaattatataaggatatattttattataaaaatttaataaaaaaggaaaaattttttcaaaaatgaggaaaaattatagccaataaaaaattaaaggtaaattccgggaacgattgaatttttttt

SEQ ID NO: 32681 - DNA, 825 bp, Heterodera glycines
attttcatttgctcctttttcaggtcccatttattttgccacccaaaataacttcaaagtgccgtttttcttttgcttttccatttgccatttcccttctctctcctcagattcaactcacttcgctttgcatggcaatcgcattgagcggaacggtggcattggcctgttttttctgtccaaaagtttacatttgtctgttccaaccatacaaaaatgtgcgaacgcggagttcagcagtgggaaaattggtcaatcagcaaatgcgatttataaggtacagagggagcagagaatggcattggcaaaacggaccatggcacggcattaaggggggggggtaattggggtaattacgattgactccgtacctttgcctttttaataagtttttattctccccatttatccgtctttacctttgaatttgttacttttgtccacccaatccctttgttttcccctttcaaatatctttttaatatgtattatttccctttttctccttttaattttccagtcaaatcacaagtcccgtgaacgacgggcgaacggccacttctttggttgtcaacagcgaatacgcaggtgaattcagagttgtgatctataaattttgaaaatttcgaatggtcattaaagctaaaaacgggtccaaatataaataaatactcaaaataaatactcaaatgtccgttttgttttgctggtaaaaatcagaaataaaaaattgtgttatcattgtcaactcatttaatcatctctccccccttttggtgtgggcttaatgaaataaatattctgtgaaaatttcccaattttttt

SEQ ID NO: 32682 - DNA, 484 bp, Heterodera glycines
tttctttttttcttcttccgctttctttttctttttcggttcctccttctttttctcttcctcctttttccttttctcctctttctcttccgctttctttttctcatcttctgttttctttttctcttcctccttttccttttctcctctttctcttccgttttctttttcccctcttccattttctttttatcttcaaccttctttttttcttcttccgttttctttttttcttcttccgctttctttttctttttcggttcctccttctttttctcttcctcctttttccttttctcctctttctcttccgctttctttttctcatcttctgttttctttttctcttcctcctttttccttttctcctctttctcttccgttatctttttcacctcattccattttctttttatactacaaccttcaatttttttttcttccattttattattttcatcatcagctaaatttttctcttcaa

SEQ ID NO: 32683 - DNA, 787 bp, Heterodera glycines
ccggtttgtttgtctgggaccagagttacattaaagtaatataatttagactcatttttttttcacaattcttacagtataaagagaggtgagaagaaaagaaagacaagtatgtctttcttggtctctaattataagattttttcaattaattcatgtatattaaaaaaataattaatttaattaatcacattaaatatattaattacttatattattattttaaatccatttcttatctttatatccatttaattacttttcattaatatttgaagaaaaaataattaaataaaaatatataagaaaaaataattaatgtatttaaaaattaaaaaaacaacttataaaaagagacaaccaacttttaaaaaaaatgtcttataactaagcatggagagatttcaaattaaaatcttaaacacctttttgtgagtctcaagatcttataaattttttactcaaacataaatttcactttaagatcttaaatcattttttgtcccataagaaactcacagtctaataattttaaaataataattatatatttttttaattatatgcatcccctctttcaacttttttcccttccttcattgcccccaccctttctcctccttcattttttttttcctttccttctccaaccctctcctccctctcttggtagtttaaactgaaggcgggaaacgacaatctgatccccatcaagctagctcctgcaggccctgctcgagcggccgcccggggatcgatccccgatctagtaacatagatgacaccg

SEQ ID NO: 32684 - DNA, 859 bp, Heterodera glycines
  misc_feature (797)..(797): n is a, c, g, or t
aacactttgccacggtcttttgggcggagattgccaattgaaaatgcaaattgcctttgctggtgttttgttgttgtgccaaaaaagccaacgagcaatggcactagcaaattgtgaaggtggcagcagaccctcccctttcacgatggtgtcccctgctgctgatgtgcccaaatttgggcgtggggatgcggtatacggtaataggaaaagcggaaacggaagggaaaaaaaacaaaaacaaatattcaaaaattgataaaaacggccaaatgtgtaatcagcagcagcagcaataacccgataattagtgcatccaatgtgatgaattggattcataatgaaaagtgtggggggcgggaggattttcgtcatcactgtgtaatgagcaaaaaatgtggaaaagattatggaagcaaagcaagaaaaggaaacggtgaatcgagaaaaaaaggaacagaaaaggggaggaaaaggaaaaagggagggaagagaggaggggaagagagaggagggaggaaaaggaaaaagggaaggaagagaggaggggaagagagaggagggaggaaaaggaaaaagggagggaagagaggaggggaagagagaggagggaggaaaaggaaaaagggagggaagagaggaggggaagagagaggagggaggaaaaggaaaaagggagggaagagaggaggggaagagagaggagggaggaaaggaaaaagggaagtaagagaggaggggaaggggagggtgtgaagggaatggaggtagacattaattgctcatttttcctcgcnggggtagccaatgcttcttcttccttcccccatttcttcttattctcttccctccatttgct

SEQ ID NO: 32685 - DNA, 865 bp, Heterodera glycines
gagaatgcaagagatagtggatagagtgagggggagatagagagaaaggaggagagagagagagatggggaaagagagggggagaggggagagaaagaggagaagagagagagaggggagagaaaagtgggaagagagatggggggatagagagtgagggggagagagagagaagggagtagagacagaggggagagagagagggatagagaggggagagaaagaggtgagagaggaggagagagagagggggagagagaaggatgggaagagagagagaaggatggaagagagagagggagagagaagcatgggaagagagaggggggatagagagagatggatagagtgagggagagagaagggatgagagtgagagagaggggagagagagagagagaaggatcgtaagagagagaaggagagaaaaggacggaagagagagaagggagagaggggaggagacatagagagagagaggggaggagagagaagtgagagagagaagaaaaagagagatatagaagggaaatagagagagagagacagaagggagagagacaagagagaaaggagatagagagaagaaagagagagaagggagatagagagaagagagacagagagaagagagagaggagggagagagagaagagaaagagcagggagagagagaggagatagagagagagaagggagagagagagaagggagagagagaaggggggagagagaagagagaggtggagagaaagaggaactgaaagaaaagaggaaatagaaagagaaaagactggaaaaaatccccgaaaaaaatcattttttaaaaaactttctcgtgaatgttgatttattaaatttttat

SEQ ID NO: 32686 - DNA, 652 bp, Heterodera glycines
gagagagagacagggagagagagaaagagagagagagatagagagagggagagagagaaagctagagagagggagagagagaaagatagagagagaaatagagagagacggagagagagaaagatagagagagaaagagagagtgagagaaagagagagagagagagaaagatagagagagaaagagagagaggagaaaggaggggagagttgagacagagaaaggagagagagagagaagaggggtgggatagggagagagacaggggaaggtgcccaatgagtcaaatcctttaataggagaagcacctggggaaagtgccgattctttttttgcgcgagtggagaagaacacaggagcgaaggtattctaaaaaatgacgacaaaccaaaatgaaatacagatttgttggccttcaaaattgaaaattcgagcgaaaactaaaaaaggtgagggcagggaaattaataagtggacggactaataggcaaagttcagacccttttgtgaaagtgatcggcacgtcccaaagcgttcaaagggcgacgcaagcgattgaagaaaaacttagagcgaaggtcgtttttgccgcttttgaatatcaatggctgtcccgtccgctttccaaaagagcgccgtctttctgaagat

SEQ ID NO: 32687 - DNA, 1018 bp, Heterodera glycines
  misc_feature (823)..(823): n is a, c, g, or t
  misc_feature (867)..(867): n is a, c, g, or t
  misc_feature (891)..(891): n is a, c, g, or t
  misc_feature (968)..(968): n is a, c, g, or t
  misc_feature (970)..(971): n is a, c, g, or t
cgcagctgggaagcggaacaaacgcgcgggtattttattttccaaaattcccaattttcggtatcatataaaatgatttaattaattttaattttttttgtaaaattagagacatttaggcagtgttgaccgctatgggacttcaaccgttggcaatcatggcattattggcaccaaaattgatggcgactgtgccaatggaagcccaaaaatgttgcatcggcgctcatcagactcgcggcttaacgcctttctgcgaggggaattagcgtaagtttggtatttccaacagtaactatttgatactgtaaaaataatatccctttatttttaatccaggcccagcattgtgcccgacttttgtgacacttcagtgtttaagacaattgttgagcgggcgagaaaggtgtgcgaaatttacctgtcataaggctattagcaaaataataaaaataataagccgactaataaatataatgttgatatttcttaataaaaattaaaaaaagtttctgatttttaacaaaaaaaaaagctccaaagaagcttaaattaagagttttattttttgtttgaggctatttttattttcttcaatttgtaagaaattatttttaattttattttccgtttttagaaaatttaagtgtcaaaatgatttataaagcatgtgctatgtttaaggcgccaaagaagccgcacaatgacaggttcagcaatttgagaacactacaacaactcaagggaatcatgtccaaaaagaagcagctttctaataagccaagttcggtaagaataatcgcaaaaaaacattattaattanaattattgaaaaaattataattaataattaaattaataattaanacacataataaaaaacatatttanaatgcccaaaaaggaaaaaatcagtaaatattttccgaaaggaatggttcataatgtcttccgcttttatattcttnannatcattttcatccgctaaaactttcccggatatgttactttttgcta

SEQ ID NO: 32688 - DNA, 814 bp, Heterodera glycines
tatcgccagtcactcatcaagcattaaaaatgagagaattgtaaaaaaaacaactttaatgaaaatgagatttttgaaacattttactgactttatgacctcccgccgctgctcattttggggttggagccgcgccggcttttggcgcggcgaccggcgcatggacagcggcggcagcgccagcggcctctgctggcgcgccgttgtcgccgtagcggtcgctgcgccgggcgttggcgactggcgatagaagccgccggcggcggacggcaagcgctgagcggtgctgcagccgctgccgctgacgccgcgaccgatggcgcggcgccgccaccgcagccgccgcccatcgtcgaccaattttccatcgaccgacttttttgagtaggcggcgcccgcgtcgcccaggcggcaggcgcgccggaattccttggtcttacttgataaactcattataacaaagttttttaatacagttcaaaaaaaattaacaattttctgatcgacaaggaaatttgtaaaaaacattttatgaaaatgccaaaatcaatttgatcaaatcgcagccattcctcggatagacaaaacgcacaaaaattctttgctgataacaggcagaaactgttcatggttgccattgaaaaaggcacgcaatttgtcaacattcaaaaagtaattctaaaaattaatttaaaattgaaaataatttaaaatatttgaaaattaaatcactttcaaattgtcgagtccgaagcgttcaatcagaaggaaacggtcgatcagtggaatttccacgcaattgatcagatgcgtt

SEQ ID NO: 32689 - DNA, 257 bp, Heterodera glycines
agagagagagagaagagagggagaagagagagagagaggggaaagagaaagggggagagaggaagagagagagaaaggggaaagagagaggggagaaagagaaagggggagagagggagagagagagagagaaggagagagagggagagagaaaagggaaagagagagagagaggaagagagagagaagagagagagagagaaaggaagagagagaagagagggagaagagagagagagagggagaagagagagaga

SEQ ID NO: 32690 - DNA, 137 bp, Heterodera glycines
cagcttgatgcctgaggtcccctggggccagaaacacccggccatcgccataagctggcggcgacactgggaccaggtgatcccgttcttcgcctttcccgagggcgtccgccggatcatctacactacgaacgcca

SEQ ID NO: 32691 - DNA, 405 bp, Heterodera glycines
ttaatttaatttttttcattttttgtgtcattaaaaaataaaacatgttttagcggtgtgttttcacctcgacaaagtccgaaaaagcaattggtcagccttttattctgggcattgtccgctgctcgtggtcagttttaatcttaatttgcgttttgccaccacaaatagcgtcatcctttcccatttgttgtatttttctttattgccaataaaaatgccactaattgggtcagttaaaatattaattgcctttcctttgtgccaattgtttcttacatgcattcggttcctttatttgtttaaactttgctatttactttactttatttgtgtatttaatgctttgttgggattaatttttctcagattttaattaaaattttcaacgggtcttcccctccc

SEQ ID NO: 32692 - DNA, 825 bp, Heterodera glycines
  misc_feature (668)..(668): n is a, c, g, or t
gaacttttagtacatactctctgaatgagctgagaaataatatatattttttcaaggtcatgaaaatttcaagaatttttatatgggcccgacagtatgatatggtactttgggtataatttcctctaagcagcactagcttaacttcggaacttttaggacatactctctgaatgagctgagaaataatatatattttttcaaggtcatgaaaatttcaagaatttttatatgtgcacgacagtatgatatggtactttgggtataatttcctctaagcagcacaagcttaacttcggaacttttagtacatactctctgaatgagctgagaaataatatatattttttcaaggtcatgaaaaattcaagaatttttatatgtgcacgacagtatgatatggtactttgggtataatttcctctaagcagcacaagcttaacttcggaacttttagtacatactctctgaatgagctgagaaataatatatattttttcaaggtcatgaaaatttcaagaatttttatatgggcacgacagtatgatatggtactttgggtataatttcctctaagcagcactagcttaacttcggaacttttagtacatactctctgaatgagctgagaaataatatatattttttcaaggtcatgaaaattccangaatttttatatgggcacgagagtatgatatggtactttgggtataatttcctcttagcagcacaagcttaacttcggaacttttagtacatactctgtgaaccagctgaaaaataatatatatttttttcaaggtcctgaaaattttcaagaattt

SEQ ID NO: 32693 - DNA, 907 bp, Heterodera glycines
  misc_feature (891)..(891): n is a, c, g, or t
ggctaactagcgcactagcgctacaccacttgtcgatgcgatgaactgaaataattatttcttttatttaatttaaaaactttggcattttttatctcggcacaggggtccatttggcagaaatagaagacatttttcttaagaatacaggaatgctctatctacccaagaaatctcaatcacggacactttgccaactccctttgtgagttatacgtcggcgctgattttgcaattattattttcctgattaaattgtaattttaaattaatttatcgtttatattaaaacgtataattgtgaaaattttaataataatttctaataattataatattttaataatattttattatattttataattttaaaatttgttgaaagaatataatatcaccttaataaacttatatttgaccagtgatttcttctgagtctgaaggccaatgtcgagtttaaattgtatttttattagttattttaaggtagattatttaattcattaattcggtataaattcgtcatgatattttattttttaagtgctaactttgttattcgaatttaaattttaagtttaataattttattgttattttttcttgaatactttcattttaatttccttaatatatttttaattaaataatctttacagccttttcttagtctcgtttgccagttaatatttttaaaaaagaaaaatttttatgatgactttaaatgtataaaatagctaaatattttaattataaattatttgaaattaactttaaattgacattgctcctcataatgccaccgaagttacaccaactcatgtattttttaattatagaatttcataatgtttgaatataatcatatgaaatattatacttaaatattanaccttaaaaattaatt

SEQ ID NO: 32694 - DNA, 826 bp, Heterodera glycines
gcgaattgtgcgggcgaccagcgcctcaagcacagggtcacggtcgtcgtgcagcaaatggacctcgtcgaagataatcaaactgaccaattgggtgtaggaacgttcgccacctaaaggagaaaaccaaattgaaaacgaaaaaaaggaagaaattcgtaccttttctcgtgatgatgtcgtatttttcgggtgtacagaccaccaattgggtgagcatgaactgctctttgctcatttgaacatcccccgtcatttccccaaccttaaccaaaatgtcaatataaataagacaagtctttacttattccaactcacagttattccgtacgcctcttccagccgttgcttgaaactgccaaccatttcttgaaccaatgaacgcattggtgcgacataaatgcatttaaactcgtcctttcggacagttccgtcctcattcatatgcttagacatctcccgaagaatgcacatcagtgcaacattggttttcccagcgccagtgggtgcacaaataagcaaatttccatcggtgtgaagcgccttttgactgatcactgattgaattcggttgagggttcggtagccctgaaaggccggacgagcccatttcggaaggtcttcaatttcgatgagtttctgaaaaagaaatatgctttatcataaacatcgataattcaattgaacctcattttcgccaaaaggttttggttttaatggcggaacataaatgctctcgtagcttttcttctgcgttctttgggaaccgtcgggcagcacacactttttgttgctcatcgtatgcgacccctgcgcaaatgccatg

SEQ ID NO: 32695 - DNA, 188 bp, Heterodera glycines
cagagttgatcaaagggattgaaatgaaacataatgctgctgatttgctttttcttttctttcaaattgcccacactccctcatctctttttctcacgcttccctttttttctctctccccccctctctctatctctcccccctctctctctctcttctctccctctctctccccctctctctctctc

SEQ ID NO: 32696 - DNA, 737 bp, Heterodera glycines
  misc_feature (498)..(498): n is a, c, g, or t
ctgtccgaaatgcgctaccgaatgatgaccgacaaatccctggaaccgatctcttcagagtttcctgacgccgcactttggaacaacgaaattgaccaattgaacaaagtgagagaggagggggaaaattgcatttttatgattaaaaagggacggaaagaaacgcaaagcaaagccaacgaaagcgacggaagtgccaattggtacggatcgccgtggatgttcgtcgagtgttacatgtacaggcgaattcggcagttctttcagcagagtcagtttctccgcgagttcgacccgttcaacgaagacaaagagaaaagttacaaagacaggtgaaaagcaattttacttaatcgtccagtcaaagaccataacacttggtcaatgcttacaattattttcgtatcaatcgaaagcttaaagtctataggctttttgtaaaactaaatctgcttaggctaatggttctagtcggttttatgcgtcccaatgaccatnacccagtttcttaggccataacttttttcttacttggtcaatacccatattcttggtaccaagcgaaagacaaaagtctcgagattttttaaatgcaagaaaagagcaaatactggcattaaaaaagaaattacaatgaaaaaaacgaaattcaacttttccgagcataatttttttgtctattgcatttagatataaataaagatatacaaaagcctctaatagacccttaagctttt

SEQ ID NO: 32697 - DNA, 641 bp, Heterodera glycines
ctctaattacccccccctcctctttaattgcttttaatgacccttcccccatttaccgctgggttctctcccccgtgttccattgtccttctctccgttttccctgtccggttttggcccctccccatggtccaatagtgggaatttgcccagccccgcgttttgtgccgggcccccgtcgtccccgcggggtcctttcgttccgtcgtctttcgtcggctctcttttccgtcccccgtcgttgtccaaccccggccatttcggtccttctcctaaagtgtggtgttgtgttccttcagccgcgtccctttccgtcgtcccttggcccaccgcgtccccctgggccgagtccgtcgttttgccaattcgtcggcggtggcattttcccggccccttccgttcctccgtctccgctccctttgcatttgtttgtttgtctttgacttttctccgcctcaattacccccttcgtgccaaatgctttccgtcacgcgtagtcccggcttgccctggtcgtgttccacgtgccgctgatagtactcgtagcgactgcggcgaaaggtcgggcggcgtacgcttcatctcaatgccgtcggcagcaaccttattagccattgttggttcactatttgttggcaccc

SEQ ID NO: 32698 - DNA, 1010 bp, Heterodera glycines
tgtagtcagtccttttcaatgccaattgttccccagtcaattcgttggtctgttcaaatggcacaacggagtaagcagaagaccaacgaaaccaaatgacgacaatgaaattagcaggggaagaagcattggcaaatgcctaaaatatggaaaaataaaagttttttgttaatgataagcaccgttttaaatgctgcacttttaaacgaccaattcccatcatcattgtccaacgcgcatttgaacatctttggcacatcgttttgaagtggcgtgaaaagccatttggccaacatttgtccattcgatgccgcggcactgtcatcgcatgggaattcggtgaagaaaccataggaataggcattgacaaagcgaagagatgggcaatcgttgagaattgacgggacgaattgtcgcaaacggcggaaacttctggaggacaattccaacacataaatgtttttcccgagcattggccaaatgttgtgcaaaatgcagtccaaaatgcggtcactggacgtaccgatattcgacgtatggatggccaaattaattggacaatttgaggtgaaaattgggccaaaacgtcggagaaaagcgatcacattgttgtcgatgtaactaaaatgaatgggaagtatgtctaatgtaatttagcatggattttactcgatctcaatgcattcaaatcggataactttgcgtggcatttcaatttgcggaattggtaatggtttccaatatttattgaaaaattctattttcttcgtgccattctctccaactttgcaaagaatttgaataaatttcagtgcccatttgcgggttttgaagtgttcgtcgacgtaaaagtcaaaacggtggctgatcattgcaatgccaaggccaagttgtgaaggcggaagcaaatcgaacacacaaagccaacagtcggcggagatgaaactgaaaaattaaattaatcaaattaatggtaagttttatttgtatttttacattttcttttttcg

SEQ ID NO: 32699 - DNA, 1096 bp, Heterodera glycines
cagtttcactttcgccctctctttctttctcacctttttctctctttctctcactctttttccctcactcactcctctctctttctccccctttatttcacttttctttctccgggcctcactatctctatctctcttctcctcgaaacaaaacttgcgaaaactttttcggcccttttgaaaataattaattaattttaataaataaataaatacatacataatttattcgattttcctacagaatctcagtttggaatgggcccataacagcttgcaattgtcaatatctttaaatgcactcggcattttgtattggtttagaacgggtggagctgactatttcaatgatttttgtacaattttatcaaagacaattggacaaaatgtaaaaattaatttttattattttattttaaagttcttaaaattttatgggaatttttgtcattaaattaatcattttaattagacatcgatctttttgaaaaagcctggacctggacctggattccatattggacctggatttcctggacaaaaatccaaggtccaagaaaaacccagtttgccgaaaaatggctctggacccaggaaaaaacccaggcctggatccaggtctaggtcgatctctaattttaatgttattgtttgtatttataaaccaaaacaaaaagaattaattatgggtagaaaaacgaattttccttacttcttattaattaattaaaaccacaaataattaaacaataattttttttccaattttagggagtgccaacaatttcgacgtgttcaaaaatttgtgcctatattttggctttcatttgcatgttcacctgttccatttgggcatttcgccaagtgttgcaaattgaaatggacaaaatgtccatgccaattccattggatcgtatgttgagaagcatttgtcagaaatgtgggcatattataatacctattatgattgatataaaaaatgtgacattgccatttttagggattttaaatgaaaaaatgaaaaattttaggtaatattttaaagattttttttatagtgatgaaagaaattttttaaaataatttcgatataaaa

SEQ ID NO: 32700 - DNA, 121 bp, Heterodera glycines
ccttcaagatggctgttggctttaaccacagcgcctttgcgcagggtagtgttcttgattacgcagttcgggccaatcaccacgtcgtcttcgatgaccacacggccttcgagaataacgt

SEQ ID NO: 32701 - DNA, 124 bp, Heterodera glycines
aatttggatgccggacagcttttttcaggcaataaaaaatatggtggtaaatttttcaaaattcccaaaattttagaatgaaaaaatggcaagaaaacatgaaattgacaagccaaatgtgctt

SEQ ID NO: 32702 - DNA, 848 bp, Heterodera glycines
acttgtaaaccatttttaacaaattcaaaattgaccactttgcatatagtgggcactttttcgcctatcttttccttttaaaatttatggcattctttttttgcaaaataaaattttcaaaatttcttcagccgtcgctcagcgtcccacgacccgaagggaaaaagcgcaatatctcagaaccgtgccaccggcagcaacaacaaattgttgctgttgcggagttgtgaacagttggacgaaagcaaccgaatacgcacttgtccagtgcccagaaaaaggatgcacagtacgggggattttgcaaattttagacgaaatttttcaattaaatccggcaaaaatcacccatttttgggtatattttttaaattttggacaggatttgtcactcaataaatcctctaagaaagttggcaagttggcgccgattttgattttttataacttcacagaagcaacccaaattaattgtgtcattcgtttccaatttttcaaaaatttaatttgtccaaaaagttaagctaacaaaaactggagttcaaatgaactttaaataatgtctaatccgagattatcgctgactttttaaatttttgcttcaaaggctttttacttccgcagtttaaggagagatttcttaatggatattatcattgaagtttcaaaatacaataaaaattagcttttttcaaatagtgaaaatcgcttttcatcattttctttgctggcccggagaaacgcttaatttaaattgcttgcaaaattgcaaaaattaccacccttttaacagtgaatctcaccggactgccaagggcccaggttggagctggacgccgtctcttcaa

SEQ ID NO: 32703 - DNA, 772 bp, Heterodera glycines
cccgctcaggtgatgatgtcgaacccccagttgctccaagcgtcgcccaaacccgtcgcgctcagtggcaggcgaaagtgatcatgatcaatgtgtcgaccgactgaactttctctgccccactcgcgatgacgtcattcgcccgtgcatatcttttgcatttcatttgccatctccgctcatttccctccttctcaacaaatggaatttctgtcttgtttcctctctctgtccccgcaaatttgttcaaatttacttacttaaatgcctaaactctattgctgctcgtaatgacagccaaccaactcattcattcattgccactaacttttgtctctgtgtgtgcacactcttttgtttttgtttcgctgtttgcctaaacactttaaactcgcgcgctgaaaacggtccgtccccccccgggggggggggggcgaagggtcggcgccgagaaaaaaagcaacggcttttcgcaacacaatttccggcccattcaaagccattgaaacacatgtatattaaaagcaagtactgttttcaaaaagattaatatttcaatgcaatttgaattttctaagtccccccccccattcatttcatgttttgtcgttcgttttcccccatttctctctgttcaattgtgaaatgtttttccgtctcttctgctctgcttttgcaggttttttctgtgatgcgcttatgagttctttcttgccactctgatcggacaccctgttcgttcgcatataaataaaaaatatctctccatttt

SEQ ID NO: 32704 - DNA, 732 bp, Heterodera glycines
  misc_feature (583)..(583): n is a, c, g, or t
  misc_feature (586)..(586): n is a, c, g, or t
aaaaatggtttagatgattttttattagtgaagtatcgacttttagtttgtttccctatatgtaagacattttaggaccaaaaatgagaaattggaaaatttaaattttcgactttttgctcgaattcgagtccgaggttcgacataggtcgaaattaatgcaagattcggattcaccggcccttatattgtataaaaacccgggattgtcaattgattggactcataaagtgcattagagccggggaaaattcttgaaaaatttcaaaatttttgttgaattttttaagcatttgtcagcgcataaactcattttggcatcatcttccgaagtttttgaggcaatgttccgttttgatgaacaaaatgaaacccgtccaccggctaaaaaggtcgcaaaaattgcaaattctgatactgatgcgactccaagaggtccgattttaattgaattcttcaaaattttcacaaattacttagaattcccaaaatgtataaaatttttacatattttcatgcctaaagtaccattcagaattatttacatacaaaaaaaaaattttatagtgaataataaattatntanggttactttccggtgtttggctaccccccataaaaatgtcatgatcccgataaaggaaaactctttcttgggtagttttaggcgctgatcaagaatctggcatcagaacttcaaaaatctttgattttgttcatgattttcatcat

SEQ ID NO: 32705 - DNA, 938 bp, Heterodera glycines
tcatgtttgatggtacctgaaagacgagaaagggcattgtaaagatgcgcttctcgcggaacactgcatacgtcagactaccgtatacgccaacagcaaaagaggccaaaatcctgtttgaaattcaagaaacatttctgtataaaaaccggtattgcttagtattacggtattgtttagaaaacgacagttccgttttctttattctgcgctttaccatgaataaatgatcactgttgaagtgcgcccgaacgagtagagaaggttgatcacaataccaacgatcagcgcaatggaaacgacacgggcggcggtctaaaaggcacaaattggaaaacctgaaaaatttataacgcaatttttttttgaaaatcggacccgtatgtgcaatttcttaaagcagcaataatattttgggctgctttcatcgaacggaggcgaagtggtggacatttgttgcgcgaccattttcatcagtcaacaaaaaatatatgcccaaaaatggcacttttcactttagaagggaaaatatataaattaaattgaaaaaattaattatttttttttttgaataaaaaattcaaaaattttcaaaaacaaacaaaattggaagattaataatttgaaaaaataatttaacgctctaagctaaagaacgacccggagacttttccaaaatattttccgcaaacatttgaatatatattttttgtttgttttatgctcataatacaaatagtcaacacatttcaaggccgcaacttttgaatgggaatttgaaaaacattggcaaaatttttacattttttaaataattaatttcatttaatatatttcaaatttttggagagagagaaagctggtgaaatggtggggttgatgagcttctgctgccccctgacatgaatatggggcggtacgtgggggggggggggggg

SEQ ID NO: 32706 - DNA, 481 bp, Heterodera glycines
tgttttgtaatcttttttcgttcgtttgatttgtcgtgtgtgcacaaaaagtgactcactttcgggtaacatgccaatctccaggcaccgcttcatctgaacaatggacgcattacgcggcattccccgcacaaaaccatggccaactcacccgacaatttcggcacattttgcgatatccttgcgctgaaagcgaattgcttctttcagatggaactgtctgccctttctttatcatcccaaaaattactattccatcgctcaggatgacacatcgtctgggatcgtttgcaaatgtatcgcttttggacactaatcgaacgacggaaaaaagccgcgcaagcggcgcacgtacgattaccgaaatggagtccatttgaaggaaccaaataacagaccaaaaatgatgtcaattggtcaaatggaaggataaacaatttataatatttaaaaggcggcaaaaaaggcaacgaccgacaac

SEQ ID NO: 32707 - DNA, 424 bp, Heterodera glycines
ggggggggtgggatttcttccccaatccccgacttttctctcaccgatcatcgggaagcaatccggtttttaaattgaaattgaaatgccaaaattaaataattatttaaccattgcgtaccgttaaggcgctgagaagacggacaagcagtgcgcaaagcctaagagaaagcagtggcggcggaatgcttttcgagaatcggacagaaacattttcatcaaacattggccggacgaagaaaaacacgaaaagtcgaaatcgacaacttttcaacagtgaagaacggagaaaattgagatcatcaacggatgaagcgagaaaagatgatgaaaaatgatgaagagatgaagatgaaactattgtaattgtaaatatcatattaattatattactgtcacattgggatagtacattgatcctcgg

SEQ ID NO: 32708 - DNA, 943 bp, Heterodera glycines
attgtcgagattaaagacatagacaagttttgaagaggtggaaagtgaatgggaaattgagagagaggcatgagagagagagagttgatgggatggcgcaggccttgttaaattaattaattcaaattcactccagctgcagatgccaccaacaatggcattttctccgtaggaaaaatgccatggcgcagacattccgttctattaaaatctggcaaaatcatgcgcaaacaaacacatacagcgcgacaaggaagcactttttaattttaatttaaatttctgtgccaatgattcttaaacaaccctaagggcatttgtaccgtatattttttgaatgataatacagtagacgtggctaattaaatgctttaaaaacaattaaggaaatgtgagaaggatgaacagcagaataatgacgaacagaaaaatcacgatgatttataacaactgttattaaaatccttcttctatgatgataatgtccaacaacaaatttgtgccattactaccgtatgcaccaaacgacagtagtgccacggaccacaacaacaacaattacagtatccatttcacggcggcgccttcttcaccaattgttgccctcccggaacagttgcctttcccaattgtgctcatcctctccgtgccggccatgctgatcattttgctcaccatttttggcaatttgctcgtcctgtttttcaaggcgcgcgtcgggcgcacaaacaccacactgttggtgtggaatttggggctcaccgacttcatggtgggcatcctggtgttgccgatgggcgcctattatttgctcaaccgacgctggatttttgggccaatgctgtgccggatttgggtgagagcagcaggtcccccaaaaacggaaaatgtggaatatacatgaaaaaagggggggggggccgaccaaagggggggggggggg

SEQ ID NO: 32709 - DNA, 931 bp, Heterodera glycines
  misc_feature (840)..(840): n is a, c, g, or t
tgaggtagtgggaattgggggccaggaacttcttcacgcgctctggctcccaccacggcagcggcgagtgctgctgccactgatgtttctgttgttgcttctgctgctgtggtggcggttgctgttgcccgttgctgctgctccccgctcctttggcctcctccgacggcgccgtcgtcgttgctcctcctcctccgtcttctcctcccccatcattttgttgctgttgcggtggctcattttgaacactgtcgtcgccgccactgccgtcgacgatgacggcacttttttcctcagcctccttttcatttatttgctgttgctggtgttcccggggcagcatttttccttaatttagacaaattttcaaatgccagcgatttcgcgttattgggctcggcaagcgacacgacacgtgagaacgacacgaaactccgaactccacaaagaattgaacaaatgatttttggaacaaattttgaaaacatacaaatattccacagaaaagttttgaaaaactttagaaaaccgttttgatttttttttatttcggggggggggggggacgagctgttgtccagacacaaagccaaactaattaaagttgcttgtcatgatctctaaaatttgaacatactttgttgttgtcctacagttccatggtaaggcgatgggctgctgctgttactgtcgcccactgctgctgctggcgtcagatcggtgtgtgtgcggagcacgcgcaacagtgtgtccagccgggcgtagtcgtcgtagagacggtagcgcgggaagccgtcctgccacagggcaatcaccggcgttgacgaaatgccgtagtgngagatcagactgaaatgggggacgcggatggcatgacttttgccaatttaaaacgaaattaaaaatataattccccaatttttttccattt

SEQ ID NO: 32710 - DNA, 854 bp, Heterodera glycines
gggactgccccgaaaacaaaaaaatcgattttttcaagtgtccgtttggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatgggaagctattcccgaaggattcggtctccccataaatctgggcgcatcggttcggggggactgccccgaaaacaaaaaaatctattttttctagtgtgcgcttgggggactctcacaattatggggagcgaaaatccaacgcagaattaaagtacaggctatagggaagctattcccgaaggattcggtctccccataaatctgggcgcatctggtcggggggactgccccgaaaacaaaaaaatatattttttttagtgtgcgtgtggggtactctaacaattatggggagcgaaaatccaccgcagaattacagtacaggctatatggaagatattcccgaaggattctgtctccccaagatctgggcgcatctggtcgggggggctgccccgaaaacaaaaaaatcaattttttt

SEQ ID NO: 32711 - DNA, 107 bp, Heterodera glycines
ctttgcctccgtctccgtccctttccgtttggtgcgctcgttttccttcgcgtttgcccttcgccgacgatcactttcttccgacaacagcagcaaactcccaaatt

SEQ ID NO: 32712 - DNA, 955 bp, Heterodera glycines
aaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaaatttttaatttattctctatgccagaaaatggttatctcttttttgcgagaaatttgtaccata

SEQ ID NO: 32713 - DNA, 652 bp, Heterodera glycines
atttgtcgcgttccaaaatttcgcacaacattttttggtcaatttgcaaaaatcccttcgattcgatcaaagtgtcggcattctcgtcaatgtacaataaacaatggtaggcaaaattctaaatttgaaagaaaataaagtattaaaaaaaattggctcttgattgagaataaaaataagtgaaaaaaggaacattatggaaaaaaatcgatgcgataatttccacttttaaacacaatttggaaatatcaagttaaattgagagaagtttttctctcaaatttccttactatttttctcttctctgcccgccgctaaaaatggtagcagcgacgagtcagagaagagaaaatagtaaggaaattgaagagaaaattttatttttttattcaaaacaatttagtgattaaaaaaagattcggacttatttaaaaataaatttgtaacatttttaaattaaaaaaaatttactgcattccacattgaatttcttcagggatttgcaattcgtcgcgttccaaaatttcgcacaacattttttggtcaatttgcaaaaatccatccgatttgatcaaagtgtcggcattttcgtcaatgtaaaataaacaatggcaggcaaaattctaaatttgaatgaaaataaagtattaaa

SEQ ID NO: 32714 - DNA, 985 bp, Heterodera glycines
  misc_feature (900)..(900): n is a, c, g, or t
  misc_feature (920)..(921): n is a, c, g, or t
  misc_feature (974)..(975): n is a, c, g, or t
ttatattaataaaattaaaaaagagaattgccaactgcccttgtttcttccactcaggtatacatgagaatccgatcaatgtcggacggactaaccaattgaaaatcctaccgtttctaaacagttcaacattgattatttgggcacggcaggatgggcaattattgtgctttttaatcctgtgaaaacaggcaaaatattaaagaaaatattttaccaagtttcgttaccattcatcaacgcattccgagtggaattggtgctaaataaattaaggtttatgcattccatgtgatatttttggctaaacaaagatatttaaaactattactagaagaaaatattgtatctcaatgcggatttggcttaattttctttataaatgattgattgatttttttgaatagatttgatcattttacacccctaaatcaaagttttttgcaactatttttccacttttaacatctatttgagattttagaacctaaataatttacagtttcttatttattcagctaaaaaattccaaatcgcatacctcacacggcaatgtgcgaaccttatccccgatttcataagctcctaggcatattgcgcaaccgccatcatcatcattttcaactgtatgctctgtaattctgctgattgcttttgtaactgaaaaaataaataaaaacttattgggtaaataaataatcaattttgaaacattcaatgaattcaattttaaataataattaaatcgattttattccattttgatacccttgtactgtttgaatttggaccaggcatttttggccaacgaagtcgggtccaatcttctgttgaccagccatgtgtggattttatccattatatagccaagtagacaagcaatatcaaaataatgcatanaactaaggctagaattccanntagagcacgtccaggtaataacgcttcttgcgcctcttcctttttatttttgnntgtcagctga

SEQ ID NO: 32715 - DNA, 1025 bp, Heterodera glycines
aattaaaactcaaataatttttttttgctgtaatttttcgagaatttactagtaaaataattgaaaataattgccgcgcaaatttcgcatttttataaaaatatttttaaatttgaatcaccaattagtcatttacgtatttcttcatcatctttgcaggcctactgtattgaccgtaactatggtggttggtcagcaaaatttattattattttgcatatattatgccgtttttctgatcaccaaaaaaaggtgtgttgatcatttgggatcggatgtttggcacatttgaggccgagcgcaaggatgatccgccggtgtacgggctgatccggccggaacggagcttcaaccagttgtggcttcaggtcgtccaactaatgggttttcaaatcgagaaattaggcatttaggtacttaaattccagtacaacagagtgggcattattttgtcagagtacttatattcaagtacaaaagggttcagtgcaaaggctagccatttgttcttagattccagtagctaatgatggccatttgccaatgtatacacttaggttccaatacaaaaggatggccaatttttcaagttacaagaacagaatgatgaacattttgctgccaatgcacttagttttttcagtacaacagagtggatattttgccaaattttgattcaaactgaaacctatttttgcctattttggcgttttgtccaaaatttgttaacaaaaatgcaataaaaacgaaaaatacattcctaagaatcgattttttggggattttaagaatacacccctaagaatcgacccaaaaatttctaaaaataaaccccctaagaaatgaaaaattttccaaaaattcatctacaaaatgtatttatttattttcttgaccagaatttatgctttaaaaactatttatctcaatactgacttggcctatttttttactttttgaatatttttttgtcatttttcccccctaaaaaagagtttttttttaaaggctattttccatttttt

SEQ ID NO: 32716 - DNA, 895 bp, Heterodera glycines
aaaactaaaaatgtaatataccaggtcaaaagctatttgatttaggcgacaaatcgggtacattacgtattctccacccccccccccccccacatcctgtcaaattttatcggaaaagtaaaaaaaaaattatgaaaaattctcaactgtgacaacagcaattggtttagactgaaccgagcacagcgcaagtttaagcagaagcaattggtgggacaacggcagagcattgtcaatgatggagatggcagtgaaaacgaaaaccacgacgaggacgacggacatggcattttggacgacattggcacgacaaaaaaggcaaaatcaataccgccaacacagcacaccgattccgacgacgaggaaggcaccgatgacaatgccaaaacggaagctgcagccaaacccaaagtgccgtggtccaatcggtgagtttgtttgttttcagtgcatcttccataatttttttgaatcctgaaatataacgatacatttttacaatccggccgcgtcagtaatttaaaacgggccaaaaaattcaggctcggtgcacaggcatgatacgggtttgctgtactgtttcaacttcatgcaccaatttggagcagtacaatgagcagaggagggtccctcaaattctttcatattttccctaaattctttcaatttttaataaatccttgcaaatcccttttttagtcaattgtccgcttctactgacgaccatcggctgggtgggcggtgatggccagcgaaaacaacgcgccgccgccagtggcaccggcgccgcccgcggggacgcctatttgagcgcgtacaaacgcgcgcagctcacctacgagcgcctgcaagcggagaaacgggcgcaacgccaacgcgcgcgcgaggaacgcga

SEQ ID NO: 32717 - DNA, 346 bp, Heterodera glycines
cggtaatagtaaagtttatcccccccccccctttttcaaaaatttttatttgttttcaaaagtcatgaaaacatgtttccatgggtttttggggtcgctgatcacgaatctggcacccatttcgaccaattccgaatcccggacccgaattgcaacaaaaagtcgaaaattcaaaatttcaattttaatttttagtctaaaaatggtttaaatgatctttaattgaagtactaatgactttaacttcgttttgatgtatttaaacaaattttgaaccaaaaattcgaaagttgaaaattgtgaattttcgactctttgttcgaattcggatccggggttcggaatt

SEQ ID NO: 32718 - DNA, 703 bp, Heterodera glycines
tgcgagaacagcttgaagtgcactatcgacgcatcgacgatctgatgaacgggagagagatgcctatggccggaaatacaattgaaaattcaatgggcttttgaagcctcggtactctgatatattctcgatgcttttatgaggtctccaaaaatttcctggaatttgtgatgaatccttgggattttttccacccccccccccttgtctactcttctttgtaatgcattattaacaaaaggggtacgaacatttgaccgatggcacaatgccatattttaaggctcctactcgatacctattctatttctcattgacaaagtctagacgatatgaatttgcaggagcacatgaacgaaaccgtgcgtgaactaaatgctcgcattgcggaattggaaactgccaacactgctttagcattgaaattcaggtggattaggattttctgaaaattgaaaaaacagaaattcttacatttttttttctcttttaccccacagggtttgatcaatcgccttcaacaactccaatcatcattgcttgaggcgaaacattttgcttggttcttggcgcacccgacttgttagaacttgagggatcaacagcaacagtttgttacggtacattaattgatacgaaaaaatggttatacgccacaaggatgaaggcgaactcgcaacaatttaattcccgaaattttttt

SEQ ID NO: 32719 - DNA, 339 bp, Heterodera glycines
acaaaatgtgttggttgttggacgttcatttgttcacttcaaattcacctcaccacacattcacacaatttatttaaccccaaccattttctcactcaaatttttttttttgtgtgaatttagacattttttccgccgtaaatttgcctcatttttttatttgtgtgtgtcgagtgagcaaagatcattctcgtcgtcgtatatcctttctttgcctcccccccaaccctcccaacttttgtccccttcccttaatttctcttcggaagaaagtgggaaggtgggggggggggggggggggaagggaggggtattgggggggggggatggtctttgtta

SEQ ID NO: 32720 - DNA, 698 bp, Heterodera glycines
aaaaagtcaaaaattcaaaaaatttcagaattcacttttatgtttgaatctgtgcagaatgataatttctaatgttgtaatggtttctatttaattttgctgttttaatctattttagaacataaaagtgaattctgaaattttttgaattttcgactttttgttcgatttcgagtccgggttcgatataggtcgaaatggatgccggattcgtaatcagcgaccctggaaagccctggaaatttggcatttttaaaaaaatttatttcagtgacgaaacgtcttgccaccagttttttcgtcttcgattaattctttcaatcttgttttacgtacaaaatcactatttcagaacacgcccttaaattataaaggtttcatttattcaagaagtcattcattttctcagcaaaaacttgaccagaaatttaatttgtccctaaattttccttctcctatggaccaacaaaataaaaaaatattaatgcagctgtgaagctatttttcgactttttaatgccacttttcggcttttatttttatatcagaaaaacatatttggtatttgcccttaattctttacctaaaaaagattttaaaagaaaaaaaattttttcggaaataaaaattaaattcttcattttattattttttttgttaatttatttgcatttaaacggcttaaatctcattaatga

SEQ ID NO: 32721 - DNA, 889 bp, Heterodera glycines
ttggccttattatcctttgacgccgaaaaaacaaaagaaaaaagagagagtttaaatcatcatttcctctctgtgggaggccaacggacatttctcccttctccctctttctcgtttccttctttttccctttctttcatttctccctctttctcatcccatttattcttttctcattgtttttcctttcccttctttttctcccccccccccccttttgccatcatcattcgtctttctcttctgttcttgaccaattcggctcgaaattcaattacgatcccttcggaaaacattcagtcaacaaaaggaggaagaagagagtgaaagggcaaagtccctttcccttcatttctctcccccccccccctccttttccccctcatttccctctcttttctctcttccttccctccttttttccctctttccctccccctcttgtccttttcttcccttctcccatctgtctcctctccttctccattcattcgcccacttcttcgtccttggcccattcaaatccctgtcccttgtcacttttctttcttaaggactcccccttcccattttctccccttcctctcctctcccccgtgtcaccccttccggcccccttttatccctcctttttctcctccccgtccatccgtcggcacctctctctccctctgtccctccgtccgtccgccccttcgctccgtcgcgcttcggcattttaaataagtttcgacaattgtgttgtcacacccgcccatcaacacaaacttgacttttcgccatgcccactaaaactaaacaaaaaacattttcccccgggggcagtgatttcaaaaatgagttttgggttttgttttgcatgctttctaatccatcccttcttttccct

SEQ ID NO: 32722 - DNA, 297 bp, Heterodera glycines
taagagccatcgacaataaaaaggattagttaaagtaagttggccgccacagtaaccacgattagccaaaattacgaagatgccgtaacaaagacttcatcaaattttcggcaatcggaattccgaaggcccaaaaatttcggcaatcggaattccgaaggcccaaaaatttcggcaatcggaattccgaaggcccaaaaatttcggcaatcggaattccgacacatccctgatacagacagaccgctattgtcaaacaatctctccagacatagacatagacacctttagttccgg

SEQ ID NO: 32723 - DNA, 1018 bp, Heterodera glycines
ctttgcatcgttttcttttgtttctcctttttatttgcttcttaatttaacaaaataaaagttcaaatgtctttggaaatttttgttgggctctgacggacgcttcggctaattaattatactgcaaaattttgtgtttaataaataaaagggaataatatttacttttaaattaattattaatgcatcatccatttttaatcttattttgcttaaaaaaatacaataattcacacaaaagcttttaaaattataaaatcattgaaaaaaacccaaaaatacatagaataatttgcacacagtccgggttcgaacctgacccatcccccctccgtgttaagacatttgcggcccggacatttgcggtccagacatttgcggcctgctgaaaatcggacattagcggaccgacctatgagttccgacatatgcgcctcgacatatgtggctacatctcgtaaaagacaactcatattccgacatataaagcttgatgctaatcctacgtttgcgaacgcctaagcctaaactaaagcttatgtctaatcctaaagcttcatcctaggcttaaccttatgacaccctgagcggaagaacaaaacctattctatactgaattttccactaccagacaaccacctatgccgtgtttcaagcagttgaattcgggcggaaaggatttggccctgatgccagattgagctggatctatttgccggaacctaaaaaagcgaaagaaatttcgccagattggatcgccaaacttatcaacattttaaaatacatttatcaatcgatcaaagattcgatgatcaatggcactaaatggacggaactgtggacagccaaagaaaaagaaatgaaaaagtgagcacgaacacaaatcagtcccccaccaaaaatatagagcccaaaaaaaacaattgaccaacagactaattaacagctttaaaaaaaatggccaaaaattttgaacaagaaaaaacaacccctaaaagggcacttattgatatatggg

SEQ ID NO: 32724 - DNA, 979 bp, Heterodera glycines
  misc_feature (913)..(914): n is a, c, g, or t
taactaactatccttagcattatgaataccagcaagacaccctttcccatattatttatcccattttctcccacactccgcttccttttgctggcatcacaaaacgacaaagttaaagtggctttttaatgagccttctcattcagagaagcattcattttgtatttattaaagggaaatcgcaaaagtcaaattgaaaggggggggggggaaagataatattttatgagaatgatgagtctaatgacaatgcaatgacattaaaaatatgctttgcttgcttctgtctatttgagatctttgctaaaatgggttggatggagaaattttttaaaattttctgtaatatttattttcttttttatttcaagcctcgcaatgctttaaattcgaccctggacaacttgaaacggtcccggattctccaatccctcatggtgtactttttaaatcacaaattcatttttacttcctctcatcgatctctttacgctaattggcaaaaagtgaggcaatttggtcaattttcagtaatctgtgacaaaagtgaattatgggcaggtaatttgttcattttctaacaaagtccttcgtctcgtctttgtgctctctttttttttaaatttcccattaaacacgcaccatttagcatatttcattggagattgatcacttccactaatgtgcaaatttgtgtccagtttctcacaaaacaatttttaatgggcgaatgttacaacgcttttgcaaattaagggggggagatttgaatttaaatgaaactaattaaaatcaaaggtcgcataagtttccttttttaaatatgcaatttgatttaactcaattcaattcaattcgacaccaaatgcttcttctctcatcgctctctttcatttgtcactgtccccttggnngcgtcccgcgaagtgccgtcccccgcgggccctttctgcccattctccagcaaagctgtttgccc

SEQ ID NO: 32725 - DNA, 110 bp, Heterodera glycines
aaattggtcagccaaggacaaaagcgaagggcgcacctcagccaaccgccgtacacgcgaatggtcgccttttcggggtcgtcccggtggcgaaggaatatctgaaagtg

SEQ ID NO: 32726 - DNA, 222 bp, Heterodera glycines
ggagcagagggatatgaagatgctgaccctcagggttacagtgatgtggccacaagccaaagaatgcccatagccagcggaagctgggagcaccaaagaccagatatcttttgagagcctctggaggaatcacagccttcctgataccctgatttcagcctagtgagagtcatttttggacgtctcacctccagaatcatcaaagaatcaatttctcttgtt

SEQ ID NO: 32727 - DNA, 926 bp, Heterodera glycines
atttaaaaggaaagatttttaacgagttttcacaattttatgtttttataaaacatttttccaaacaattttgatgtggttattttactttttttagaggaaactccagaacttcccaacattgaagagcccaatgcaattggtgcggcaaattcgatcgtggcacctccctccgacctgagtgatgtcgttgtggagcatgcggcaaattcgaacgtggcaccgccctcctcccagctgaatgctgtcgttgttttgccgcagtctcggaatcccggtagagtgaatagaagaaatgctaaattcttgaaacaaattaacatcagcagcgagcgacaaagtcgacgcaaaaccagtcacctcaagtggcctcgacttcggcgcaaatgccacgcaaaactgtgcagcctacgtctcgggtcccgtagagtgaattgaaaaatgcacaatttttaaagcaaataaacaacgaaagatgaatattttcgcggtaatagtttagatggtgccatcgtgatcagcgacctccgaaaccccataagacttgtttttattaatttaaaaaatttttgaattgtcaaaaatgtgtggtaccatctaaactattaccaaaatatagtttaattttatttatttgccaccaatttgttgcaattaatatatgcttcggtaaaaatttgtaggtctcccaaggacgactgcccaaaaaaaacaacgttcactctttctattttaacggtgacaacacttttctttgaaatcgatgaaaaaaattaaccgtttcatggtcaaattgaaatatagccgacatggaagttgtctgcagtacgtgcaaaacacccggacacactgctgtgaattgcgaccagctgaacccggacgtgtgaatggaaatgggaagaaataccgatcaaatgatgagagaa

SEQ ID NO: 32728 - DNA, 942 bp, Heterodera glycines
  misc_feature (890)..(890): n is a, c, g, or t
ctcaacgagttaaaaggtagaaaaatttattaaaatactaattttatttttaaaattttgatgagaataataagcagtaaaacgatgagttttcaaacttgtttttacatgtaatattttataaaaagccttttggtaaaaatgccgaaatcctatgattttgtactcaccgtgccattaaaccgcttgagaaattatgggatttttacttaacacttccgaagaattcgtgtttttaatctactcttagcaataaaatattacttttaaattattttatgcatttataataaataataaaaaataaaactaaattttacagaaacaatcagtcgtggaggaaagacgggagaagaaattgaaaaagcacttgttgaaatgtggaagcgattggaatcagatattccacgtgcggacaggcaatgttctaattctgtgattgattgagatttttgcatgaatattctcggttctttgtttgaagaaaactcattttccaacaagcatttgctttcatctttttttatggtttgatttttgtgcattttttgaccaaattcggcttctaaatattcttattcttaaattggcctctctttagttaactttgacccaaaccccgaaaacatcgggaatttttttatttgacccatctttcaaaaaatatcaattggttgttttttactggcacagatgcatcttaaatgctgttgtggacggcgaggaatggaaacgcgatgaagtctttggcactgtggaatttttcaagaatcaacttttgataatggtaaataaagagtgagattttggcaagcttttcataaaacaaaaaacagaaatttattttgacttattttatgacatttcatgactttttcactttccgtacnccacctctgctgggcacctcctctgtgagcttgtcttaactctaaatccttc

SEQ ID NO: 32729 - DNA, 79 bp, Heterodera glycines
aggaagtggtttccactgacttcgttggctcgcgtcacgccggtgtggtcgatgccgaagctaccatctgcaacgataa

SEQ ID NO: 32730 - DNA, 893 bp, Heterodera glycines
cttaaatttaaacttttaatttttattttttaaatttatttatttttcaaaatgaccagtgattgccctcacaaatggacgaaggaaattgcttatgtttggggcaattctcagaaggattttgggttgcttgtttatatgtagaaaaagggaaatttatttaaaattttgtaaatatttaaaatttaatttaaatttttaaaaaaaagaagtgccaatggccataaaatgtttcttcgctcaatgcatatgtatcttcaaattttggcgggaatttacgagcaaaataatggacgaaaaagaaaagggaagggaaatggaggagaaaagggggagggcaacggctgtcgctaatttggccttttggccatcggactttggcggaatggccaatggacaaatggcggggggggggagaaacgggaggaaaagaaaaagggaaattaaattaaacaaataaaaaatggaaagtaaaattatatttaaataaaataaataaatttgtctttgtttttcatgtcaaaacaatgcacggattgctctgagacaacactcgtcacaattgctcattgtcagcagcagcagtcaatcgacagaacaaagtatgtcccaagggcataagaaaaattggaccgaaattaaatttctatggaatttgatggaaatatttaaaaaaaattgataaaagaaaagaaaaaggcttaaatgggagtgaattagccgaaggacaaaaagaaagcaaaaatcaaattaagaaaattacgttgtaaaagtctcaattaattaaaatcatcaagtaatctctcactgaataagcttcaaaagtggcataaattatgctttatgcttattgtttgttgtcggtttcgttttggttggctttgttttatttc

SEQ ID NO: 32731 - DNA, 713 bp, Heterodera glycines
aaaatgataacgaagttatcttttgaaaaatacattcctttatattgggaaattcattctgtgccaattgtaatttcatactatcggcgagagcaaaaactcatttacgcggataaagcaaatttataagacacatttatttaataaatttttaaaatatattctgaaaaccaacgaaatgaatggaaatcaatcgaatacggtaccataatctacagtagtatcttttcaaaattgtcctttatttccccttttctgcttctgtagttttactcgtccttcaatgactgtttcccctgttggcctctgattggctgtgcttttggcttcggattcatcgcaattttcggaatggcgatgaacacatccgtaatttacatcaccgtcaaaacaaagtgtctgctgtatttcaataataaattataaatttcctaattgccctttaatttgcttaatttccccctcattttttatttttaaattgttttttatgtctttgcgcgccaccgctaattatttgttggcactgacctccgcctttgaactccttcaccagcacggccactttctgttcgtcttcacggctttctcaggcataaatttcattgactaccgttcggccgttcgaattggcaccgtttcgctgttcggactgtttgcaacgaatacgacgattttttttacccgggattgaccgctttatttgcatcatt

SEQ ID NO: 32732 - DNA, 113 bp, Heterodera glycines
agaggtcggggaagctcagaccgcaggcgatgccgagggcaaggccaagtacgacttgcaggaaaatcgaacgcgagcaccatttgagcatgggaggagtctctgatcggtgt

SEQ ID NO: 32733 - DNA, 984 bp, Heterodera glycines
attttccatattattatatatttttaaattccgttaataattcgaaatgctttttttgctgctccttttttcctccgccccttttgcccttttgtttttgccgttggatatttttttcacccaaattgtgcccgcaaaagggggaaacggcggtgggaaggggggctgttatgtgagttaaaaaattaatttcattatttaaatgtgattattataagaaacgttgcccttttttgttgaataaatttaaggaatttgatttatttattttttataaattgattaatctctctaatttataagggatattgtgaaaagtttaatgcgttggaagatgacttggagaaaatgaagcaaataaaggcaaacgctgaatgttttgttgacgacatgggaaaagtcatcaaagggtttgagaagaaactgaacaaattgaggaccagcgtaacgaaattggaggaagaaaatgagagtttaaccggggattagcagggattaattaactaattgaagcgtttaactgggattaattaagcataaccttggctaattaaattaatcaaagggtatccttctgaaaagagacgcacaaacgatttatcatttcggaaaatattttttgattttcaatttaattttgtaagaattttttaaccaaaacttgtttttggtgttcctttaagggttcttttacggttgactttgctcttttaaaatacttcaaaaataaatttaaaaaattttagagaaaattgcgaaaaagattagagagttctaaacgacacaattcaaagaatgaaacgaattatgaggacgagagtatgttgttacataaaataataattatattaataataataattgtaatttaatattataaaatacataattaaagccttactctaatttagatgaaattcacgtcctttttctcctcatttttaaaaataaaacgtcacttttaagtgcacattgaacatttga

SEQ ID NO: 32734 - DNA, 1011 bp, Heterodera glycines
  misc_feature (932)..(932): n is a, c, g, or t
gaagggcggtcggcggtgtccttttgggttaatttggctcattaactgtccaccgacggatgaaagtgcgtccattggcggaaggcaccgcattaataaagaaggaaagtaagcgaatgaagcgaattgccctttttaaccatttaccaatgccattttcgttctctgtgcccccgcccccttctaaaaaaaacgccgcttaatcccaacggaagtcacaaatgggaaaagtctgctaaatgctggacatcctttacgcagcttcaaatttaaggaaattaggagacaattaaaaaattggagcatcgcaaataatcataaagaaaatgatgaatttgccaattcaatcggaaggacttttttattaatggcataagcaaagacattaataattaaggagggggagagaagggaagggaactgaatgttcttgcggggatcacctgcttcggggaaaacgttaattagtgtgccaaaagcacaacatttgccattgtgtgaagaaaatgccaatggaatgtgaaaaacaattcgaatgtattgggaaaggtcagatgcttcacagtccgctcttcgtcagaccaacttcacgaacttcgccgggaaccaaccacttctgtatggagggtgggagtgagtgagtgccttttgcggtgcgttcgcggaagctcacctcactccgtccgtgctccgtcccaacacccatcccctcgttccgctcttcaccagcaacactctctccccgatcgccaaactcagttggttgtccccttgggcactgaatggcgtcgtgcattcgatcagtcggccgtagtccgtcggggcgaacattggcgaaactgcgcaaaagatggcacaattccattgacatgaacaaacgcactgcagcggtgcatggtgggccgtgctgttgctgcccaactgtctgactntcgccccgggcatggcactgcaccaatggggccgcactttgcccaccgccattgaaaaactgagttcgtcccacgctaa

SEQ ID NO: 32735 - DNA, 953 bp, Heterodera glycines
aatcagcttttttgaaaatagcacataaattttgctagcaaatgtacacaaatttgttcagagaatcggcaccaaatatacgcctttttgcaaaacaaattcttttcacgtatatacagcaaaaaaaattttatggtgaaattaaaaaatttccgataaggggcaaccaaaatcgattctgcgatatttacgaggactacagcacataccgagaatacgaaaattttgttacagcgaaatacaaacccgtcaaaaggggtttttcaaaaaaaccatcaaaataaaaaaaaattttgaagtgactttactcaaaagcaaccaaatttaattcttaatatcattcagtagccctaaatgttttctattatcctgcaaaatttctaaaagttccgtcaagtttcaagaaagttatgaccaaaaatgttcatgaaaatttgcttttttgattttctcaggttataacttttttgaaacttaatgaatttttttttgaaattttgtaagataaaagaaaacacttagagcttccgaattaccaaaattctaaaagttgttgccttttggcgaaagttttgaataattttctgtcaaaaattttccatttaatggtttttgacaaacgtcccagcaccttccaatatatggcaaattttacttttgatcgtataaattgtttttttctgacccggcctgaaaaccgaatcccgaaaccaaaaaaccagtactaggatttgcagagccccgagaagccgggaccggacctcgattggtgccgacaggtgccgctgggaaaatatttaactcacatgaagcgaatcgaactaagagaaagaagttgaaaagcaggaagactagccacttggccatttattatgaaaaattttcgtcaacatttttttgatgtttttttttttgagtacgccattttgatgatttttgagtaacgacccgca

SEQ ID NO: 32736 - DNA, 843 bp, Heterodera glycines
  misc_feature (730)..(730): n is a, c, g, or t
  misc_feature (757)..(757): n is a, c, g, or t
tttttccattgattgaaattttgaaaagaagaaattctgacggacggcacaatggcttcatgtgcatatgtaatttgattgatgatttttgactactcactgcttcttctgctccttttttggctgtttgagatgacaaatgagtccatgagagagggcagatgttttttgggggacggcttttgcccaaaataaagcttcatagttccaaatttttttttgtttttttttgtccatgagagagagcagatgttttttagggggggggggcggcttttcctcaaaataaagctttataattccaattttttttttgtattttttatccataaaagggcagatatttttttggagaatggcttttccccaaaataaattttctttatagttccaaatttttttgtatttttatccatgagagagggcagatgtttttgggggggacggcttttcctcaaataaagatttaaaatttacaattttttcaacaagtttttaaccactggggaagaatgtgtcccgagaaagcagtaatggttacgcaggccgctctcaaaatttccgaaattccaccctctcaaaaatggccagtcccggataaacagaattaaaaattgtggccggaagcatcaaaaacctacgaatatcattttaaatttcaaattaattcttttcttaatttataattaaattgtttaattaatttgagattgaataagcttacaaattntggaggaaaggacttaatttccattanaaaaacaatttgttactattagcgaaaagccaatctgtcagtaaatttgtaaaaaagggatgccatgactcatgacacttaaaaag

SEQ ID NO: 32737 - DNA, 83 bp, Heterodera glycines
cccttgcgggaactccagcggcaaaatccccatgccaatcaggttggagcggtggatacgctcgaaggactcggcaatcacca

SEQ ID NO: 32738 - DNA, 76 bp, Heterodera glycines
ctgccgctgctggcgggccgctacagccatctgcgcgcgcggagtggccgcgcccgtgccccgcccgccttcctct

SEQ ID NO: 32739 - DNA, 647 bp, Heterodera glycines
tgggatttttatgtgctaaaaatcctgaaatatgtaataaaatatgtgctaaaaaccccaaaatatgtgctaaaaaccaaaaaaaggcctaaatatgtgttaaaaaatgcaaaaatatgtgctaaaaattggaaaacccaagtgtatttacgcaaaaaaatcatatttaatatcagtctttatcaattttcgcccgacctccaatcaaaattttggcgatatcaatcaatttgtaaagtcctggattaatttttccatcagttgaataagttccttccgggaactttgaaatccagtgacgatttaacacagcgtttgatttggctgctttaggcatttaaatatataaagaaattttctaaatgcttaagaaacgtaaagtagtcaatttttagggtgcattttcagattttcttgtatttttcttacgatttttctcaaaaatgccaaaatatgtgccaaaactcccaaatgtgtgccatatgtttttatgtgccaaaacgccaaaatatgtgtttttatgtttttataagtcgctccaaatcaaaaattgtccggagagaatgctattgttgggcttctctcgccataactaagccgcaaaaaaaatatgttaaaacataaaaatcccagcccgagttatgacc

SEQ ID NO: 32740 - DNA, 544 bp, Heterodera glycines
actttcattaccaattttcccaattttcaattcccctcaaatcgctgctcaagtggtcggtcgttctgttgtcctttttgttcgcctccttctgaaaaggttttgccaattccttttcaaaattcgcttttcaattcgaatttattttgtataaaatgcgaatgaatcagccaaaaagtccgtccgtccattcattcattttcatatatttctcccacatttaaattttcttcctaattcctttttttgtaagcaaaaatatcgtggccctttgaaaaataattccgtgggaacagaaactcaacaaaataagcaagttcagaattgagaatgttttcaaagttggcaattgccttatttttcctttcttttgcaacgaattgccaaattatttggcctttgtttcatttgggaagaactcagtccgtcggggtacgcttttgccgtcgaagatgcttttctttttatgctttgttttaaattcacttttgggtcactggcaaattgctctgtaacagcgccccggccgcggaaaatctcgtca

SEQ ID NO: 32741 - DNA, 1067 bp, Heterodera glycines
  misc_feature (586)..(586): n is a, c, g, or t
  misc_feature (898)..(898): n is a, c, g, or t
  misc_feature (901)..(901): n is a, c, g, or t
tttttttttttttttttttagaaaaagaatttttgttggacatttttttttttttttttttttttttttttttttttttttataacaccaccccgcgggcggggagagggggggagggggcgcgcccccccttttttttttttttttttttttttttttttttttctttcccccctttttttttttttttttttgtgtggggggggggtgtgtgttgcttttttttttttttttttttttttttttttttggggggggggggggggggggggggagggggggggaggggccttttctttctttctttagtgggggggggggggggtgttttttttttttttttttttttttttttatttttcacctcgcgggggaggggggtgtttgtttttttttttgtttttttatcttttttttttttttttttcactattatattaaaaaaaaaaaaaaaaaataaaaaaaaggaggggggggggggggtgggggcggtggggggttttgtttttttttttttttttttttttttttttttttattttattgtgtgggtggggggggggttttgttttttattctttccccntttttttctttttttttataaaaaaaaaaaaaataaaaaaataaaaaataaataaattttttttttttttttttttttttttttttttttttttttttttttttttatttttatataaaaaaaataagaataaaaaatgtgggttggggtgggggggggtgtgggtggtgtggttttgttttttttttttttgtttttttattatttatttaagtaatatataaatgaatgttgttttttttttattttttttttttttatttttttttttttttattttttttttttttttttttttttttttgtttttgngtnagattatataataataatattatattatgaaatatagagtgatgagattatagttattatattattatttttatttttttttttttttttttttttttttttgttttttttttttttttttttttttttttttttttttttttttttttttttttttttttttttt

SEQ ID NO: 32742 - DNA, 952 bp, Heterodera glycines
tcatcaattttttttagccaacaaaattctcaaggtaaatttaattaacaaaatgtgcgcaggtgaaaggccaactaataatacgcaagtgattaatgtgctcaaaccgttcaagttattgggttaagaatcgactaattgcttgctttaatttaatatcgaaataagatttgtgcctaagggcgaatttttctggtgcacacaaatacgtcgccgggtttcaaccataacttttttttgttgttaactaaattaagcattattggtgtacaatagctatcattgatggaacaaattcactaaagcattaaaaacatttcccttccttcgcttttcggtaccaccagtcccaaatattttcatttcttaaaaaatttgtcaaaaataaattacttctttggcttcgaatggttaaggaatatactgggtcatcactagggctacgatttttagttgctaaaaacagccaaaatagttagtttttaggctctaaaaaccccaaaaataggtgctaaaaatggaattgctaaaaactttcaaatttagggggtgtaaaatggtaaaattttattcaaaaagcaaccaaatcagtattgagataaataattttaaaatcacaaattcttgtcaataaataagtaaataaattttggagatgaatttttgagaaaattttttatttattaggatgtattttcagaaatttttgggtcggttattagtagggactccatttttaggcaaatgcctaacatttttgcgcacttaatacgcacagataagcacgaaaaacgcattttccgcttggtttggggcgtctacgatgacttttataatgcctatttcggggtttttgtgcctaatgtgcctattttagggtttttgaaaaaatccttaacaaaaatgcaataaaaacaaaaaatacacccctaagaaatggcccgaaaaaatt

SEQ ID NO: 32743 - DNA, 797 bp, Heterodera glycines
cgggagctaccggtcgggattgtctcggaatcccgatctcggctttttttttgaaagtgtgtctggatcgggatcccgacaagtcgggacttgaatcccgaatctcggctctattatttccctgcctgatgccaatcccgaatcccgattttttccaaaatttcgggctctagaatttataataataaatattttttgactaattttcccgcacttcgcgctttgcccattcgtcgtagccccattgtgacttcaaataccttaaaaatggatggattagaaaatataataaacaattattaataaatttcttattttgcccctcacaattggcgcatgttccgcttgaacaggtcaaaggcccacgcggtgtccgcctcgtccagccgagtggcccaacgccattccaactgaagcggctcactaaaaggcggggggggggggtgtaaaagaggtcggggcgggggtcgacggcgaagaaagaaatgagggaaatttttgaaaattcgattttttcaaagaaatttcaagaatttgaaaaacctagcgatttttatttaaaaaaatttctgaaattttattaagaaaaatttactaatatgttttttttttgaaaaatttcagtttaagctcagaggggggaggtagaaaattttattttattaaaaaattgtcagaatcgctgatttatctcatttttatgaagtcactgttaacaaatttcatcccaaatttttgtgaattttccgacacctcggacctataaaaactaactaaaagtaaattccgtaattgtt

SEQ ID NO: 32744 - DNA, 99 bp, Heterodera glycines
ccggggacctctagagtctcatcgcggccgtgtacatgtccgacttcccttcaaacggctggttgcggttgtagtcatagcggacgctcgggcggaaga

SEQ ID NO: 32745 - DNA, 719 bp, Heterodera glycines
ctcaaatcgtgtgagggtgccactctttcagattaaaccgtgcaatttgacatttgccaacacattctaatacggcggccagtgggcggggtcgccgctcgctcgcaaatctgagcttgttctcgcgcccaactactgctccatttattttttgggagggggtcggcacaattaattatccggatcataaatggcatatcaatttgacccatggcatcaaagttgaggaaaagggtgctgtgcctatagtctccagttatgactgatgcgatggcaaccggacgttagtgagagtgactcgagagatcccccacacagtaacaacataatttccactatatggatcgtctgaatgttcaggatccagcagagggagtggggaataggcaaagtggaacgatcagtgacggggaggagaatcggcacagaacggagacggcggagacaaagcggcgcaaaaaatgtgcgttaattgggggggggcaaagattagtccacgctcctccaactttttggggcgagctttttttacactgaaatttcaaaagattgacgccgacctttccctccttttccccttttccatttcaattgactgtattcttttttgaatgccgaatcgctttttctctttttctctttttttattacaatttctcctttttttgccttcttcgtttttctttttgcctccgtcttcccctttcttttcattcaca

SEQ ID NO: 32746 - DNA, 973 bp, Heterodera glycines
cccaaataattgtcatattcgtaatcaatgacctttaaaacccccgggtatttggtttcaggactttttaaacaaaaaaaaattttgaccaaaaaaaagttgaaaaaattttcaaaatagtgctcctttaaactagtgcccagaatttcgtgttttctcaatgtaaatctcttttttcatagtgcagtatttgctcttttctttgtatttacaaatttcctaaactttaatcttttggtttatgccaagaacgtatgttcgacttaatatggaaaattatggtaaactgaggatgatcgttaattggaagcgtctttgattggggaaagtccctgcatcatggacggtaaaaaagaaaaaaaagctgtaaagagcaacatttacttcgtgactttaacttttttcctgcacgttaaatccacaccaaatttaacataccgatcagggatggcacggaattccgagttccgacttccgacatttttggggtaagacacattagtgcctcacactaaagacacataacaaaccactaatgttttatcaaagacataagacacattattgtgtcacactaaattcatagaacaaacactattgttttatcaaaaacataagacacattattgtgtcacactaaattcatagaacaaacacaaatgttttatcagatatttggctatttggcaaatttaccacaactcttcccaacccacttacaaaaggggccgccaaagttgaagtatgaatttctcgaaagtgagcaaaaagttgagtggccgaccgacaggttcaacacttcagagatgaaatcacaaccaattgtaaagcaacagcatttctttcatatgatgggtctcatttctaaattttacataataattaacataaaaaagcaaaatataattcaaaacaattaatccccataaactttgatgaggcccttaaaatccatctgggcaagctgttgaat

SEQ ID NO: 32747 - DNA, 963 bp, Heterodera glycines
gcggcgaattccaaaaggctcaaaaatacgaaaaacatacaagctaataaaaaggggaaaagggaaaaattaattgaacttattacgagggtaattaaacgttaattaccgccaaaccaaaagtcaatcgctttggcataagcgacttggggcagtccgaagcgaaggccattgccctttgataaaccaattatgtaatcacacataaattaaaatgacattttgatctttgcttcagccttaccaaagtggaaagggaaagcattgtcgtgaaggaaagggtcactcgcgcgggcacagccctaattaaaagacgacggacgcttaattggcaaatgcgccacaaaccttcggtcaatccaaaaggaaacctggacaataaatgaatcgctaatgagtgctaattggacggatacccatgagatcatcacaattagtcccgtgggcaaatacgtttgcaccacgtggtacccaatttgcctgttcagatggattattgccaccaaacagctgaaattgtctaaatggaaagttcatttcattaatgataataattatgatgatgcctcttctgtacgtgtgttccataattgcgtattggtaatttccgctgcaatatccgctggttatgttggagatgcggaattcgggcaactgaatgtctgaaagtgcctagcctaatttattaagcctaattaatttattgttctcatttataaactcggattgtgccgggtcgggtcgacgtggtcaaaccaacggatgagcaactgtctttccacataggcatctgaaatttcgcagtgctttcaagaggcgtttgccaatgttacagcttagcatttcgattcggcacttctgactgtccattgggtacagagacagctccaaattgcacgcaacgctaagagtgatgctaaaggaaaagccaatttcgcaaaattaattcaatgatttgtaaaa

SEQ ID NO: 32748 - DNA, 977 bp, Heterodera glycines
ttctgatgctgatcaaaaaaatgtgattagcagatcactgctgatcattcctacttgtaaacgcattattttcctaagaaatacagtacttttcaaagacaaccgtatggattgatcggaattccaagtttcgatattttgggaaaaatttcggaactattctaatttttatgtttcaattaaaattttttttaccaatatgaacaataattaattaatccaaaaaccattaatccttaattttagcacatttaaaatttcagcccttgcaaaaaaatactcattttggacaaaatttgaaggattagagaaaatttggatttttaaataaatttaaattatttaattttttgcaccgagaaattttcggaatttcttggatttttgtccagaaatccaggtcaaggtcaatttggaaatccaggtccagcatgaaaaacctggataaattttttcatctttttatggcgaaatgtatttaaaatggtataattttaaaaattttccggttggcccctaaaaattcttattctcttaaaaaactggcttaaaatcgcaaaattttgttatttttgaaaaaatcattaacaaatcgcattaaatccaggtccagattttttccaaaataccgatctctacttttgatctctgaatttttttgttagcttataaaaattaagaaatacttccgctggatctggttattttaaaaattaaaaatgcttaaaattttgttttttcataaattaaccttttaattccttaaaaaatttcatattcattcatttccagtaaattttgtgtttttgttccggcacttgggggtcagtaaaattgttgaaaattaatggggcggcgataaacaaaaaaataattccacctttttgaagcggttttgagttttggggactcagtttaatcttttcccaatccgggaccttggagccctcattgacaacattttgatttttaaatct

SEQ ID NO: 32749 - DNA, 277 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgttattata

SEQ ID NO: 32750 - DNA, 800 bp, Heterodera glycines
aaatttttaaattttatggtaaatatgttcatagggcccagattcaaaattaaacaaattatatatcaatcgatagctctcggtctgtaatggaagaatccgaaagaattttttggcggcaaccaatccctgaagagttacagacccgggactgaaatggcattaagtggcttttggactgaactgtccactaaaaacgctgatactggtttgaattcaaattttgcatgcagcaccgaatttagtcttttaccgccatttccagaaattttggcccaaaaattgtccatttttgaagtaacgacgggaatttagaattcaaaaataaaattttgcttttttccgataaaaataaatgcttttttcaccaaaatttttgcgctttgtgaatctgaccaatttgccaacaacatcatctctgaaatgtcaccaaattctgaggcattttttggccctcaaatcgaccacaacaatcgcctcaggcaattcattattaaaccaattacaaaaatggcataggtaattgtttcccatttaaagcatccaaagtgccaccattggatgtgttggaaagcattgacattgagtcgttaaggcggtgccaattggaatttaacaggtgcacagaaaactgagaaattttcgtttaaaaagaaattccgggaccgccaaaagcgattttaattttttttttttcattgccaaacgaaatatgatctttgtggcatcgtttgatagccctaattattctctatttccatgcaaaatttcaaaaaaatctcagagttacccaaaaaaat

SEQ ID NO: 32751 - DNA, 395 bp, Heterodera glycines
tacgtttcttcgaactgtatgacgaaaataacgaactgcgcggtagcttctacctcgatctgtatgcccgtgaaaacaagcgcggcggggcgtggatggatgactgcgtaggccagatgcgtaaagctgatggttctttgcaaaaaccggtcgcgtatttgacttgtaacttcaaccgcccggtaaatggtaaaccggcgctgttcactcacgacgaagtgatcaccctcttccacgagttcggtcacggcctgcaccatatgctgacccgcatcgaaaccgctggtgtttccggtatcagcggtgtgccgtgggatgcggtcgaactgccgagtcagtttatggaaaactggtgctgggagccggaggcgctggcgtttatctctggtcactat

SEQ ID NO: 32752 - DNA, 797 bp, Heterodera glycines
tttctcaccgaacccgcacatttattactgaaaattagtcggggtatagaataagtggcattggttactaatcattaacagcaaactgtcggcccttttgatcatgtttcatttccgacttttaaccagcatttgactcggcttaatggccaaattaagccaattaaattaattaattgatcaaaattttgacactttcgtctgctgaacttttccctgatttaacctgcttttgttgagaaatgcgaataaaattataatacaataatgagagaatgagaaatgtgactgatgtccacaaaaaaagttatgtaacaaataaaaatttcagaattaaatgggctaaaaatgcacgtgatacaatttggtaattggttgttgaccggtaaaaaagcaaattgggggaggggagggggagagacgaagagaggaagggagagagagagagaaagagagagggagagagaaagagagagggagaaagaagagggggatcaaagagtcattctaacaatacggtagtatgaaacaaaagtaattagagaaataggaaatttaattatcaaaagagagagagtgagcgagtgagagagagaaaaggagagagagaaaacgacggtggattaacaaatgatttgtgattgatcgatcggcagtgactagaaatttgcattgttaatgttgttgttcagctccaccagctgatcctgtcggattgttcgcgtccgtcgcagcacattgtcttctgtgggggggggggattgctttcactcacttttcttccgtttgaattttgt

SEQ ID NO: 32753 - DNA, 640 bp, Heterodera glycines
tgccatttttcgaagaacacagtttttgtcacattgtcagagaaagaaaaaaagaggacgaaagagagaaggaggagaagagggagagagcagagcgaagagaaagagagagggcgaagagaaagagagagggcgaagagaaagggggagagcgaagagaaagagagagagcgaagagaaagggggagagcgaagagaaagagagagagcgaagagaaagagagagagcgaagagaaagattcaccggaataatgcatacaaaattcaagaattggagaaaagggcatgaaatcaaacggaaaatatgctttatctacaacaatgcattcattgtcaataaaccatattaaaagcccactagggggtaaaaatgcatttttaaacgggccaaaaaataaattccaaaactatgaataattaaattaattgattgtccgttggtgtcaaatttacctgctcgtcgcacgcatcaagtgcatcgctccgtcagtgttttgttttgtttttgtgtgccccccaaatatgcaatgtgttgctgtaggcaattttttgttatctcaccaccacccatatgcaggtcattcattaccccccccccccaccgggtagcccccccccccaaaaaaaattttttttttt

SEQ ID NO: 32754 - DNA, 483 bp, Heterodera glycines
aagcacgcatgcagaaaaaacaccactttttgttcatttctctgtaaaataataaagataattttaaaaaataaaaaagaaaatacctttcaaagagacaaacaaatgattctatgattatttgagcaaatgaagacaatctacctttaaccaaataagtcgtaataatctcgtcaaagtctatttcagtcctcataacccacccctgataagaagaaggggctcgatattttacttcctcttcctgatagaaatagatgaaaatacgcgttttttcttatccgtagatacaatttgtaccagtccgttaatgtagcggtaaaatttggtaacttgacagtgaattcgtcttgaggcatgtttaaaaaaatcccacgaaagacgataatctccatcacggatcagaaaagagaaaagattttacgaaaatcgtccgctcttaggaatgttcgaaaaagggtggttgttggccttatgaacggc

SEQ ID NO: 32755 - DNA, 389 bp, Heterodera glycines
taggtcggaattttatttcttttttcaaaaaatacatcttttgctatttatttataaatttagctgaataaattattaaataagcaacaaataaaatttttttcgaactataatcataaatctaaacataatataatgttttagaatgttaatgattttttttgtaaatatttttaattaatgaacagacattttaactgaaatataaatgagtattgtttcaatggtagaatatagaattaattattattttacattataggctggacagatattcgctgcgccctccaattatatttataatcgatccatttgggaaaaattaaatagataaaaaataaaaataaaacatacgcatcgtatataaaaatacatcaaataataaacga

SEQ ID NO: 32756 - DNA, 888 bp, Heterodera glycines
tggattacgaacaaaaaatgtttcaagattctaatgaccaacaaagtccaaaaaattgctattccttgctttaagttttattttaattttttgaaatttatgccggccaattgagaaaaaaaatgggtcacaagtggtacatatatacatataaaaaaaaatttccaatgaatttaatattaatgagcaaatttataaagcaattaactaaaaaaaacttttcaattgatttttaaagtgaattttttccggaaatcatgttatatttaattgggtaaatcaattttcatattactgtaaaaaaatcaaatttcaacaaaaaaaaaggttgaagaaaattaatgcaaaattttgagacatgcttattcattttgttgcaattcaccattttcaaaaattttctttaaataaaatgaatacaaatttgtgcaattgatatgtgttcgtagtaaatcactcaaaatttgaatccaattccaccactgccggcgttctcaataacctcttgatcattgcttttaacttaaaaattctatatagatatttaaaatttacaacacaaatcttttgatttaaaattaaatggtaattaattaattaattaccaaattatagcgtggaactaatgggtaaaatcgggtgtgttgatatgcacgagcaagttcacgaacagcagaacgaagtgcctggtatttatggaccagacggtacagatctgtgctgagctgggcacattgttcttcgagatttccaatgggttttgctgaaattaaatatttttaattattaattagttttctaatttaattcaaatcgtcaaaatgggagagagattaatttacttcaaaaattaattaaagttataaacatcaaattttaaaaaaaatt

SEQ ID NO: 32757 - DNA, 873 bp, Heterodera glycines
atatccatatttttccgaaccctatttattaatctaatatatttataattttatggtctttttgtacttttgaaacaatttgattttagtatctttgtagatgtacattcgagaattaaaatcaccagatataaaaccccatgaagagctccttcaggttttttctaatccatcccgccgttccattcgtttggccgatgaagttcgggtttatttgcatctaacttaaaattgtttttttttaaattttacctgataaataggtattttatcaaaattttaatatggttgcgttttgttataccaaattgagcatacttttctttaataatccagaactaatttttgaggcacggcaatgcgcgtaccaaaacgagcacgctcgtttagcgcgaattattgaagctcaggtggcgattatttcctcgcaacaacggacaatcgaagggttggtctcccggctgcctcgtcagttttttttaaataaaaattccgtttaactaaaaaataattttattgttttgaagggaatgatggtgcggctccgcccaatggcggcgaacgacggggttcgcttaacttgtaataaaagcgtaatttgttgtatttagacattggaggagcgcccaaccaacaaagagttgtgtggaggcagcatggccaaccgcacattcgtcaaattggtgatttatctttatcatcaaatatatacatatattaatttgacgttatttgcctctgttttcagacaatcgtccgcacattgcgcccgagcccaatggtcgaggagacaaagtcagtttgcttaatctttgaattagtgttttttcgttgtattagatggaggcggacatgggccacgcccaaatggaa

SEQ ID NO: 32758 - DNA, 880 bp, Heterodera glycines
atttggacggatttagcactgtcgagtaagctgaaaagagaaaagaacagcagcaaatcggcacttaatgttgccggtgctaattgctaattttgtgtgtcgtaaatcccgcgtcaaaatcccgaaaattaattgtcacaagtttcaaggagaaattcatacatcgatagataccaaaccatttttatacatccgatttatttatcgaaattgagttttttcttcataaaatgcatttgatcacggatgaatatgatcggtcgatcaatcattcttaattaattcatttcttcttctgcggttgatcgctgtttttgttgttttgtccgtcactcatttcgccctttttcgctgctttgtaccgtttcttctgccggtggaggagacaatggcctaaattaggcgcaatttgaattatttaaacaaaattaaatgcctttttttaattgctcacccaatgcaattagtgtcactatcaagccaaaagaacacacagttacaattgtcccaatttccgtctttccaatgaaccgccgctgtctccccaataattttgcttcgtttcattatccaaccgatgccccattcattttccttggccaatgtcagcttttcctttgtccattcgttcaccaattcaaatggcacaatttgcattaacggcacgcgaacagaaaaatgaatttcgtaactgacggaagaaatggcattggcacgaagaaaatgctaaacaatttgagtggggtcggaattccaatttccgaaattttgggcctcattttttcgaattttatagaatatttttttcaagggctagagttgggttcaaggggtaaaccaaaaatacgtttaatggttcttaaatggcgtataattaaaa

SEQ ID NO: 32759 - DNA, 888 bp, Heterodera glycines
tattttgaacttgctcgtcttcgggtggaatatctcttgtattttgtattttcttgccatcggatggaatacttgttttttgtaggtgctgcattgctacaaagagacaattataaattaaaacataatataaatatctacagggaaatttggacaaggagtgtcgtactgaagaatttattctctttatatagccttgttttagtacttgtgtagcatcgttacattaggttattaagttagtttagtatgggtgttaaaagctacactatacgataagaatgactttcgcacaaaaaatttctccctttatataggctaattgctgatcctagtgtagaaacgctacattaggttattagctagtgtagcatggagggttaaaagctacactatacgataagaatgactttcgcacagaaaactttctggacatgtttttgaaagatttttggtgaaaaaattttcagctcaaaaaacatgtgcacccacccctctttggtcccgaatcccaaaatcacttttatttttataacaattcgtaaaaaagtgataaaaatgtgaaataaaatttatattatagagcaaaaaattgtgggtttaagtagtatttcacttttcaaaaatttcttttagaagggagttatgaatttttttctgaaaattcgaaaatttccagaatttctggaataactttttttgtttgcgatatataaatttcaaataaataccataaaatcttcctattttttgctatttttattgctttaattcagttaaattaaccaaaccttcactgagtaatgaattttcaaaatttaacccaaaatcctgagggccaaaaattttcctcaaaaaaataaagaatctcttacatttttgctgtaa

SEQ ID NO: 32760 - DNA, 946 bp, Heterodera glycines
tgcaggtccgcacacaaaaacggtatatttcacacaaaaattgatttccgagcggttcctcggcatttttcgtgtccgacttctgatattacgcccaatgtgccggttttgctaaatttaaatgatttaaaagtgccatcgcatcaacaaaactgtaccaagccatgacaagctgcttgactataattatggctgctgctgttatgtcgtctgtttgccatctgtaaatttacattgtgaaccacattaatttcaacgaattgtacatatttgaccgacgaattatccgacacttcacattttttaggaaattatttttttttatttctttttttttcatgagctcctaaggatttgcaaaacacaaatttaattttacatgctacgtacgctactgtcaagcgaattctagcctaaaattaatttttgaaaaatacattttttgtcaaattttggtcgtcggaattccgacttccgatttccgaaatttttgataaaaagtcggaaattttcggaaatttttttttgagttttttttgacaaattagtaatttttgtaaaatttctgttcataaattgcccccggtccccaggtttccgtggcgtttccgaatgaaacttagtgtgggaaagagctctgagtccgtttaggatgttcggtggtgctgaggttatactcctgcaagggcgtagccaggaccttcgtttcggggggggggggggccaactcaaaaagtcggttcttaggggggaattttttcgtttttggaaacctcaatatttagggcgtgtatttttccgctttttttaaattgaattgattgcattaaacgcggtcaatgtaaatgatcctggttttttttcatttcataaactcgttttgttttttttcaaaaaaaaaatttaataatttaaaaaaaaaaaaaatttttttttcaaaaaattc

SEQ ID NO: 32761 - DNA, 58 bp, Heterodera glycines
ccgtcacccgccccagcgccaccatgcgccaggcgatggctcaggcagaggtcggcga

SEQ ID NO: 32762 - DNA, 1308 bp, Heterodera glycines
ttaatttttaatgagttattatcatatttttattattttgaattttctttttatttcattcttttttattttttttaagttaaaaatcctactatcagagttatatctaatttaatttttgaaatttgaaaaaaaataaaataaatttcttttttaaaacttgtaaattcatataattccacttgacaagacttaaaattttccaatgaaaaattgcattcaaaaaattaaaaataactttttgttttttctcgaccgccaattcccgacccattttaaagcatttcattcaagctttaattgcccccccctcccaaagaatttgtggtctttccaaacaaacccatcaaaacgtcctcccccccccccacattctccgcatcgaacagcagacaaagcgcacgctctctcaaaacggcggtctttgacccctttcacaaagcaaaatttgaaattttcaaaaaaaaaaaatttttgtaggctaagccgtcgtcgaacgactgccctaagccccccccccccccctcaccaacaaaaaaaaacaatggaaaattccattccaaatgtcggcgaacgacggagtgggtgtagttgtcggagtggtgcggatgcggaacctgttccaacaccaccacattccgtggaatgtttgcctggctggtgacgaatgcttccccccccccccccggccctgtaatttcccggtaatgtgatgagtttttgggggactgggggggcgcctgtggaacaattcctgaaaaaacaacaacaataacagtaaaatcgtcgatctatgtaatgtgatgggtgtgtatcatcgacattttgaacctttttcaattatattgcctttttaaatgaaatatccctaattcctttattaggagtaaagaaaaatttatcggaattaatctcgagttctaatacttttttttgttgcttatttcttagccaaaatggtggaacaattaaagggttactattaatgaaaaaaattttttaaaaatttttatgggaaaaatggagggaaaatttctcgtaatttttaaaaaaaattttgttccggatttttgttggattggggggggttttccttttatgaaaaacatcccctttaaaaaaaataaaacaaattttggaaatttttaaaaccccctttaataaacctaacccttttttttcattaaaaattttttctttttttataataaataaaaataataccccccccaaaaattaatattcttttaaaaattaaaatgagagaaaaaaaaaaaaaaaaaaaaataaaaaaaatttttttttttt

SEQ ID NO: 32763 - DNA, 122 bp, Heterodera glycines
tatcgccggcaaaggtctggcgctgtccaaagccatcaacatcatcgacaacggcctgaaaggcggcctcgaccctcaacagggcggcgagatcgccgaaaacctggcggcgttgtacgact

SEQ ID NO: 32764 - DNA, 754 bp, Heterodera glycines
  misc_feature (655)..(655): n is a, c, g, or t
ttgatatgctttttcaagtaagatcccagcaccaaccaggctagaagaaaataaggaaggcttaaaacgccaaaaaattccaaaaaaagcattaaaaagccaaaaattgccaacaattaaatgcttaatatgataatatgcttaaaacctaattgaatgggctcgcactttttgtcacccgcctcatttgcacaatttggtcaatgtcgaggcccaaatgtgcggccacaaactcccaattgcgcatggagccgcagccgggcgggttcagccgctgctccaacagttgggccatttcggcacgcaaatgccgaacacggacactgccgccgccggaggcggtggggacagcagagatgccatatttgttgcttccattgttgtttttgtcttcgcaaatgccattgtcattttggcgcaactgtcgtcgccaagggcgcaacaaatcggaggaggacgggggcgaacaaatgaccaaaaaggcagagtcggcatcatcatcgaccacaggctgcggaggaaggattttttaagattttttttatgcatgtgggctaaagagtcaaatgcaatttgtttatattttaaaattaattttttaagaaaactttagttaaaatggtgtggtgtgtgtgtccggataatgccataagcncaatattttgaaactatatataatttttgataagattttgttttcaatatggacatttctcacttttgaagcacaatttttgaaaaagcaaaatatccg

SEQ ID NO: 32765 - DNA, 667 bp, Heterodera glycines
tgacgtattatgtgtatcgacttgccaataaataaatctttaagcgaattgtctgtctgttggccaatttttattagctttaggaaatgatgggagtgaacagtgagttggagagatgccacggcataaattctaattataaaaatgacaatttccacatttaaaaataatgcttttccacctcataatttgattgatttgttataatattttcatctgctcgcataagcattctttttgaaaaggcaaaaaaaaattaataaaaaaaattatttacaataagcaattcctttttcgtcagcttacaatgttggctttctccttatttcctaactttttgcttctccttttggcaatttgccatgtccacggaatgttcggaagggaaagagaacgaaaatcggaggaaaagcgcacaaacagcagaagcagtagcagagaaaatcggtgggtgagcagagagcatggggaggggagagaagtgccgaaaaacctttccagtgagccagacaatggcatcctttccatcgaagttgtgccgagtttggctggaaaccctttacacggctatcgcttcgtcgatcggtgcgtgactctcaaatttcgcgagtattcgcgagcggagtctgaagaattgcgatggatttacccaacgaaagagccggaa

SEQ ID NO: 32766 - DNA, 652 bp, Heterodera glycines
aaatgaaaattgtcaattccaataggaaaaactttgccaaccccgcaaaatccgttgccgaataaagtgatggcattcagaagcatttcgatctagtaagaatgatgtgaaattgaatgtgccttcgcgaaagtgtgctcatcaaaaatattgaaaaagtgatggcttgcttaattgaatttgcaaaacaattaattttctgaattattcatttgatatttgataaaatgttactcctattttattatttaaaatgcattgaattctttctcttttttgtttggctttgcttatccatccaattttatttattaaaaaaatgaatttttactgttttacataaatttgcgcattttcattttttagctttgttttgcattttcaaatgtttcgttcgccatctgagccaagcccgttctcgtcaactcggtgcccctacgatactcaggcgctctgtagaagtccgtactgtccatttgcacaccaagccgacgacactgtcgacgtcgttgaaggtgaaggaatgccgaagttcggcgggagggagtcggtgtaaccttcggaattggtgtcatgacaaaaaaatctaaaaattttcttacaaaatcactttccatggtaaaaagctgcgctgttttctcgggttctttat

SEQ ID NO: 32767 - DNA, 916 bp, Heterodera glycines
tgttccaagcaccccaccaaaagcaaaacgatataaccccttataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggaggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactccaacaattatggggagcaaaaatccaacgcaaaattaaagtacaggctatagggaagctaattccggaaggattcggtctccccataaatctgggcgcatcggctcggggggaacggcccgaaaacaaaaaaaatcaattttttcaagtgtcccgttgggggactccaaacaattatgggggaacaaaaattcccaacgcaaaattaaa

SEQ ID NO: 32768 - DNA, 784 bp, Heterodera glycines
cagatttatgggggagaccgaatccttccggatagccttaaatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggaagtccccccgaaccgatgcgcccagatttatggggagaccgaatccttccggaatagcttccctatagcctgtactttaattctgcgttggatttttgctccccataattggttgagtaccccaaacggacacttgaaaaaatcgatttttttgttttcggtgcagtccccccgaacagatgcgcccagatttatggggagaccgaatccttccggaatagcttccctatagcctgtactttaattctgcgttggatttttgctccccataaatgtttgagtaccccaaacggacacttgaaaaaatcgattttt

SEQ ID NO: 32769 - DNA, 902 bp, Heterodera glycines
aaaactcgagaaatcggaaaaacggacgttggggacatcgcattgtatttgagtgaaaaggagaaagtcgtatatgattcatatgcaaatggaggacttactgcattatttaggtgaacggtgagaagaaacggatagtcgtgataacacagggccctttgccggttttggtggcccatgactgcgaactcactcagtttccagtggagccaatttcggaggacaaaattgtggacaccaatggggcgggcgatgcattttgtggaggtattgtaaaagtgaatgcattaagttgtggataaacttgactacatttgatcccctatttttccttgaggctttttggctgcattttccaccggccgctctttggatctttgcgtccgtgctggtaattttgctgctcgtacaattattcaacaaattggctgcacttttccaaatgaatgtgcttatttagaatgagttaaaaatgtacgaacaatccttctcaaattgttaaatttacagttctatgttttattaaatttattcgtaattttttaataaatattcttagtgtttctgatcatcttatggcttatttactaataaatatagatgattatcaaacagctacagtttgttagatttgttcaacataggaaaatttaaaatttacattactgaactgagatgatttcgttgagcaaaaaagaagcctattaatagagaccggtaaaaaaaattttccgggacgggagtcccgaacgggaatccctcccgttaaaatcccgtccatttttaacgggagtcccgggcgggagtaattcgaaaatttaattaaatactaaatattttaatgcacaaatttgaaggacaatccttttattaaacgcagaaaaattataatatgcgctttt

SEQ ID NO: 32770 - DNA, 984 bp, Heterodera glycines
  misc_feature (858)..(858): n is a, c, g, or t
cccatcttaagtaatttatgaaaatatttttattcatcctttgtgtttgtgtttatgtttatgtaaacagcagatgtgcagacgaaagataacgatctcaaaaagttgacaaaattttggccaattcaattttaattagtatttatctcacattgtttatgtaataatgaaaagaaaatacatgctaataatgtagccatttactttttaattaatttattttttcatttagtataatttattttttattttatataaacataataattaacaatgataatatttaaattaagaaaaatattttcgatttattaaaaaattgcttcctggtgcccaaacttcacggtgcccaaacttcttggtgcccaaacttcccggcgcctaaacttccccccccccgtttcataactttaaaattattcaattttattttgaattttaaataaatattttttcactgtattaatttaatttgaataattcatttattgtttcatcaatgtataaatctcacggcttctccatggtgttgagtcgttaacacaataaagggcgttagaatttaaaatttcgttatgtttcaataaagttatggcaaaaaatgttcgaaaaacaaagttttttgagttctttcgatcctaactttttttttgaaatttgctgactgacagagaaaatcgaatttaaaaggggaggagatccaagccttctctaagaaataatatttataattcttccatcatccgctgcaccagcagaaaataaatttaattatttggaatggaaaagaccgaccgacacaaattagtgccaaaaaacattttgaaaatttttgagaatgcttgaatttattaactntgatgaattgcatgttagggcattaaaatcagagtccgaccccaaattttaaaattttggggattttaaccattttttaataatttgttatcacaaattgataaaatataaaatattaatttaaaa

SEQ ID NO: 32771 - DNA, 885 bp, Heterodera glycines
gatctttttaataaataatttaatgaattctaatactattaatatttgatgaaatctttttaaattaaatttctattttacaaagaaaaaagcaatgcattaaaaataaattcattttttttttgttatttcccagaatttttcgaatgttaatgaaaacttgtcttaattaaatgaagaaagtggtttcaaagattttgttaaactgttaatgaatgtgctgagaattttcggttattttggccactcagacaattgaattaaatgaaatttaaccaaaattaattaatcatttgatcaaattctcgtggcataattaaatgccctgcgtttataaaccagttataataaccaacaaatcatcttcgtctgcccaaaaacattttggactttaaactattgtttttttgaatacaaatatcttgaacagacattataaataaacaatgaaaataaaatttaaatcattatcaaaattaaattgtcctagaggatgagattttttttaagaaatttgggacaaagaaacaaaaaccatcgaaaaatttaagtattagcgattataccaattatcatttaattagaaaaatattttttttaatttgaaatgtaaaaaatcgccgttttttcaatgaaaaactgaaaaagtacaattataaatttttgatattttcggaactcataatcctaatgtgaacgtcgataaagaatttgatgcgtatgaatgacatagtctgcagtaaaaaatcctgtttttgttcattgtaaaaaatcttttttgttgctttcccatttatttcaaaaaatgttgtttttattcgcagaaattattgagtaattaataattaaatttaaaatattttatgattttaactccaattagct

SEQ ID NO: 32772 - DNA, 579 bp, Heterodera glycines
tttttgatacctaaaagtgttaatttaaaaaaaaatttatttgcctatttttgtgcttaaaaatatttattatttacaaccagtaaagagtaaatattcagtagaacgaaataccataaacaaaatattattttgttatttttgaattacattttcatttttattgtaaataatggcattttcattgtccattgttttcgctaacattttgcattgaatggaaattatgggcattttcagtgtccaaagtttcgatgacatttggtattgaatcgacattaatggcattttcaatgtccgaagtttcggtgccatttgacattgaatggtcattaatggccttttccgttccggtgttgtttcgacaatatttggaactgtttcttcaatggtctgactgccttgcacatagtttggtacaacttaaaaataaatttattaaaaaaacaaaaataggttttcgttaattttgaaaaaagcctgtgaataaatttgacctcgcccttcaaccaaaatgaattgaatggcactacaaattgggcaagttacatgagctttaaacctaaatctaatttattt

SEQ ID NO: 32773 - DNA, 463 bp, Heterodera glycines
aaaggcaccgtgtcggattggaagagattattcagcaaggcaaaaaatccatttgatgcggcatttggtatgaggcaaatcaacggtcatattaatgacaatttttgttttgactgcggcaatggacgaaaaggctggtcgaggataaggaaaataagggaggggagggaataagggggggggggaagaggggctggacaaacaatggacgggggggggggggcacgaggggattggggtgggtggaacggaactttgctttgagagagaggaaaatgagaacggcggatgggaggaggaagagcaccagcagggtgggcagtgggaatgacgcggaagatgacgggaaggaagtgaggagggggggggggagaaggacggacgaaaggggagaagcgacagcggggacagagggagggagggggggggggaagagagggatgaccgcccgtccaccttgggc

SEQ ID NO: 32774 - DNA, 717 bp, Heterodera glycines
tgccacagctgttcgtgcggatgctggtggtggccctttccataatgcgtcgtttgggtccgcgttttcgtccgccaccgcctccgccccttccgtccgttttccgccgtcggcggtgttcgccgtgaggtgcgacaggcgcattgtttgcttcttctgctgctgctgggcgccgcgttcgatgttctgcaggaaagtgccgtgaccagcggacggcgcagcgcaagtgggaggaggcggaggctaaaaatgccaagtgcccgcgtaatgccaaaggcaaattaaaccgaaccttttgctgctgttcgatgccgctaatgccgaaggaggcgaagttctgctcgatgttcactttgcactgcatcaaaacagagatggtccgaccctaaaaaagaatttggtggtgttcaattaagtggcataaaatcgttgcaattatgccgtttgtcaactccattgcctactttttcccgtggtaaatccgtgcttttaacccggtgttttttttacctggtgtttgacaccgatgagtcccttcgggccgcccactttgcctagctgttcaaaccgtataaggtgccgttgtaaatccggattaatcggcccttttgatgcgaaaccagaaacctgaaattttttgtcattttttttcaattttccaattttaccaaaaacccatttaaaatggtttgaaatgaaccctgagcgttcccctcc

SEQ ID NO: 32775 - DNA, 960 bp, Heterodera glycines
tgacttataaggaatacatcggaaaagcgcattcgctattaatcattcttttgccgggctgccgacattttgttatttttaatttgatttgttttaaaatgctgacaattgccattcatctaaacgcatttggttataattagtcattaaggcttaattggaactgtagaacaagcactaaaattttggtcataaaagcacagcgagaaatgcttggatttaacttacctcatcaaaaaataaaaataattttaagtttttttaatataaggtgaaaggatgcattggtttattgttttggttttgattttgaattcaatttacaattctaatgcgttttttcattcgctggattcagcaactccgggaggtaaattcaaatgaattaaaattattttaagcattgattgtttttaaaatttttaaaataaaatccaaaaatttagaaatttttgcttttcagcttgtcctctcctcgtcccagccccttgggtgtgcgtgtgcggttgccagaaatcagatataaaaaaaatttcgtcgagttacggtggcgctgatcacagtagcagtgatggtgatggaggctacggtggaaatgagagcggtggtggaggggaagaaaatctgaagctaaagattggcaaagtgaaggagtattgcggctgccaaacagtgaatgtcacctgcaaatcatgcgaatcggagcaggaaaacccaatacatattgaggtgcgtttaaaaatagaaattttatttacacaaagtctaacagtaacaaaaaaaaggtaaaattaaaactttgacatagaattttaattttcaaacaaaaaaggagttatcgaaagacgctgcaatgaaattttaaaattaaatcctaaattaataaaacatcaaatatttggtgatctatccacttaaaaaaaaaagtaagaacatagttggagagcttctgaaaatctt

SEQ ID NO: 32776 - DNA, 622 bp, Heterodera glycines
ttttttttaatttcagccaatggggtaccaaataatcgcattcggttgttgtatgattatgaactaaacagcaaaatattgtgcactgaaaatgacccaacggtggtggaagcattcggacgggcaaaacaatttcggtaaaaaaaacaattgaaaaacccgtactggtacctcgactctattaattgttagttgcccaactcgtactgcgatctgtgataaatttctgttgctgtacagtaagagttgggtaatttagtattgatgaaatttattaacagatgtttactaaaaatataattttttaaatcacaaaaaccaactgtaaaaaaaaagaatttacgaaataggaaaagataaaataaaattcgtaaaaaagttacaaaattgaaaaaaaacagaaatttatttcttaaaatttcaacaaaatgcgatttcaaaccgtaaaatgactgtgatttcgcatacattttttcccgttgtaaaaaacatttgctttaaggaaaagtatcgttcaatgctgacattgtgaagttggtcatcagaactttttacattatttcacacttttttttattgatttcattcattttttacctattttattttaaacaactagcgg

SEQ ID NO: 32777 - DNA, 816 bp, Heterodera glycines
  misc_feature (553)..(553): n is a, c, g, or t
attttaatgggaattgcccttaaaatatattcagaactttcctgcggcactcatccgccaaattggcaagttgatcattgccctgggcagtgccgttctgtccgccgtcctccgccaattgcgccgctggcagtgcccttgcggcgactgttcgcttctcttccttctccacttcctcttcttcttcctcctcctcttcgtcaatctcttcgtatgaatattcctcctcgtcttccatcacttcctcctcctcctcataataatggccaatgttcggcacagattgagcaatcatttggcttttctcgaaaattgcaatttaagaaagaccccataaatcaacttgagaatccctccctaataattagtcccattaggtggacactttcattgatcacttcccaaagattccttccaaaaaccatcccacgggcaatttagtagggtttcggccgtgtgatgatgggatggattatcagcggttgtttaggtcagtgggcggtaggctggtggaagagtgatgatgacaaataccgccggagggggggggggnggggaaattgggagggggctgagggggaggggtcaattattacgacaattaacggaaaaaatcccacattttaaagagcaataaaggaagttcaaaaaacgagagcaatatttcctattttctttgtctggtgagtccatcccaaaaaaaaaattgtcctttttctgaccccggcagtaaataatgtttttgcagatgttgacttttgaaagacaacctcggcgaatttggtggaaaatgacgagaattgggggggggggggg

SEQ ID NO: 32778 - DNA, 928 bp, Heterodera glycines
accccattcagagactagtcaaaaaaaataataataggcttggactactatactaattagaaattttagaatgtgtctgttaaatgcaaaactgttgtgaaaaattgttataactcctttcagagaagagatagaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactcctttcagagaagagataaaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagacaagtcaaaaaaaataataataggcttggactactatactaattagaaattttagaatgtgtctgttaaatgcaaaactgttgtgaaaaattgttataactcctttcagagaagagatagaaaaaaataaaaatagggttagagagcccgtgaacagct

SEQ ID NO: 32779 - DNA, 839 bp, Heterodera glycines
  misc_feature (38)..(38): n is a, c, g, or t
  misc_feature (826)..(826): n is a, c, g, or t
aaaaaaacattattaatttttcatcttcatcatttttntggtttcaaaatatattgaatacttttttatactttgaaagacttttttattaatacagaattttttgaaatttcctaaaatccgcaatcctgcgcaggatcctgcagattttacatgcaggatttgcaggattgcaggatttgcaggattaatcctgccggatcctgtcctgtaaaaaattttgaattccaatcctgcaacaggatccgcaaatttgaaatttccggtctctaattctaagcctattttggtcatttttatggcattttgtgcctatttcactttttacgaagaatttttttcaaaaaataaccattaaaaaattttatttacatattttagtacatatttgggggtttttgtacatatttcatacatattttagcattttttatacatattttatttacatatttcgcaattttgttacataaaattagcatccctacttatgatgatgatgaatttaccttttgaaagaaaggcgatgataatttatattaagtttacttatatttaaaatatatctattaaattcggatccggggttaggaattagacaaaatatgtacgaattcagattcgtcatcagtaccctctaaaactgatttgcgcctaaaatataaaaaaattagagaccccaattctttaccatcgcctgaaattcgacctgtgttttcaaaaatttgtcccacgtttcctatcggaatgccgggggcctcttaattctttttttaacatttttaaaatcaattacagtttcaggaaatcgcttaatttattttanaggcaatatatac

SEQ ID NO: 32780 - DNA, 441 bp, Heterodera glycines
ccccccccccccccctcgctctccagccgtgggggtcagttccgtcggtggaaaattgttgggctataaatatttccaaaattggccaattttgttcggcttttactatcattttttggcttttccataattatcatgtattaacacttgcttacaattcattgttcctcaacgtgttctgctgttctgctgacgaaaactgtgctggtacggttgtcccttcggtttggcgcgccgccgccagcgaagacggaggcgccgcagacggagtggcagcactcgccgttgtcgccgttgttgtggtcgttggtattgttgttgtgcttgtactgcttgaacttgttgtggccgtcgttggtgttgttgtggttgtggcgctggtactgcttctcgttgttgatgctggtgatggtgtaacgttcatctcctcatgatcttgac

SEQ ID NO: 32781 - DNA, 913 bp, Heterodera glycines
ggggctccaatgccagtggttgcagccgaactgtaattgtaaaattggtgtgcgatttgttcgttcgactctctctcatctgtatgctttctcttcggaagctgagggggaggcggtggcgggggcatatggtacaccggagttggagtctgggtgcacgcattggaccgaaagccgtggtcaacattgaaaactcgccccttgtttcggatcttcagaatttaagaaatgtatttttaatgtaaatccccaaaaattaccttgaaaaatgtgtagcctggcaaatcataaattacatcaaaaggcacaaatcgaggactgattttgaagcgggtgcaccaaattgtcactccttctttggtaacacaccactccgcctcacattcagtgcccttacattctcggcactttcccaggatgtcaaactgaatcgtccttggcatagctatgcgttcactgctaactgttataccgttagcagtctgactaatctcaacggcagccaaaatattctccatcaaagattttttgtcactaatattaatggccattttttggagctttgatcatgaatgttaccaaatttaaaatcgaatcgttttatataccctttttcattctcttccgttccatagtttatttaaaaaatgttccctcatcctttccgtttatcgaccaaaatattgctacgggtcaaaggattgggtaaacaaatgcaatcgccgatgttcgagactctcgttccttatttttcattcatttttatcccttttccccaaatggcacgccatccatctctccttccgatttacaaacgaaatattcgtcgccaaaaccacgtacacattaagcatgtacgcgtaaatttttcatgttgacataataaattataattattcaggtgtttgttact

SEQ ID NO: 32782 - DNA, 721 bp, Heterodera glycines
aaagtcgaaatttttattgttttctcttcagcttacaattagtgcccaagtggcttacaattagtttgttaaattcgaatttttgaagaatagtgtaccctctccaatttacctccgtcttcaatacgctcccttttggctgttgtccgtgtcggcgcggccgtttctgtccctttgctcctcttcgtgttctcttgtcgaactgtttgcttcggctgctgcttttcgccctttccttcctccgtttttgctgttattgaattgccaatcggcggcttcaactctttgatggaaattgctgacaattgttggttctgttgttggcttgtgccgattgaggacaaaagtgaggaagaagttgaggaaggtatcggactgagcacattggtatggtggcgaagtgcggcggccattgaggaaggcaacggcggggggccgtgcatgtcgcgccgaagggtttccacgttgtacacaaactgcgtgggaatggggataaaatttaaaaaataagatgcattttccaacctccttcagttggtggatgtacgcgtccattcggcccgggtcggacagaatttcgaggctgaaacgtggcggttgggaggttgtcgtcctcgtcctcctcgtccctttccttctgctcttccttttcatggttaggttcggcctgttcctttcgattttttctctttctccttttcaccatcccttcttcttcctc

SEQ ID NO: 32783 - DNA, 914 bp, Heterodera glycines
cggccgtcactttagcagtgagagggacgcggtcggcgtctgcagtgagcagcggacagcagaaaaaagtgccgaatttggcgggggaataatttaaaattcaaaaaataaaattaaaataagtgtgtaaacaataataaataaagtcctcaccttttcagtgcgttcgttcctcttcacttttcccaaaaacgcaattgcagcgcaggcgaagcgcgtgctctgcgctttccgccggcgttggaattgcggaagaaacggaagagaacgacggacggacggcgggggaaagggcaaattattacggaagggaagtgatcagactgatggaggaggaggaggaggcgcaggagacgcacaacaaagtgactgatcgttttttcttagaaattgcaaccaattccgaaatgggccggcactttttcccactatggcacccctaaaaagccaaacccatggggggcgttcacatcagtctttccgatcaccctcccccaatgccatgtttccatctctgttttttgtgccgttcccattgccaatatttcccttcccccttttgcccaggccaccgatatctttctctgtcgtccctccgtttccgatcggcttgccccgtgctctctcgccaatccctcctcctcctcttcctcttctccgtcacttcttcccgcccctcctccactttttccgccacccgatgaaatttttacggaagtgactgaattcgtcggcagggaatggctcttccgcgacttgtgccatcagctgatcactgagcatgcacagctgatccttgtccatggggctagcggaagcggcaaaagcgcattgattcggcacattgcggcgcactcggccaattttggggacgcgtacgctcaagtgaaagatgatggcatttcgtactcaat

SEQ ID NO: 32784 - DNA, 639 bp, Heterodera glycines
tttggtcaaagaattcatttatcaacacattaaattccagtaaataattatagctttacatttatttatttttttgctaacattgcccttttccgtcgtcctcgtcttcgtcctcctcattttgcattccgattggcacaaatgccaaattcgtcggcacttccaaatgcgcaatctcttttccctccgtttccaacagaaattcaaaattgaactcgccctaattttgtattaaaatttaaattattataaatagaaatttaaaaaattaataattaaatttcttacagcgaaaaggtccacaaaagggatgccgaatatccgtggtgattcggggatcacaacagtggcattccaccccgctttttgctccatctcgcgcaccgtgtgattgcctggcctttgcaacaattcgcacaaattgcggccgataaaattgcataaatcgaaattgctataacataatgaaaattttaaaatttttttgattatttttaattcattaattagggctggtccccagaaggtattcatccctggcattttccaccaatggatgaatttaatcggtgttttggccccgaacactgacatttcctcgtggagcacccagttgaataataataataatattattgt

SEQ ID NO: 32785 - DNA, 603 bp, Heterodera glycines
tttattttatttcggatttggacgagaaaaaatggctaacactttttttggctttgacaaaaaattagactcgtgattccgaaattgccattctaacactttttttggcttgtgcaaaatattagactcgtgattccgaaattgcgccatatcgggaaggcccgcctagcgcacgcgtgctattttattttatttcggatttggacgaaaaaaaatggctaacacttttttttggcttgtgcaaaaaattagactcgtgattccgaaattgggcagtatcggtaacactttttttggcttgtgcaaaatattagactcgtgattccgaaattgggccgtatcgggaaggcccgcctagcgcacgcgtgccattttattttatttcggattaggacgagaaaaaatggctaacactttttttggcttgtgcaaaaaattagactcgtgattccgaaattgggccgtatcgggaaggcccgcctagcgcacgcgtgctattttattttatttcggattttgacgagaaaaaatggctaacactttttttggattgggcgaaaaattattactatgtgattccgaaattgggcagcatgggtaagg

SEQ ID NO: 32786 - DNA, 64 bp, Heterodera glycines
cattttgaaaatcagaatttttgtgtccttttgaaattgccaaagttgatcagtttatctacgg

SEQ ID NO: 32787 - DNA, 955 bp, Heterodera glycines
ttaaaagatataaatgaaatgtggctggatattctttcatttagtaaaataaaaagcatactattaagaattaataaaaaaattatttttaattaaatttaaagtaacctgtcaaccgttgaaaccatatacatatgttattggtttgactgtcttcaaaaaattgcatgctaatagcaaaagatagcagcgcatgaaatggctcatgcgataatcagcaagagttaattaaaaatgtaaatctaatttatcgtcactaaagattaaagtaacatttaaaatgaatatttatgaatatgaaatatggacaaaaacgttgaaatatggattattccagaaatcctcataatatggatatttatatggacataaaatcacccaatcaaaaaagtttacgtagaaatgctattttgaacccctttcttcatagcatattagaagaaaaaatatgtaaatccataaaatttttttgcattgttgctttgatttgaatattaaacataaacggacaaaaaaaaacgaaaaataaaaatagtgacctaaaattttttggtctttgattttctttaatgtacgttaacttttacaagttaaaacaaatgtttaaatattttgtataaattatttttcaataaaactaatggagcatccttcaaaaaacaaataacaaaagtatgcaaaatgcaaatgaaacttttgcagctcttctagcccagaaaaaaatatatcaacccgtcggtgttagcatgaaaagaggattaaacgcaaatttaagaacaaattatagagacgaaattttgtaaaaattataataaagtaattaccatgttaattaaaacatgataataagtaaaaagtgcttaaattatttgttaaaaattaaattataattaatttattgaacaaaattatagcaaaaatgaaatcacgaatatttaaaaattatgaaagtatt

SEQ ID NO: 32788 - DNA, 1038 bp, Heterodera glycines
aaggccaacaaaatttgaaaaacggccgcgaagcggccgtcaaggaccaacaaattttaaaaacgggcgcgaagcgcccgtccaaggccaacaaaatttgaaaaacgggcgcgaagcgcccgtccaaggccaacaaaatttgaaaaacgggcgcgaagcgcccgtccaaggccaacgtaaattgaaaaacgggcgcgaagcgcctaacaagctaaaaaacgggcgctaagcgcccgtataagttaaacagatttaaaaaaacgggcgcgaagcgcccgtccaaggccaacaaaaattgaaaaacgggcgcgaagcgcctaacaagctaaataacgggcgcgaagcacccgtccaaggccaacaaatttaaaaacgggcgcgaagcgtccgtcttgatcctcgatgtggactaaaaacccataataattttttaaaaattcaaaaaaaaatctccaacaaattcgatcaatttgaatcgcttcacagtctaggtagcgaagctcccaaagcgcgaagcgctttatcccagctaaaatgccaacggttcacgcacccgctagttatatatacgttagaatgataaggagtttcgtttcaaaaactaatttgagaagaacgggaatagctggggggctgaaattttgcacacaggggtaactcgagacggcgcatccgggaaaaatacggattttttggtccggtggccaactgagtcccagcggctcgaaaactgactttgccgccagtctcagtgttacgaaattttttgcttttgctttcagagcttagcggaccccaaaagcgaaatgccccaactatggcctacaactttgccagcaaaaaatttttgatcagatcaaaggcctgacctgtaggttaggcaacgtaagaatcactttttttggacacttcagtaccaagcgaatagctcgtaagggtttgctcgaagcagggggtcgccagcggacttattgtagagctcaatgagctcgatttttacaaattttaaaatttcaaaaatttttcaaaatttttcga

SEQ ID NO: 32789 - DNA, 620 bp, Heterodera glycines
gaagaatttttgaattcttacaaaaattgaataataagacaatagaagacaggaggccggcagtgccaataagcgtcgccgagaacatttttaagaaaattttagtgtttttgtttaaaattcaaaaacttatttttacttaaaaatttgagggtgcgagacttggcggggatacaccaagacggaaaaccaatggtggggggcgaggtacatactagaagagaacgaaaactaagaaatatttcgactttaccataaaacatattagcggggttgacctcacaaggggtcattcccaactgtaagtcggaaaatgaatataaacggtatgccattggatagagcatggtcaatttcttttaaggatttttttattttacgtgatcatatcaagaaatgaattattgcctgaggtcccattttcagctttgtccactttcattaattaattcagtcggagcggagctaaacctaaaataaacattaaaaagaatggataggctggcttgttcatcatttccaacttcggtttcaagttgatttatttttgccagagcaaaatttaaaaaaatccattaagtttattcctttttttccgaattccttcaagtccctttgct

SEQ ID NO: 32790 - DNA, 897 bp, Heterodera glycines
cattgccaatcgtcgactaatttttttctgaaaaagatatttcggtcttttgattacaatcaaaacaatttaactgaaaaaatgtttatctctctctatccattatttatatcgcatttaaaccatttaattatcctctctttcttcagaaaacttaaaaatacttccgatttaattttctgaaactttttaaaattacatttaatatttcaattgacccataaaacacctttactctcaaatttaagaatgccgaaatgcgtcgtctgttggaagccgaccagcttgcgctgggttgtctggacacatggcttatgatgaagctcagcggctgtgatgatcaaagctttgtcaccgaaccttccagtgcttcttccaccggaatgttcgacccgttcacggtgattgctcattcattttcccagcgtagttaatcattggtccatgcatttaactctaattatacattaattgattttgttctacattaattaggccgagtggggccgtcccattttgcgtctgctcggcttccccgacccgggcgcggtgctcccgtcgctggtcgacacgacgcggctcggcgtgcacacggcgcccgagctgttcggccgcgcaattccaatttttgcatcggtaaaaaacgacggatattttttaaattaattttattagtcctatcccacagtcaaaaacaataaaattgaattaattagtgtacaatatttttttttagctcggcgattcccaagcggccgcgttcggtgccggatgcattcgccgcggggacctgaaaatctcactgggcaccggcactctgttcgactacgtgagcgggcccgaaattcacagtcaatgcatggtcgggcgggaatggtattgagaatggtgttgttt

SEQ ID NO: 32791 - DNA, 87 bp, Heterodera glycines
ggaggtaaaataaaattttcagttagaggaaaaaggtactgatgtaaaatatctgactgttaaagaacatgttcatgtattcttaaa

SEQ ID NO: 32792 - DNA, 192 bp, Heterodera glycines
ttttcaaaatcgtttttttttcggcgcgctttttccaaaaaacttttcgggaacaggggggccggcggtgccgataggcgccgccggggaaaattttttggactttttaatgaatttgttagaaaattttcaaaatttgcgacccccctcgctgcgaaccctctccccccacctcttttacaccggcccccc

SEQ ID NO: 32793 - DNA, 551 bp, Heterodera glycines
tgctgggtcgtttcttaaaaaccgccactatgggcgtttcttaaatccgccaaggagttggaaaacaaaaaatgcaagattacaaattcataacttggcttaaattcaatcaaattaattattcttggtatcattcaatagctctaggtgttctctatcagaatattaatttagaaatttttttttataaaatttcaataagttatggtcacaaaatttaaaaaaatcttgtgtttgaattttttggccattacttttttgaaactcaatgaaattttttaaaattttaaagataaatgagaattcttaggtctattcaatatataaattaattttggctcaattccattttaaggactagaattttaaatgtttataaataaatatgcatgcccatggcaaaaaacatagcatgttcaatcctttataactttttttcagaagcaactagattaaattttatttttagaatttcaagttccctatttaatctatttatcaaatttaaaaagattccattgagtttcaaaaaagttatggacaaaaaattc

SEQ ID NO: 32794 - DNA, 993 bp, Heterodera glycines
atagaatttttatatttctattttctcttctttaaattgttgaattataaaaaaattattgattttttaataatacttttatttcttcataatgttttctagattgaaaagtttctattaggtatttattttttaatactgagagtatttttttattaatttctattatggagacaaaaagttcattaaaatctcaacgggacattaaattaattttttttttctgtaacattttcttcggaattaattttttaataatattaattaggatatttgttatttaaaattttttttcgagttttctaattttagtttatataatttaccaataagtgtttaaaatataaataattacctgcgagccaatctcggtccccctaatggctaagtaatcactcatttttttgactcatatattttaaaacgaagccattttttatttaaacatatttgaatttaatcactttttattcatttaaaatactattgctgtattctttttttcaatatgtaaaagtcaaagttaaaatgttatgttaacattttttcatttacaaaaaaagatttaataacattttaagttaaaattatttatttaaaacacatttataaataaaaattaattctttactcttttcatccatttgtctttgagtttaaaaatcaaccaattctacatctttaattgctgctcttaaaaattttcacctttttatatttattgtgtgatttttcgcaaattaatttttatttatatgggatatcttttacatatgcaaatactctttcgctagtgaaattatttcaattttaaattacaggattccttacgaagaagatacaatttttttagcaaaaaacgttaaggtttatctgaaacttttgatccacaagtaataatttaaaaaaaagatttttaggaaatattatatttttatagctaaagaaaaattattaataattgcctaaaaataataatttatgtgtactttc

SEQ ID NO: 32795 - DNA, 403 bp, Heterodera glycines
tgtaacccgaaaccccaggcgggggggggggactgatgatgatgggaaatagcaaatgccatccattggcaatgacgcggcaacgaatttatttttgtgccctcttttatttaatggcaacaaaacattgcctttttttcactgcggaaatttctctcgcggttttcctcggaatttccgtctttttgggctttgcgagcgtgaattgtttacatttattggtttatttatattagcgacaaaatgtcgagcggaacgaatgaaaatgactcataattgaggaggagaaaaattaaggggccaagggaaatgggaaaaaggggaaaagggaggggaaagaaaaagggggggggggggagaaacccaatccatccgccgatctgtcgttgcctcccccaccccg

SEQ ID NO: 32796 - DNA, 912 bp, Heterodera glycines
tacattttcagttatcatttatgccatattaaggacagctcacccagggcaggagcggcgataaaaatttacagggctaaatcttttaaaggaaaaacacctagctatggtccctgagggagggtttgaaaaacataacacccaaagcatgaatgcaatccaatactcctaaatactatatgcatagagaatgtgataaaggaactaaaccaccataaaaacctcgatcaaacttaaattatttttttatcattaaatataccgaatctattttagttgatctcttcagaaaccgttgaaagaaatgtaattaaattatttgccaattgaaaaacgcactcacgacgttgtgctccacctgaagacgtgcattaacttccatgaagaaatgattccccttatagtccagcaaaaactcgacaggtactaaaattattatgattttacagaatcatttcttgataagattcattcgatacactgaccaacgttctagttacccaacatggcgtgtcaatttcaaaggatcgtccaacattcactgacgtattgccggatccaaaacaggagccggtgccagatcaacgatcttctgatgccgtcgctgcacagaacaggccctctcgtacaaatgcaccaaatttccgtaatgttccccaattatttgcacttcgatatgccaaggtctttccacgaatctgaaacatcaaacatgcttatttgttattgccatagccgaatatcggaagttgtacttctcgactaacagcgaaccatcaccgaacgcggtcaaagcttcggaaaaggcgcggctgaacgcatcttcaatctgtgaaaacgaatgatcttcgaaagacagtcacagtaaataatttaaaatgcccaataattacagagacccgctccccattc

SEQ ID NO: 32797 - DNA, 799 bp, Heterodera glycines
tttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccaaaattatggggagaccgaatccttccggaatagcttccctataggctggactttaattctgccgtggatttttggtccccctaattggttgaagacccccaaaggacccttggaaaaaaccaattttttggtttccggggagtcccccccaacccgtgccccccaaattatggggagaaccaaaccctccggaaaaacttccccaaaagccggaatttaaattcggggtggaattttggttccccataatggttggagaaccccaaacggacacttgaaaaaatcaattttttggtttttggggaagtccccccaagccgaggcgcccaaatttatggggagaccaaatccttcgggaaaaccttccctatagcctgaactttaattctgcgtggaatttttgttccccataattgtttgagtaccccaaacggaaacttgaaaaaaatcaattttttggttttctgggcaggccccccgaaccgaggcgcccagattaatgggaagaccgaatctttccgaaaagcttcccttaagccggaatttaaatcggggtgggatttttgccccccaaaatggtttgaggacccc

SEQ ID NO: 32798 - DNA, 893 bp, Heterodera glycines
  misc_feature (859)..(859): n is a, c, g, or t
acaaataaaaatttaattcaattatatttatttcgagcttgaatttcacaatttcacaatgccaaaaataataacagaattcgtagcaaaaaaggacaatttaatttaaactatttcgtaaaatgatgtcaaattagaaaatttgaagcaatattttcaaacaaatccaaaagtgagtgccgaaataattggcacggaattgagaattgaaagtgcaactctacatagatggaaaaaggaaagttcatccatttgatcagtgatttcgaaaatggaaaatgcattaaatctattcaagtgatttgatatataacacctgcactggcctttcttggaggagttaagagtttcaaatcttctacaaagaataagtgctaaagaaagcaataaatgttcttctaaccattctttttaaacaaaacatttaattgttgctgatccaaacagcttgaagctgtgagtgacgactctctgttggaaggttgacttttgttcggaaatgaacggctggaaatgtgcaagtcggagccagaaagcgtgcttttgttgccgccaacaaaactctgttggagacattggtcggtcaacgaatgagaagccgaacaaactaaaagcagaaaactaaagagccattattattcaattgtgaatgagcttaaaaataagtgcgcacatttgatttacatttgaataagatttaaattaaagttcggtaaaaaaattaaaaggaaatgtgtaagcacttggcagattttgcatatttttcgaatttttatgactaatatttattacaaaataattggttttatgtttgtttttaatttttgcattttcagcgaatgtttttttcttctaatanaactataattaatcaaacacatggtaaaaataaa

SEQ ID NO: 32799 - DNA, 907 bp, Heterodera glycines
  misc_feature (868)..(868): n is a, c, g, or t
ttgcaattttcagttccatttagagcccaaaatcccccacctaaattgactagtgatagtccaattaaggtactattacatccacgtttatgtggcacccaaattttggaactgtctcgccctcgggtgggacttaaaagaaggtagaggaaaatgtttgaaattttcaagtcaaaattttcgttcttaaatttaatgcaatagttttctcgctttttttcacggttttcgaatcgcggaatcgtgcgggtttaaaatttaaaagccgaaaagcttctatgatttttaacaaaaaaaaatcatttgttttttttcattttttagaccctgaaatagtgcatgaaaaggggcgggttagacgccgagggaattccttacaaagggacgcaccccatctaatttttgcaattttcagttccattagagcccaaaatcccccacctaaattgactagtgatagtccaattaaggtactattacatccacatttatgtggcacccaaattttggaactgtctcgccctcgggtgggacttaaaagaaggtggaggaaaatgtttcaaattttcaagtcaacattttcgttcttaaatttttatgcaatagttatctcgctttttttcacggttttcgaatcgcggaatcgtgcgggtttaaaatttaaaagccgaaaagtttctatgatttttaacaaaaaaaatcatttgttttttttcattttttagaccctgaaatagtgcatgaaaaggggcgggttagacgccgagggaattccttacaaagggacgcaccccatctaatttttgcaattttcagttccattagagcccaaaatcccccacctaaattgactagtgatagtccattnaaggtactactacatccacatttatgtggcacccaaatt

SEQ ID NO: 32800 - DNA, 936 bp, Heterodera glycines
agcagggatggcattccgaggccccaaaaattttcggaaagcggaaatcggaattccgaggccccaaattttttcggaaatcggaaatcggaattccgaggcccaaaaatttttcggaagtcggaaatcggaattccgaccccaaaaacgtcggaaatcggaattcggaagtcggaaatcggaaatttttcaaaaaacataaaaaataataaaaaattttctaaatattagtagttaattagattcggccacgacagtcccttttaattagagactggtactatcgatttaacggttggaatatatcgaagtgttcgatatatatttacgattttatcgaaaaatagataaagaaatttcacgtttttcattatttttcggtatcgattttttaacgaattttattggaaaatatcgatcgaatcacttgtacgacttctattttttccattagcgttttaaagattgactattggatttcaaccgaaattttaaattatttataaaaaatgtcaaaataggcaatatatttttttgtacttttactcgtcaatcgaaggaacatgtcaaaataatgaaggttaaaaaataccaggaatatgttggttataaaatttattccataaaatatcaatgtataattgctattatttaaattgtaattaattttgcgatgggttgcgaaaaatattgattttaactataattatgttttttaaataacgcccattttgatggttaaaatattattgtgtaattatttattaatttttaaatattcataaattgataaatacggagggtcaaaggtggagatgataaagaacaaaatacaagcaaaaaaaaagtaaaatttttgatgaaaatcatcgaataattttttaaagcaaatatgcttttaatagatcaaaaaatttttgaggcaccttttacttg

SEQ ID NO: 32801 - DNA, 984 bp, Heterodera glycines
  misc_feature (843)..(843): n is a, c, g, or t
  misc_feature (858)..(858): n is a, c, g, or t
cttttagcattagccaataaaaatttttaagtttaatttaacatctattaaacattcaagcgacacgaatattaaaaattttttacaataagaaattgaaattaagtttcaatagaaaataacaaaaaaaaataaaaataaacaattgtaaatatcaatgatcacattcacgcataaaagtcaaaatgtctttttttgtgattattcccagtaatcggccgttggaagtgaccatcgttgttcgaagacccaacttcctgaacatgtcgatcactgtctccatgggtgtttggtcggctactgtcattggtgcctaaatgagcagcgatttatttcgaattttcttgacaattttttgagaagacccgaagtgtttttataacgtaaaagttacaacttatgtcgaaatggagtcaaatttccaaaaaataatggtaaaatggggtatggaggagccgttaaagccgcctgaatttttttttgaaattttaatgttttatttcgggcccacactcactcaccacgtccataatgtggccaagttgcaggggcgcagatacgccagcggcatacgtcgacgcagccgtgccaatgtcgtcggggacgaaggatggagacggtgggagaactgtagcgccgccaccgttgaggacagtgccgtcgtcggccaccaaaaattgcggagggagcgattggctggcgaggcccgcttctgtggagaagtgcaccgtggaattggtggtcacatttggctgcattttgcgtgcattcctcaacaccaagctgagatccattctgaacaaacgggaaggagatgtgtgttaatcacttatattaatattnaacaaataaaatganaaaaaagaaacataaaaaggatgggagcaggtccatgcccagtgtattttttcaatttcagcgccaaagcgaaaaaataggaatttgtggcggttaacgccaaatggcaaattttgtcattttagg

SEQ ID NO: 32802 - DNA, 1393 bp, Heterodera glycines
aattgtttaaattttttttttataatttttacttttacttttttattttcatttttcaacttatttcctgttttagttttccctattctctttttttttaggttgtttaattttgttgcagctttctagctagcacaaagccagagcatggattcaacgttttccttttttttgacatattcgacagcccaacatgtggtgtgcgtttttaggcattaacaatgggcatagttggtatatagtcagggctaacacattttgctccctgactgtagaatatatagatttttaaaaaatttttcgcaaagaatctttataatcctttcaaatgaaagataatataaaaaattttataataactatcccatttttacttaatcaagtaacatagcctcccagctaataataatttatatgaaccagctaacctccttcacatcatttgatatttcgcattagtccataatgcaaatagcaaagagtgcgatgtgtctaactagctaacgatggtcttcaagataacggttacatgattcatacgcatcatattaaatattttttattacatatgaactcagggctaaactaattctacactcttaatatcattctaaagactttctgattctttaataacctgcaacattccaaaaaatttagtcaagattacatatagttctagccaaaaagttggaaaatttggttttttgaatttttctggccataacttttttgaaccttaataaaatttttcgaaattttgcaggctaatagaggacacttagggctatcgaatgatatcaagattgttgaatttggttggcaaagaaaaaagttatagccaaaaacttgcgctcgtactaaaacggcccgtactaaaccgaccccgagcccaagaatgtttaatttggttgagaaagaaaaaagttatggtcgaaaaattcgttcgacgacgtttcggctgacgacgttttgtcctactccggcccgtagctcaattggatagagcacggcacggattgttggggtcgtgggttcgagtcccaccgggcgagataccgtttaagttctacttgtggctgtcaaacgcatcccaaaccaagaggtgttcgccaacgaacagctttgcgccgatgattttgtacaagtagtcctccgttgtttcatcattcatccacaccgaaccagcgaaattgatcaccaattttccagcaaattggttgacaatttgaggcaccgatcgctttctgttgaccaacacatacggcttgagtttttgtccgttgttttgagccgtaatgcacaccgtcacccgcattttgtcatgtaatgtggtcgcaactgtcacctaatttgtttgaatagcttcattttatccaaaaaaaacatacat

SEQ ID NO: 32803 - DNA, 715 bp, Heterodera glycines
aaataagtattttttaattgaaaaatacaagaaaataaaatattaatataatcttaacaaataaacacataacaaagaattatacgaactttcgattatttattaattatgaaaatagttaaataaaaatactaatcctatttctttgcacatattaacgcgtggcgtgaagagtatgagaacaagaaaaattaaaaatataaatttttaaaattaaaataaacattaaaatatttgtaaaaatcgaaatctaaaatgaaaaatgcacataatcgaaatcttaatgcaaaaaccataaggaaaatgaatagaaaacacaaaaatgaataaaaaataaacaaatttaagttttttatatcgaaaaacgaacttcaagtaagctctagaaaaggcatccataataaaaaacttaaatttaaatgatctaaacatagaaaactaataagcaacattaataaataaattttgggaaaaaataaagagagtccggcgagttttcaagattcccgctgcaatttttcgtgaatctcgctcacgatttcatacttttagcctagagaatttttacgggagacactatttttacggattcacggtcctgctccctgaaatttctcactcgcaactttgttgatcgaaaaacagtgaatataaaaattaacttctttttaaaattcatgattaaaaaatttaaatggtaaataaatttaaggaa

SEQ ID NO: 32804 - DNA, 660 bp, Heterodera glycines
gagggacgtccttgccgctgagagtgagatgggcggcggatgggattcatctcctccactcaaacgagaactgttgattcaattctgttaggctccatctttttagttttcgctcgcgctgagcaagttctggaattccatggcgggattcgtcatcatcagccagcggggggggggggggggagcggaggattggcattgtcgtgacccgccctcccccctcctccccaactcttcgcggcccctcccctcaactttttcagctgttcgtggattgagttggggaaatgtcccactccccccccctcccttttttttgattctcgcgcaaaaaaaacaacgaaatttcaacaaaatgatgcaaaagggcagcaaagcaaacaaaaaaagacaagcaattaaaagcgagaacggagaaaagaaatgacacaaaatacaaaatatttaatttaaataattttaaaatttctaaatttttattcaatggattaaatgggcaaaaaaaaacgcacggaaaaattaaaatttaatggaacgcataaaaaatcatcggaataccgactaatgagtgaactgaaaatgcaaaactaattcagtaaatgatgaaattccaagaaagggatgggagggaagagaagagatgaaagaaaagaagaaaat

SEQ ID NO: 32805 - DNA, 684 bp, Heterodera glycines
taattattttcgatttatttgcctaattaacttttagctgatctttgaatgtgcgctgcacttttttgttgtgcgtttgcgcttttcattctctgctcgcacttgagaaagtgttcatcgccatttgtttgtgtctgcccgttttggcgacaatttggagcaggtggacaattaattggtttaatttgtggacaattaattagtttaatttatggacaattaattggtttaatttgtggacaattaattggtttaatttatggacaattaattggtttaatttatggacaattaattggtttaatttgtggacaattaattagtttaatttatggacaattaattggtttaatttgtggacaattaattagtttaatttatggacaattaattggtttaatttgtggacaattaattggtttaatttgtggacaattaattagtttaatttatggacaattaattggtttaatttgtggacaattaattggtttaatttatggacaattaattagtttaatttatggacaattaattggtttaatttatggacaattaattggtttaatttatggacaattaattagtttaatttatggacaattaattggtttaatttatggacaattaattggtttaatttatggacaattaattggtttaatttaatggacaattaattgg

SEQ ID NO: 32806 - DNA, 1067 bp, Heterodera glycines
ctttttctatcaattggcagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaatttttagaaattttatttatttttgatattaattcataaatattttttcagaaaatgctctgaaacgcaccaaatttatttacatgctagtttaggcacctctgatgctttttctatcaaaaaaggaaatgaataaattttttaaaattttttaatcctttt

SEQ ID NO: 32807 - DNA, 876 bp, Heterodera glycines
ttttgagcaaatttttaagaaaataaagatttttagggtccggcggtgccgataggcgccgccgtggaaaaattaagaattttgaccatatttttaacagattttcattaaaaaattcttaatttagtggatatttggaaaaattgttattttctggtttttatgaaaaatttaacataatcatttgtagaatttaggtgagattttcgttatggcacggaatttcaatttccgaaaatttttggggcctcggaatgccatccctggaggggatgtgaccgaacgtttcagttctgtaccaccgttctgtccaagcacaattccgtagcggataagttttttccccaatcaaggaaagggttgcgcattgattccactggactaagcccgattgggatttgtcgaacgtaagaggtaatggggggggggggggggaactcaaatttcttatcatgtatcgacatattccgattgcattgcgtacgaatccacatcactcttgttcctttgttactttaaatgtcacattaaaattagctgattttcgtttattttgctttacattttttacattgctttgcttccatttatgtgtatatatttagaaatggcttcggttactgatcgttttatgatgaattggaaggggattccgctgtgttttggcctcgtcacttcgacaacatttcatatttttaaacaatcggtggcttctaaatcgtttcaatgccaaagcctttgaaattcaaagaaactaaaattgcaaaacaaatggcgaaatgtacctaattgtaatattttatatttgattgtaaggtcaagattaggccggggaacaaaaacatttcaaacattttatagttggctttttctaaa

SEQ ID NO: 32808 - DNA, 940 bp, Heterodera glycines
tgttcggaatttataatgattagatgtgcatggtgtgactaatttctttgcttcactcatttctaccaaaattatcacatgtgccaaaattaatgtcgaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgtaagtcggggatctgacggctaatataaaaataaagagcagctcgctctataaactatctgattacatgacttctccatacccaactcatccatgcatataattgacacgaagcacaccgcacaatcaaaaaaatgccacgacgatgactcgcagagatatggatgagttgagtctatgaatgcgacgcggctgacccgaccattttagttagaaatgatcagaggtcaagaattgtacagagcgttgtgccgaacttgtgtcgttgagtataatcatgtgaaggaacaattgctgaatgggctgaagaagaacggcaacgtcagcctggtcaagaagagaaaggcatccgatgcgaccgctcacccgaccctccgaaatgacactgtataacaaacattctttttgacctaacacggaatctgtcattgtgctgaatgttctgttaaaagccaaagagccacataagagtcaataaatgacttttattttccgat

SEQ ID NO: 32809 - DNA, 467 bp, Heterodera glycines
aatgtttgaacaaactgctcgaaacgccaaatagctaaatcgacgttatttttgcgcgctaattcaaaaattacactgataaaggcctttttgcacaatttattttgatcagccatatctcacttaatttctaactaaaccgaacaaatttagtatctaaaaaaagtttttttaatggagaatctttttctaagcgaatgctaagcaatttgacatctcaggaaaaaattatgagaatttcaaatttttatcaggttataactcaagtcctaaattgccgttttcaaccaaaatttgaaataatggcacgaaggaaatgaaaattaccaatttcaatgaaaaagaaatgccaattcagcaaattcaattgcaacgcaaagtcatcgcattcaaattagggttcggaccccgcccccgtcacccccgcccccgccgggggcgggacaggttttttggcctcacccccg

SEQ ID NO: 32810 - DNA, 862 bp, Heterodera glycines
ctttatcaaatttatttatgaataatgtatgttgcagcattaaaaaattttgcactaatgaattaataacttattcgttttgatagcttctctagaaaattcatcataagttaataaatcagcaaatatttataaatgagttttcttttcaaagttatttttacggtttttaattattttgacatattaattaatttatggtttatttaattattattttttaattcttgtatattattcttactttaatttctttactattcatttcccattataattgtctccttttttgatttaagaaccattttaatttctatcatttgttctattattacttcaataagccttgcatattttattattatttcggtattcttttatttccattcaattggagacgagtctaatggtactaagtacgcctggttacgtttagattcacagtatgttacaatttaagatctgtttacagattttatgctgacaaatgaataaaaatttattgactagattgtattgagtgagtctgggctttctatcttcatttattatgtaagttgaccatatttaatcaattattatctatatcaatttctgatgtatcaatactttttttaaatttatacaattaatattcatgaaaaaaatttgcaatataaattattcataatatttttaatatagtataatatacctatgctaaataaagtaccatgattcttatttattgtttatatgattatgtttttttctttaaacacaaatcaacaaaatttacataaaagttattaataaaatctcaattcaattgtttctatataatattttcgcgaaatgataaaagataataaaaaccttccaa

SEQ ID NO: 32811 - DNA, 1146 bp, Heterodera glycines
aaaaaatggaaaatttttaaattcctttttccccctccctttttcccaggggtattatttggaaaaatttttttttcccccaataacttttcaaaccccatttttcgccccgtgaatgtttttttatgaattctgacccgtttgagtagatagatagaaaaaattgaaaaatttgaatcatgtttccactcccttctcacaggggtatttatttttaaagtcttttttccccaataaacttttcatcccccatttttcgctccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccgggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttcccctaataaacttttcataccccatttttcgcaccgtgaatgttatttttattgaattctgaaccggtttgagtagattagactagaaaaaattgaaaattttgaaatcatgtttccca

SEQ ID NO: 32812 - DNA, 592 bp, Heterodera glycines
gactaaaccgaccagactaaaccgtccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactaaaccgaccagactataccgaccagactaaaccgaccagactaaaccgaccagactaaaccgaccagactaaaccgaccagactaaaccgaccagactaaaccgaccagactaaaccgaccagactaaaccgaccagactaaaccgcccagactataccgaccagactaaaccgaccagactataccgaccagactataccgaccagactataccgaccagact

SEQ ID NO: 32813 - DNA, 967 bp, Heterodera glycines
  misc_feature (858)..(858): n is a, c, g, or t
  misc_feature (868)..(868): n is a, c, g, or t
  misc_feature (874)..(874): n is a, c, g, or t
  misc_feature (898)..(898): n is a, c, g, or t
  misc_feature (900)..(900): n is a, c, g, or t
  misc_feature (907)..(907): n is a, c, g, or t
  misc_feature (936)..(936): n is a, c, g, or t
  misc_feature (951)..(951): n is a, c, g, or t
ttaatgatgttgtttatgtatgtgttaattgattattttattaattttttccaatttgccacttaattacgtcgtgtgccaatacaatgcttgcgggcgcactttcttcgcgagagcagctgagcaaagacaccaacagattttggaagggtcccttcgtcttcgctttgatgttctcctccagctgattgtgctgatgccttctgtccaactgctcatacgcctgcttcagcgccgtaatttgtcggtttgtgcgcgtcgccaaaatttcgattagcaccgccctacggtagacaccgtaattaaatgtacatacggtaagccatgaggtaaactgtaaccagaatccaccatcaattcgatggcttatatgaacattaaatttagccaaaacaaatagctaagtttctcctgtggtcattatggcgtttataccgtaatctatcacttaaacctgttgagctactggcgttcctttttgaagttctctccatgtgctttatcccaattcaattgtaaatgtactcactcattggagccggacaatgcggcacgcatttggttggcatcgtaaacggcgggcgtttgcatcaaagaaatgctttgtaaatttaaatttaaatggctgtttttgcattttataatttacatcagttcttcaaagtcgcttttgaactcctttttcagcatggcaatcagatcagtgccgaattgttttttgaactccaaagccaatgcttgacgcttaatttatgaattttaaattaaaatgttaaatttgcaatttgaatttagtctgtcacctgttcgttgctaatgggagcaatgacttgcgtaacttcggccttaattatttcngaatgaattntcactncaaattcccccctccccttgcccnantgctcgnctcgtgcttctttcgcatggcatcatgcnaatgatgcgcagttngtacggttttaaaatg

SEQ ID NO: 32814 - DNA, 1005 bp, Heterodera glycines
tcgtcgtggcatcttttggttatgcgagtcgtcgtagggcattttttggttatgcgagtcgtcgtcgtggcattttttggttatgcgagtcgtcgtcgtagcattttttggttatacgagtcgtcgtagggcattttttggttatgcgagtcgtcgtcgtggcattttttggttatacgagtcgtcgtcgtggcattttttggttatgcgagtcgtcgtcgtggcattttttggttatgcgagtcgtcgtcgtagcattttttggttatacgagtcgtcgtagggcattttttggttatgcgagtcgtcgtcgtggcattttttggttatacgagtcgtcgtagggcattttttggttatgcgagtcgtcgtcgtggcattttttgattatgcgagtcgtcgtcgtggcattttttggttatgcgagtcgtcgtcgtagcattttttggttatacgagtcgtcgtagggcattttttggttatgcgagtcgtcgtcgtagcattttttggttatacgagtcgtcgtagggcattttttggttatgcgagtcgtcgtcgtgacattttttggttatgcgagccgtcgtcgtagcattttttggttatgcgagtgaattagcaataacaaaatctttgttcacttcgttatttggcacccccacaaagtgtccaagccacgaaatgtccaaaagagtaaaaacccacgaaatgtccaaaatttttcaaaatttataaaaacaaaatgagtctaatttaggatttttagggttttcggggtcgctaaatacgaatataccctttatattaccccttgcctaaccttaggcccatctgaataataaaaaactcaaattcgagacttggacatttcgtgggctggacattttgtgggtcagcgcgttatttgtatttcaattttaagtaaatgcttggcaattcgttgtatttttgttgggactgggtcgttttggcgccgacgttttggcgccagcctcagttttttta

SEQ ID NO: 32815 - DNA, 173 bp, Heterodera glycines
atgtctgcgtcctgccggctcgttcgcaggaccgaaacaagcgcacgattgatcgtatccatctcctcttggatagcagccagatccgctctatcgagcgggctattcttttgagccttcgacaatttcgcctggtctcgaggggtcgcccctcgttttgtgccacaacggct

SEQ ID NO: 32816 - DNA, 958 bp, Heterodera glycines
tcttcccggtacggcagaggtagttaaacacaaaatgacctaaaaattttaggatttaaaaatttagattaattttttttttcattaccatcaaatcgtccggcgttgtgcgcaaaaatgtacgtatcataactggtaaaagcagttaaaatctactccacaaaatccttcgtcggctcatgtccctcagcctcactccaatccttggtccttacctccccacaaattttgcaattcgtcctatttttgtcgtcacaacattccgtacacgtaactctcaccgaaatataattgatcacatgctctttctggtcccccttataaatcgaatcctgcgatgtttccgaatcctgtaaaacaagacctattttgttgttttgttgtaaaacttacccaaactacaattctgtagacgtccttgtcctctttttcctcaatcggcataatataacaaccccgcttggggtcgtggctcacactacaaagttggcaataagtctcaccacattcatggtccttcttcggattaaataaataagtcttatcacaaatcacacaacgtttccataatttacaagtttgatgtccttgatgatagttataacactcccaattgtaaaagtaacggcgacacttcgggcattcaatcttcactccactctcctttccacacggtactccgcccactctgttgcaataataacaccttgcccgacactccaaagtatgataaatatcacgcgagtaaaagcactcacaatcaacgcaaaatttcctcccgcgattaaaaaagcagacgtaattcttcagaccatcccagtgagtgttctccaaaaatatcggcacgaccatctctcgccccataggccccttccataaaacacggatcgatttccgcggatccgcagacttcttcaactcacaatccggaattttccggggaaatctcatcctaaaa

SEQ ID NO: 32817 - DNA, 983 bp, Heterodera glycines
agaatttacgaatatttaatttaaataattcttataatttttgagaataataaaatgtaaaaagtgggcaatagtaatgcataaatataatgacaaatgccacttcatttaagatatgcgtatgaggtaatatttattgacttaaaaattgattgaaattaaataaattcattttttgcacaaatataatttttaatataataatgcgtaaattattgaaattttgcagaaaatatatataattttaaattcgaaatgttctttaaaaatagggcacgaaattaaacataaaaataacaaataattacatccttatttattagaataacattttattttaaaattacaacacacatagaaaacccgcattttttattttataaaggatgaagaagtttaaatatttttgttttgagcaaagttatgtgaattatttaaaaaaaatgtaattttgaaggcttatcaaaaaaacttattgatccaaaaaattaagaaattttatttataaatagggcgttctaggtcatctcgtaaaactgtcaattttacagatttttcgagaaaaaaccgtcataactttttttgacacaaccaaaataaagaaacaacttcctgaaaacggaataaagcttatttcatttggctgtgtttatgaaaagttataacgggtttttctcgaaaaatctattatatttgcactttttacgaaaggacctattaacacttaagtaggcacggaattaaacaaaataatgacaaataattacattcgtattttagagcatataattatacgtgtcatataatgttatggccattttaattgcattattgtatctgtcttcgatatgacgtcatgtctccatccggcatgacgtcatagccgagacgccgatatattcgcgtttaaattcaacaactattcgaaaacttatataattaaaatacgaaaattatattcaatgagtgaagatctaaattaa

SEQ ID NO: 32818 - DNA, 125 bp, Heterodera glycines
ctaggctgaaatcctggcagggcgaggaggcccaggcgaggtcggcgctgcccggcagatcgccggccctcacctcgaacacgtcgcccagttggaaatgcccagcgccccaattgtcggcatag

SEQ ID NO: 32819 - DNA, 964 bp, Heterodera glycines
  misc_feature (905)..(905): n is a, c, g, or t
  misc_feature (913)..(913): n is a, c, g, or t
aaattagcttcaatctcaaaaaatttaatacatttttgagattacgaatgcggatgtaaaaaaatatataaaatgccaaaaatgtagtgtaatttgtgcctgtttgatcatttcgcacaggcacggcactgggtaagtgaacgcggtggccaggcacagttccgcagccaattcaccctcgtccacggtggcaatccgagttctggatggaaaagagctgacaatgaatgctaattgactaaccatcggacggacgaaatcaaatagctgagctgatttcccttcccctccccgataaatttatattttcgaagtttccagtttttttaatattaatttttgattttttttttgaaaatggtaataaaaaaaatgatgaatttgaggacaaactggttgagcatttggccaagccaacagtgcagccaaatgtccattcccagcgacacattgcaacggttcacatgcgcaacagcgttcggactggcccagccctgttggttggcgcacagaaagacctggaattttttaaaaataacctaatatttgaaatttatttttattaaaaccgctattttttttgcatgccaaagaaaatgccgaaatttcccgtacacaattaattcactgtcccccgcccgaaaaattttaaaaaataaagtttttttcatacaaatgtgccaacaaaatgtttattttcatcgctttattgttgttgctgttgtttttattgccgtccattctcacctccttcagccgctgcttctcctccttcagctcgtccttgtccgtcctcaacatgctcagtttgcgcaccggcagcgcaggcaacggacgctgggcaaagcctaggagaaaacaaaaccatacaaaaatataaagatagatatctcaatttaatttanaccttccnagacattaattagtgattgatggaaggatgggtgattaagtcgagaaaaat

SEQ ID NO: 32820 - DNA, 1148 bp, Heterodera glycines
  misc_feature (1041)..(1041): n is a, c, g, or t
  misc_feature (1073)..(1073): n is a, c, g, or t
  misc_feature (1107)..(1107): n is a, c, g, or t
  misc_feature (1117)..(1117): n is a, c, g, or t
  misc_feature (1134)..(1135): n is a, c, g, or t
tgcaggtcaaacattgttaaaaatatacattgtaaaaaaatagaagaaatactaaaaaaggaaataaattattcttgacaaaatttaacactatatggtacgatcagagttaagtggtcttctatacatgtgtgagtaaaagctatttgattaaacaatcataattatttaaaaaaatagatcgtaattgttaagatgaatgagcttgcagaagcatgacattaaagacattaaattacaacaaaacagcattaatgagacgttttctccacatttaaaataatacatggaccaacaaattactattgattgacgaacggataagatatgggagaaaaaaattttaattctcgaaatgcttaggaagataaaatatgaaaaatattaattatatttttaagtataaaaatagaaaataattgaattaatataaatcaatgatcaaacgcctttttattgattcatataaaaaactgacctaaaaaccatcctaaaatcataatgtgatccttgaatctcattaaaaaatttatttattacaactttctgttcaattaaactatacgtatgaagccttcctgaggataacttgagaaccaattttatagagatatttattttaagatctagatttattaactaatttaattattgtaaatatgtaaatatccattaaaacatattttataatacaaaatataatagccacatatataatttattaatttttatttaacaaaatacaatatttgattttattaaagaaattttatcaaattcattcaaatatcactacccccataacttttctctggcacatccaattgtttaaaatttgcttatttgttagtaaagctactcctttgaaacaactttcgaatgatactttaatcgttcaatttggttggtaaaaatattccaaaaagttataggagcacattttagggaaggtacggaaaatttatgatttattatgtataattgtcggtacatcagacaatattggataggttgtacatttttgtcttttactttatctanacatacatagatgttagtaataacttcatccncgaaattgagttttcgaattttttaatagatganaatcttttanattatgcacgacaatannatttgatgaacta

SEQ ID NO: 32821 - DNA, 522 bp, Heterodera glycines
aatgctatctgcaatacaaaagatacacaccaccctatgatgtcttgatctgtttggtccacaaagaaattgctttattttatgggccaatctgagtgccaaccgggtgcagcctaatattgctcttcggcacaccaaacaacacaatatccgctggtgctaaatgatcaaacaagcaaaatggcagatggaaaagtttttcgaaacaccacatggggtattcttaaaagaattttgttggggtcgaggttgggataacaaaaattgggatgggcgcagggacggtcccaggattttggtttgggggtaccaaatcaaaaaagtcaattcttaggggtgtatttttgaaaatttttcgcttgaacgcctttttttttttttgctattccccagcaaaaattgtgtacgctaaatttgcaaaaaagaatcgaaacattgattttgcacttggcaaagaacattcagcggaagagatggatgaagacgaaaacatttcgttataataaaaaatattatttggcg

SEQ ID NO: 32822 - DNA, 852 bp, Heterodera glycines
cttggtttctaaggtcacagccccgccgggggagataatccccggtaaaagcggggaacggggaaaaatggtgacattttcaaggaaaaattcaaaatttttatctttggtctctacatttttaacaaatttttctgttttgttaagctttaagttgttcaaaattctgagaataaagcttaggatgcggatgaagtgaaattcccggggattccctttcccccggctgtgacccaacaaaacagcaaaaggacgaacagtgacaaaaatttaaaactaaatgatttgaatctgatcgctttgcgtgccctgagtttgagagagccaatgctttttaagtcaatggaatgcttcgaagtgaacgaagagagagtgaagaatgatcgcaaatggaagttgcttcgctttctttacccatctctccgtccgcggtggcgtcgtttcttccgcagttttagtcgtccattgcaaatgcaactaaaaggcacaaatcggcccatgtttttcgttaatttctgctaattaccccccccccccccctccccgaggggcttttccctccgccagttttaaactcctttccattgcgttttgccaataatttttctcgtcttttctcaccatggcattccggtcgcagtcaacatgcactgcatgcttttgtctccgtactcatcacagtcaatcagttcgacgtgttcacaatttgctgaaagcgttgggttcgcctccaattcccttccccccttctaaattttgcctgtctcaacaattgccgatgagattgagtgccgactcgtccttacgcgtctttttgttttgcgcatccgacgatacgaccgaatccgatga

SEQ ID NO: 32823 - DNA, 326 bp, Heterodera glycines
tcgcttttgatggcacgtgctaccgccagtgcgcctgtcacgggacgcaattcgccgttgagtgccaattcgccgatcaattcataacctgccagctggctgtcgtcgagctgtccactggctgccaaaatcccaatcgcaatcggtaaatccagccgtgcgccatctttgggcagatctgcaggcgcaaggttgatggtcaagcggcgattgggaaagctaaaacctgcattgatgattgccgagcgcacgcggtctttgctctcacgcaccgccgcctcaggcaaaccaacgatggtaactgcaggcaaaccctgtgacaaatg

SEQ ID NO: 32824 - DNA, 611 bp, Heterodera glycines
gagtaaaggttgggcaaaatggtagatctggaagggaatcgaaccctcgacctctggtgcggcgatcggcttcccacccaaaccagtgctctttccgtctgagctaccaggccatcccattagccttcccttttatggatcttttgcccccgctaagcgttttaaccgtccgctggctcattccttacaatagacaccagcaactgattcgttaatatcatttctgggtgcggttggcaagaatggaggaagggggactgtaaaagagtgaaaaagataaggcaaatgaggggaagaaaaataatttagaacattttgtatttaatttctttaaaacatttttttaattttaatacctaattaattttatttaaagtttcattttttgctcagcggtacctgtggcacttcgaacccaaaaactctttgattggttcaaacccgcaaatttagtcaacttggattaactgttgttaacatttaaattttaaaaaaaagttccttaaaaacgaggaaaaaattttttgggtgtacaaaaaggtcatattttttgttttgttttgacttcaaatttcggtccgcgacccccattggacttggttcgataacat

SEQ ID NO: 32825 - DNA, 1416 bp, Heterodera glycines
  misc_feature (1275)..(1275): n is a, c, g, or t
gcaaagacacagtccaaaaacatttcgccaagcataaatatgacaaaggcacccgaattggtacaaccgtatccaccgggggcgtttgattacggtagaaaatgccaaacgaaggtgaccatcggtttggattcgcttttctccgtcctgttggagctgaaccgacgagagcccgacctatgcgctagaagtctccactcgttgctgcagcttcttcaggtgttcgatgccggcacaatggcaacgcaaccgcgcgcaattttggcacgaatgcatgaacagctgagagagttgcgcagagagggcaacgcacaagtgtctgttgtggctaacgcatgcatgatggtgagagagagcgagagagagaggagagagagagagagaaaagggggagagagagggcgagagaaaaggggagagagagaaaggggtggaggggagatgttttcttttcattttcttgcagagtttggccgttgcctctggacaacccgagtttctgttcgcctccgttttggccctcctctgcgaatccaaacgttgtgtgccgttcaaccaagttggccgccttctttttacctttcgccctgttgctgattccaatgtttttgagctcgccaacagtacaagccctctgccccgaaactttcattctttggcactttccgtccatcggcgaattgtcggcacaaagtcgggccaaatcagtcgatggatcagcgagccgttggagcagcgaccgattgtgtgcgaattcgacgtcatttacacgggaagtgcgcttattgaggaccgatcagctgaagagggcattcgccggggatgtttagcatctgatggttttgtgagggcgaagtgcgacgacaaaaagccgcctttttttgtttgtgtgaaggtgcctatgtgtatctgctgacggtgtacggcttcttcaaacttggcaccggactgtgcgaaacgcgtgccggcgaagtgatggtgtgcaacgagtcggtccgcttcagtgacggctctgcgctgtacgtgtccaacgggtcgctgtacctgcgccaccggcactctgcgcgcctttgggtgttggacacggaaactttgcgcgaaatcggtccattgtttggaaatgtttcccatttttgattgcttttcaggtgagatcctgctcccgtccgcgctgatcagtcagggtcttctcttttctgatgggcgtcagttttgggtcgcctctttggacgaccaatggcatttggcgttcactccgttggacgattcgtttgngcctttgcggggagacaattcgccaaacgaagcggagggcggtgatcgatggacgtcaggcgaaaaagccgcgaggacgacgcaattacgactgatggactgcgaattctgtgcatttggcgaattgggagagacgcacga

SEQ ID NO: 32826 - DNA, 670 bp, Heterodera glycines
agtttcttcagttctctttccgctggatgaacaaccttttaatgcgtgagattcctctgagggcgaccatccgtctttgggacacttatttggtcggtgcaggacaaattagataaaactcggccgggcccctcccccttctcgtattctttagttaatgatttcatttgtctggaacagagtgaacatgacgggttttcccaatttcacacgtacatttgtggtgctttcctgcgattgtggtcgaaacaactgttaaatgaaaaggactttcaggtgtatcagctcttaaataaataattggaatttaactttagggcataatgttacttcttcaaaatctcccaacaaaaggatggaatgaccagcaaatctgtgaactgaccgcggatgcctactcactcatgcagtttttccatcacgcgaagagccatttacaaacataatgcctgattatgttttcttcccggctctagttcagtttatgaatccgattgttttttattggtccaatcatgactgtctttttcaaacttgatcaatacatttggtattaaacacggtactggtttaagtttgtataagacagtcgtgattggaccaataaaaaacaatcggattcataaactgaactagagccgggaagaaaacataatcaggcattatgttt

SEQ ID NO: 32827 - DNA, 669 bp, Heterodera glycines
cgggcgcgaagcgccctgcccctagaggtgcgcgagcgaggagcgaagcggagcgacgagcgagtgtaccgagtcaatacgaacctgatcaattcttttagatgtcacttagcgggcatggggtgaacggctaggctcagctgtcttccggtagctgctgctgcacgaacatccagatacgcatctgcgcctgagctgctactgcactaacaacctgacgcatctaccccgttactggctacaactcgacgggataggctcggctttctataaagcgcagccatctaccgggacgcctagttgcgaaatatgtactaaaaagtccaaaatatttataaaaatatgtacatatgtaatatgtagaaaaatccgaaaatatgtaaataaaaaatatctatgtttagctacaatacaaatgaaatatcccaattaggaaacaagaaaaaagcaaaactttcagtttggcgccgcctttgttcagtcaaatttatattcttcaggcaaagtaaaaccctaattttcacgttttttcccatacactgtgttaatttaatataaggacaccctattttttgttagtttgaccactttccatgaaccgatcgaggtgaaattttaactgtacatagccaattctgaaaatatttaagattctaacaatgacaagac

SEQ ID NO: 32828 - DNA, 921 bp, Heterodera glycines
ttggacacggtgtgctattgattaattcatctttttttgcattcgtcaaatgaaagaaataaataacaaattacttcttagagcttattttcataattctttttgctaagtttagaacagatatacgaatcaaacaaattttcctatttaaaaaaacaagaaaagtattatttttttataagatttattgatcttagttttccatctctcactttttttacaatataaaagcggattttttaaattattattttacatttttaacctcaagccaaaccttatttttctctaaaagtttttaaagtctctacaatttttaatttctttttctcttgggtgcgctaacaaatggcattaaaattgcttctccgtcgaaatcgcccagcattcaactcgtcctcaaattggcactgtttcggcccatttcgaagcgctggtggacaaacattttgatgactggacgaattttttttgtaatttcggcaagttttttttgtttttttctgttcttcttttttgtttttgggttatggtcccaaaagccttaacagccccaaattttcaaaataaaataaaaatttttccaaattcaagaaaatttatttgtaaaagtgaatagttttttatgtgttttttgaaggattttatgcgtaaaatatttaatggcctccaagtaggcaagttttttttgtttttgttttttttgtatgtaaaaatgagaatgtttcaactttttaaattatttttttaggattttttttcaaaaaaacgaacttcaattttcagaatatcaaagtggtggacattctcccctttttgaccgtccatatcataagagaacatttttttcttaaattaaaaaaactttttttggaattttacatttttaatttaattttttggccctttttatttcattaa

SEQ ID NO: 32829 - DNA, 418 bp, Heterodera glycines
  misc_feature (10)..(10): n is a, c, g, or t
ttaaattttntggtccgtataaaattcatattaaggattcgtttttttcggcataaaaaatcgtgaaatagacacctaaaaaggcataaataggtgccaagcactaagcacaaaaagtccaaaataggcattataaaattgatcctagatgccagaaactaagctaaaaactttttttttttttttggggtctattgcactttatgagtgagtccaaatgtattttatgagtccaatcaattgacaatcccgggtttttatacaataactttgctcatgttcgaacaaatcctatcggtttggtatcattcaaaaacattaggcctgaataatggaataatacgaaaatacaagagaattctaaattttaaagaaaggttcaaacgaaaataagcaacccataattaaataatcaaat

SEQ ID NO: 32830 - DNA, 1306 bp, Heterodera glycines
gcttgatgcctgaggtcccttggggcaaaacaggaatgtaaataagtgcttttcgtgggagacaatcaaaaaatattttaaaaaaattaaagttggtgtcggattttccaatgtcggattttccaatgtcggattttcctagagcctaaattttcgatggttgttgtttgtttacttggtgttgtggtaactatgaatttgattgatgcttggattatgaatcaatagttaattaattaattaattagtgattaattgggcctacccaaattgtaccacacgtccgtctcgccgcacagagtgcgcatttcgatgattgtctggccaagaaagtcgtccgacgattcacggctcagctttcgcctcagtttgctgctgctcttcagcaacagatcgttgtcctcgtcccacacgcgcactttgatccgatcagtgatgttgtcacattcgctgcagtaatttttgatcagagtggcataaatgcggaaaatggtatttatttatttattattttatttacatattttgggtttttgcacatatttcgtacatatttggctatttttcttacatatttatgacatattttgaccactttttgtacatacctatttttgttgacaaatttttaaataagtttttgtatttacgatttttttattgaaaaattttccatgaaatacaaatttttatttttaaaataataataatatttaattatttcatttttaacgaaattcttaaaacaaataatttattttttaaataataatttaatatttaactcattcatttttaacgacgaaattcttaaaacaaataaaataataaaaataatttttaaaaaggcgcaaaaatttggacaaaatttaagacaattttgaatattaatgctccactcacaatgtgaactgctcgttccacaccggcaggtggttcaactcctgctgctgctggtgaatggtgcgcgtccgcttgagcgctttgcccacctgtgccgtcacgtacggcacaccagtgcccgttttgtctttggcgctcagccctttggcacaaatcactgcaaattaattatgtttctatttaaattattatctaatttattgcgggaccagactccgcgggatcaatcccacaatttcaacaaaaaaaaaaatgcgggaatgcgcgaaatgggaatcccgcaaattccccgcgcgggctcccccgtcccgcgcctgcgtgccacctgtcagctgaattttggcactccattttgaactgccctccaaaattgagttttttacgacacgaagagcctgaaaaa

SEQ ID NO: 32831 - DNA, 906 bp, Heterodera glycines
aaaaatagatgaggcccacactcaattaaccaaatagggatggggaattgtatcccaaatccgaaaccaattcaaacagtttacttttacaattataagtccgaacagtaaataatttaacagcagaaaactaaaccaaagaaaaacataaaacaactaacgactgaactaataggagtgaaaatggtgaagggtcaacagcagaaaacaatcgataatacagaaacaaaaatggcgggaaatacaatttaaaagcaaacgcacaaaaaatgagaaagaaaaacaattaaattaaattaagtcaaatgagaaataaatatttatctatattatcacatcctcgtcctttgaaaagcgatgtccacagagcttggcgaatcgggaaatacattcggctacatgaaaggcgatggtgaggtgtagatcaacggagatcagctccaaaactaggtcgatcggaaatgaccgcacaaacgaacggcgatacggcagttgctggtgaacatgccgagccccacgaaaccccggccgattgaactgtccacggcctctttcagctctgcttatccctccatttttccccacttcaattttcttttcggtcccaactcctcgttttcgtcctccttgggtatccatttgatttatgacatcacccaggccctcaaaccagtaggcccttttccttcattttgccgtcgttgaacacatggtcggtgttgaatccggaatcatagcgccacagttccagcactgatcgtctcgccggcgttgtcgtcacaattttacattgccttgcgctgttcccaaatgttctttcattcgtgtgatcagctcttcatattcgaccattttctctttgatgaaaggaggcggaagccaaaacacaggtacatggctgaagcg

SEQ ID NO: 32832 - DNA, 915 bp, Heterodera glycines
tttggggctgggggcctcgcgctttcttccatctctcctgcgtttgagtttaccacctaaaatccccagcattaaatcaatccaaagataaacgatgcttttctgtttgaaacctgcgtggaaccgaagccaggcccgtggtgtccgatggcacctccggttgtcgtgctgtttacttgctgtccactcctcaacagcccgtccgagttacgcggtttcgggactgatgcacgttttgcgtaatcggtcctcgtctttcgcagttcgcctccttccacgccaacggcggtgtgaatggaaccacttggggttgtctgagataaccacgagaataaaggaggacaacggaaacgaaccgcctgattgagcttatgggtccagtcaaactcataatcataagtgtgaccagtcctttcaagcacagttttgaaaagaccataacaatattcatagtcaggggtttcaaaaaaatcgagtcgtcgagcataacgcaaatattgagcaaattcatctgcagaaacaaatttatcggtttagaatgtgcacacgaaccggggaatccctcgcaaagcacttcgatcggagttgcgcgcttcgtgtcaccgattttctgatacctttctttgagtgtgtccgctttcaagccctgccaaggcaaggagccacgtagaaagtacataaacatgtgtccgagcgcttccaagtcatctcgacgactctgttcctttcccagatgcgtgtttatcgacatgtaccgggctgtcccagtcaacgacttatgttctcggtaggcaatatgtttacctgtgaaatgacttacaaataataacctaataacaccggcaatcctctaaattattggtcccgaaaagttttttctttatattttttcctgttataacacgtctctagggg

SEQ ID NO: 32833 - DNA, 984 bp, Heterodera glycines
  misc_feature (18)..(18): n is a, c, g, or t
  misc_feature (943)..(943): n is a, c, g, or t
  misc_feature (960)..(960): n is a, c, g, or t
ctaaaggtaggatttttntgggaaaaaagcgagacctcacaattgctaaaaatcgaaatcagggataaataatgttttttagtttttgatagggggacgaggtttttcaaaaaacaaaaactaggcagtttttataagaaattttttttggatagatttttgaaaagatttattgttaatcatttttccatcctaataaggttttgaaaaaatcgctagaaaatttttgatattttaataaaaaaactaatatttttgaaaacttctgtttggtaacttttcctttctctgcaggtgatgtgcgaacagtcgctctgtttgtctctgtccaacgaaaacgcgtgcgaaacgctcattttggccgacctgcactcggcggaacacctgaaaacgcaggctgttgagttcatcaacttgcacgccaacgaggttttggggaattggggcaaaattcggcgcatttatcgtcgtgggaacatttatagagaataatgacattacggcgatgaaaataggtgccgttgggaagaaattttgaatttattggaacatttcctcgcttttcgtcataattcaattcccccctctcccaggtgatggagtcggacgggtggaagattctggtcaaggagcacccgccgttgctcgagcaggtgttcaaggcgttggccacccagcagacgccgcccatcattctgaaccaaccgccccggaaaaggccgcgacaattctgagacgttgaacgaactgccagcaaaacacgacaccaacacaccccaaataatgtcatcgacggaacggacggattcatggaggcgaacgatttgcacacatttggacagacaaaacaaaaagacactgaatgagttgttgtgatatgtcatacaaacaaatatatatattatacatataatgtattctctccctctctctccgctgtttngtcgcccttttatacanttgtaaaacgcgtggtttcttccc

SEQ ID NO: 32834 - DNA, 957 bp, Heterodera glycines
  misc_feature (848)..(848): n is a, c, g, or t
  misc_feature (861)..(861): n is a, c, g, or t
  misc_feature (929)..(929): n is a, c, g, or t
ggatggattcggatccattctcactttgtgcaatacttctgcgtttgtcatgcctggtttgtgttaggaaaactacggtatcataattggaggcgaaaattgcccacccgggtacggtatcctgccaaaagtgaccaattcggtgagcagaatgccaaaggactaaacgtcagatctgacagtgaatttgttgtaattagccgcctcaggtgtcgtccactgaatggttaaagtaaaaagtgagggaaagggcgccgactttaatcggaaaacgggcgcccaactcgcgcttcgtattcgttctcgcggataagccgagcaagtccgaagtccgcaattttgaccatcgaagggtgagagatgagaatgtttcgcacagcgagatcacggtgaatgaaatttttctcctgcgaacaattggaaatttaaacactttcgctttggcacctccaaataacgcatgccagaggcaatttgcacggcgacgtcgaccaactgaaaaagaaaagtgaaaagggcgcccgtcgcttcttcaacctgcgcgacgttacacactcggccatggccttgcagaaagtgcagcagattctctgaatgcgaaagatagctatgtttacgatgtttgtggctttggatttggataccattgggaattggagcggtctatagcccgggtctatccccccccccctcccccctaattgcttaccctgcattaattccgtcgctattaaaaatggctcttcccgagtgcacaccgcgtaaagctgaagcagttttgggtgtcgcagacgtttcatcagttgagcctaaaagcgaccttttgctgatataaaagaatttgctgngcattgcctctgncagaaaatccgcgacacaaagcggtgggagccgggcttcagcttaaaatgggagagggagcgcattgntggcattcgattgcctttggcacctttt

SEQ ID NO: 32835 - DNA, 948 bp, Heterodera glycines
  misc_feature (18)..(18): n is a, c, g, or t
  misc_feature (24)..(24): n is a, c, g, or t
  misc_feature (45)..(45): n is a, c, g, or t
  misc_feature (116)..(116): n is a, c, g, or t
  misc_feature (866)..(866): n is a, c, g, or t
  misc_feature (886)..(886): n is a, c, g, or t
  misc_feature (897)..(897): n is a, c, g, or t
agagtcttttataataanagacanaagaataattggggaaaaatntgaaaaaatattcaaaggattttaaaaataaatcattgggccgaaaaaacgaactctttaaacgaactttntggcaatattggagcaaatcaaagcggactatgggcatgctaacagctgcaaattaagcggcagccaaattaatttgacaaatttgggaaaagaaatttccatttttggcaaaattttatacgaaacattgaaaatgcattcgaacaatgtgaaatatgaggaaattaagcaattgatgacatttccattaacagtggccgaacatttcatgaagcggcttagcaaatttgtacaaaggtattttacttatattagccattggcttaactttcccaaaagtcgggaatttaattatgataatttttattcaaaattatataaaataataatttagatttgactcttataaaatttagagtccaccaagtgttagtgtgagttgcaattattttctaagaaattttcatatttggatgccctagattttggagcaaagcattaattaaaaaaggaccaaattttaaatatttttcccagcgacgtctgtcgtaaatgtcagattcttccgatgaattttttattatttaagtctaaggccaagaaattttttaaatttatatcataattttgaaatattcaagaaaattgtaggcggatactaatagactaccaacactagattttttgggtgaaattaattttaaatttaaaatcattttaataatttaaattcgagtaattggccaatcacattcagccggtacaggtaattaccgatcagtaccgggcattagtcaatcttttactanattttttgaaatttctctcncataacaattntgttaatattttaagaaatttaacaaaagacattctaattgatgacgattt

SEQ ID NO: 32836 - DNA, 73 bp, Heterodera glycines
aattggccatcgaggcccgcaccagccgcggcgcaaggcccagggcctcgacggcgctggcttcatcggtggc

SEQ ID NO: 32837 - DNA, 959 bp, Heterodera glycines
  misc_feature (29)..(29): n is a, c, g, or t
attctttaaatcatgcacatcatcctttntgggttaaaaatctaaacaagtgaatttgcggttaactcttaaaccattttcgatatgacctaatccaagaaatcttcagatgaatcgtccaaaggatttctagagcccgtaagacgcaatgcgctcgttttatgctggaaattgactgcagaagacgcctttttagtggtttgttcggatgatcagccccgattgcgcgaacgcatccaatgccgcaaggggtaagaaacagcagccaatttggaaaaacgcattggggggggggggcgaggtgcacttcatcccccaccattcccatagatcaatccctcccccgaaatttaaaaaaaagttcaagaaaacattattatttttttcttgtaattttctataaaaatttcagtggaaaataatactgggggtggacaagctgctcctgggacctttgcctctttattgtattacttttcaaaatgttttatgtgctccgagatttccaaataagcgctaaaataaactctaaaaatttccaactgttacagtttttttccaacgacgcacaaagtttctgtcgggaagttttattccattgaattttcacgttactccacgcccaattcgccgcatgtgcgcatttttgtgctcaaagaatcgccctctccgctggaatctcgactggtcaatggcgagttgcaggttctttctttcatttttgaatatgtttttaaaatattttaattaattaattttagcttcgtatttttatttggcgtgccaaagatcactattggagtgaattttgtgaggtcaaccaaatgcccaaaggctctccggacgtttgtttggcgtggtgtaaattgaatgaaaaactccaaaacaagctgaacatcctcgtatttgttcaactaattgacgacttgcttaaggcaagttaacaaaaccatgaaaaa

SEQ ID NO: 32838 - DNA, 989 bp, Heterodera glycines
  misc_feature (10)..(10): n is a, c, g, or t
ttagtagganattagtggagcaaatcacaacatagcattggtggcagcgaataatgcttaaatttctaaaatagaataaaaattcaaatccgttctttcttttattttatttttccccggaaatggagcttgctgttaaaacatatttttaatcaaaaacatattaagcatggacttaatgagcacggtgttttaaaaaataaccatatttcaataatgatggcatgttttttaggtagttttattgtaatttctctggaataaaaattgcgatttatcgattattgcataaaccgatagaggcgatttttaaaagattcaaatgaaatgaattatttcgaattaaaagttgacgccaagatttagttttaacgtgtgttggtttatcactatgatgcaatttgctatgccttttaaagactgaaatagcagtgaataaatattgtggatgaaacaattcgtgttgtaaatgcaaaaacaacaaaataataaaattctattgtctgtattagtaggaattagtggagcaaatcacaacatagcattggtggcagcgaataatgcttaaatttctaaaatagaataaaaattcaaatccgttctttcttttattttatttttccccggaaatggagcttgctgttaaaacatatttttaatcaaaaacatattaagcatggacttaatgagcacggtgttttaaaaaataaccatattttaataatgatggcatgttttttaggtagttttattgtaatttctctggaataaaaattgcgatttatcgattattgcataaaccgatagaggcgatttttaaaagattcaaatgaaatgaattatttcgaattaaaatttgacgccaagatttagtttttaacgtgtgttggtttatcactatgatgcaatttgctatgccttttaaagactgaatagcagtgaataaatattgtggatgaaacaattcgtgttgtaaatgcaaaaacaac

SEQ ID NO: 32839 - DNA, 972 bp, Heterodera glycines
  misc_feature (879)..(879): n is a, c, g, or t
  misc_feature (936)..(936): n is a, c, g, or t
  misc_feature (961)..(961): n is a, c, g, or t
tgcgacggttttgtcgagtttcactttgtgaaggcgcgccattgcgacgattcgctggcattcgcctgtcgcgtgcgttcgctgtttctgcagtcgcttgagcataaattgcgcagtgacgactacggcgactgtcgcgagttggagcggctgatcatcaaattcgcacgcctccaacatcccttcaggcattgttttggatcattatgaatgatgaagagagagagagagtgagggacaaagagatggagagaatggagaaagagcaaggaacaaagacagagagatggagagagaacgagggacagacagaaagatggagagagagtaggagaatcgagaaaaagagagcgagggaaaaatatataaagcaagagaatggtgagagagcgagggacagagagagagaggagagatagagagagagtaacaaaaatatttctcacccttttaacacagtatccgaagacgaatagacccacccaggagcatggagtacggtgtgttcaccgccgatggaatgccgcacccgctctccgcctccgttgtgccgaccgccgatggccatggcattttggacgctgtggcggaagacgaagaagtaaacaattggaattgcttggacgcaacggagggagaatgctaattataatccaatttaaaaaggacgcggaattggacgaacaattggacaggcgaaaggcggaggaggaggagcagcagcgggcgaagggacgcgagtatttttgcgacatttgcggacggacactttggtttgcggacaatgtgcaggcgatcaaacacaaaaagggacaccagcaaaaggaggaggagaagccgaagcaggacgaagacggagaaagaacagatggatgaccnatagacacaccgtttcaaaaaacgagagatgaaccataaatagggagtgcacagaanaaacattcttattttgcgtactatntctttgtctct

SEQ ID NO: 32840 - DNA, 1712 bp, Heterodera glycines
  misc_feature (88)..(88): n is a, c, g, or t
  misc_feature (1077)..(1077): n is a, c, g, or t
aattggttgtgcggcgcaaatgtcgtcgcacagttttcaatgtcagccaattcagccgccgctgcattcgcaccgaaaatggcgcacncatctgatgtcacgccacaaatatctgatcgtcattggcactgtcctcttcgtggacatccttttcctcttcccttattccggcatccaaatggtcgctttgcttcacctcaacaatttgcttgccacttcccaaatgacaacactaattcggtggtgtcttcaggtaatgggccttcctttgctcctattagtactaattacttgcccgattagattctgatcggagttcactccgtttgtcagcctctttgttatttccgaatgacagtgagtaaagaaattgcacatgccaattgccttgtctgtaggaatttcgccgtcttgcctgttgtctgggccaaaagcgtcgttttgggggcagcggaagcagcgcgggcggatccgtttttggtggggcgacggccggcacaatcagtcgaacgacaaaagggaacagaaacgtcggcatcgacgagccccagccgaccacgaagagaagcatcgtattgaggacagtgttctcccagggaatggcccggacagaagaaatagcgacgatgggagaacgaacagagcgaagggaagagagcgccgattgggtaagagagagagagagagaaatgccaaaccaaacgatggcaaaggcaaagaagagcttcagacaatcccaaccgtggatgggccgcaaatgttgctgatcacccaaagacggagatggacgcgcaatctgagcttattgtgcaaagaagagggcgaggaattggaaatgtttttggccagagaatatcggaaaagaacgacagaaaaatacggtaggaaagagagtgagggggaagagagcggaagtgaggaaaagcaaacggttgcgggagagggagaacgctgctggatgagaggaggagggtcgttgagagaagggagagtacgacgaaagaaatgggaaagaacggaggaagaggagagaccgggaaaggcgacgagaaagtgaatgagaaaaagacggggatntaaagagcaagggaagtggagagagaggaaaacgggagtttctacaaagagtcggacgccgaccgttgtcaaaatatcaaaaacattttaaaaaagtgatggtttgacgtttgttgtccaaactctagcagataaaatctaagactccacctcgaaacgcttccgaatgtacggaaaaagcactgcaaagaaataatttaattgaaacccatgaaaaaacaagaacatattttctgacaaatgaaatgtattattatttcttgataaataaagactcagtctcttcagtaccaagtttttgttaggctgtaacttttcgtacacaagcaactcgtacatagggttaagctaaaaagttcgaaaatctgatttctgatgtacttttggccataagtttgttcaaaatatgaaattttttcgcaatttttcagactaatagagacacttagggctttcgaatgataccaagaaagttggatttggttacaatgaaaaaagttataattcaaactcggcggttctgttccgctttatgcgtgcgtcccatggccttttatgcgtcccaaagaacttttatgcgtcccatggccttttaagcgtcccatggccttttttttatgcgtccccaaagaact

SEQ ID NO: 32841 - DNA, 177 bp, Heterodera glycines
agtccgtttgcgcaaacacttttgcatttattcctacacggtcgaaattatatatatatatttttttttttgccgtaaaaccggtatagtttaaaagattttctttggcttttacttttggattttatttttgttatgatgtcatatgaatttatgccccggagggcgtccaaaaat

SEQ ID NO: 32842 - DNA, 994 bp, Heterodera glycines
  misc_feature (837)..(837): n is a, c, g, or t
  misc_feature (865)..(865): n is a, c, g, or t
  misc_feature (922)..(923): n is a, c, g, or t
  misc_feature (928)..(928): n is a, c, g, or t
  misc_feature (933)..(933): n is a, c, g, or t
  misc_feature (935)..(936): n is a, c, g, or t
  misc_feature (966)..(966): n is a, c, g, or t
  misc_feature (983)..(983): n is a, c, g, or t
  misc_feature (987)..(987): n is a, c, g, or t
atattgccaagcctgacggattgttaggctggctttctcgcaatatggacaactcagaaaatcatgacaattcgtttgaccaatcaaattgtcctagccagaaaaatcaaactaattattccgctgatacgtcaacagatttattaatgttaccaaatacagtaaatcattatattcattcaaatccaatgatgactttaagccaacaaaattactataatcaggaaaacccatcgacgtcaaccaatcaatcaacttatcctgatcacgcaaacacaatggctttgaacaatcaatcgatttatgctgatcaggcaaacacatatgcattgaacaatcactcaactttttctgatcaaacaaactcactggcattgaacaatcaatcaaattatcctgatcaggcaaactcattggcattgaacaatcaatcaaattatcctgatcaggcaaactcattgacattgaacaatcaatcaaattatcctgatcaggcaaactcattggcattgaacaatcaatcaaattatcctgatcaggcaaacccattggcattgggtaatcaatctacttatcctgatcgctcactatttatggcgaaccaaaacaatgaagttaacggtcttattccaacaattgattctgatcaagctgatcaaactattttgcaatcaaataaaggctccacgggacaacaactgcagcaaaatgtgcaagttcagcagggaaatcttccgacaatgctaagcatgacaacgccagtgcctgaacaaccattcgatgggacgcattcaatggtttctcaatatcgaatatttttgtacccattctttttgngggtttttgttttttatttaattattanaaaaacataaaaaccaagaaaataattcagaaccttaacatcaatcaataactgtgnngcaanagcgncnnattgagaacccagcacatcatcatcatcangtgacaatctaaatggntcangaaatga

SEQ ID NO: 32843 - DNA, 918 bp, Heterodera glycines
tctactcttgatgggttctttgaagaaatattcgatggttctcaaccacgccggccttcgccgtgaattggaacagaaaaaaacgcaccctcgggcgcagtcgcgtggcgccgccaacccgaaacagcaacaacaggaggagggacgaatccgagtgcaactcaaaggggacgacggagaaaatcggtcgggggacggggaaggaatccgacgacaaaaatatttttgaaaatcggaggaaatagaaaaatttacgaatggcaaacaaaaagaaaatcgtttttgtaactttgaccccattattcagtgggcgaaggggcggcacagccaaagttcatgacccgacaacaaatgatggaatacgctgcggaaatggtgcccaaactgaagacacggcagcagcaaacccaagtcgaacagaacgacgcgacggggaagcagaagaagcggaagtgaacgaacggacggacattcaaccaatgacatcaaatgtacaattaatacaattgttgtttgttatatagaactctcgttttctttttgatgttgtatagaattttggttagaaattaataacaaattcagacatttttcaccgcgttcgaaatggttcagtttttctctattaacccagacaaagaaatagcactcaaaatgagagatattggcgctaggtggaaagtggccgattttgaatttgcaaaatttttataacagtcataaaaatttattggtaatagtaccaccgtggtaaccccccgatttcgaaaaacaaaatttttgaaatattttttcgagataagattatattaggggttttaagggtcggagaatccgaatctgatattaatttcggcctatgtcgaaccccgaacccggattcgagcaaaaagtctaacaatccaattttccaatttc

SEQ ID NO: 32844 - DNA, 905 bp, Heterodera glycines
tatgtgtataaaatttatcaaaaaaagagatagccatttttcttgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttct

SEQ ID NO: 32845 - DNA, 937 bp, Heterodera glycines
catcaaatcaaaaaaaaaattaatcggaaaaatttgccaattagcaaaaaaaaaatgaagttggcgaaattccaaataaagcttcgtataccgcggtgggaaagtttcggttctagcacaaatgccaatatttccttccatctgtggcataaaattaatatacgatcatcaagtgctgatgctaattgtatgccaaatttggcaaaaatttcgttaaggttcagaaatggaatgccatttttccgctatttatggcctattttatgtccatgaataggccagcgcctattgaaccttaacataattattggaaaaaataattaatgctaattgagcgtcaatcatttaaagcttttaaatggtaatgtgagaatgcttagtttgttggttggatatataaaaattgatgaaattttcgtaaaaaaatttagaaaaattttgtatagagaattaaaagttttggaatggtgccaaaaatgcttttggctacgtttgaaatgaaaaatgtattaatttgaatgacggaaaatggaaaaaaaagaagaattaatgtatgatctttaagctatagttcctcaatgcttgcgagaatattttaatttaactaagtcatcaatttttatttgtgaaaattcttttttctttttttaaaatcattttgccagggggaagagggaataaaatttggacaattaaaattaattaatttgtcgggaccctaaataagtcattttgaaaattttaaaaaattaactttttgaaaccacttttgccaattcaattatcgcccttttcaacacaaaataatggcactaatggggcacctttccgcaaaaccaatttaagtggcaaaaatgatgaagctgtgaggggaaagaaggaacaacggcatggcacaattcacaacacatcaagcgtcatcaagaaaacggagctg

SEQ ID NO: 32846 - DNA, 155 bp, Heterodera glycines
tcatggaatcacgcacctcatggaattccatgcacttcatggattcatgcacgttagcacagctagacacctttatgtggcaattgggtaatacttactttaaaagatagaataaaggaaaaactacctaaaatttcccataacatttttttttt

SEQ ID NO: 32847 - DNA, 754 bp, Heterodera glycines
aatcgattatatatgaaattagtaaatttactcttttatttattttttgttcaatctgtttacacattttcgtattcttaatcattttcaaacttaaaaaatcccaatactattgagaatgtaaaagcagggctttgaatgtgaagtttaagatacatctagcaaaaaattgcgatacatatattatattattataaaaaatagaaaagattagttgaaaatctgttaaaaaataaaaatattaatttcagataatgcaataagtatcttaacaaatgaaaaatgaaatagatgaaatattaaataaaatacataatatttagcaagaaacagggtttcctaaaattagataataaacgaaaaaataataattttttcttaaaaataataaatgtttatttacaatacatataatttgatataaaaaatattgaataaatgcaaaaccacagcagtctcaaaaatcatgaccacaacatacaagtaaattgaaaaatgtcaatattacaaataaaatggttttgtcataacaaaatgatgaaattaacgaattaattaaattcaaaattaataaacgacacaaaattaatttagtcactcgaacgccaaatctgttgaataattaataatttaaaaagtctgaacaaagatgtcatcaattcaaaaatattagtttagctataacaaaatatttaagaaattaatataatataaaattaaacaaaagggtaattcgagatttaattttttaatg

SEQ ID NO: 32848 - DNA, 249 bp, Heterodera glycines
cagtgagccgagatcgcgccactgcactccagcctgggcaaaggagccagactccgtggcaaaaaaaaaaaaaaaaaaaaaaagagattctattcacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagt

SEQ ID NO: 32849 - DNA, 288 bp, Heterodera glycines
  misc_feature (12)..(12): n is a, c, g, or t
tataataacgcntgcggacatctacatttttgaattgacttttattggtaattactctttctttttctccatattgaccatcatactcatactccccccacccttttcttcttccgccacccacctcccccgctacgcgccgctcccctccccttcgtgctcctctcttgatagtttaaactgaaggcgggaaacgacaatctgatccccatcaagctagctgttgcgggtcctgctcgagcggccgcccggggatcgacccccgatctagtaacatagatgacaccg

SEQ ID NO: 32850 - DNA, 884 bp, Heterodera glycines
taatgaggaaggaagaaagaataattagcagcaaatcttctacggtgaccgaattcgaccaaattggacacaggcgcaataaaaggacgaacaaagggaggaggaggagaagggcacggaggaagaacagaagagacactcggcacgactgatgacagtgctttcctccgaccaattcggcacgttggagatgaaccggcgaaggttggagacggagcagagacagttgcgcgagatgggagtgatttgacggaaatgggggaaagagtgacggacggacggacgaacaaacaaaactttgctctttatttccataagttatatgaattaaaagacgtataatagaacactcaatgcattgcatttcttcattgtccatgaattcctctgctgatcgctgttttcacattccgttggtctgatcagtggtcactttcattggttcctctctgatcactcccaccactccgcatgcgatccgttttcccgcattgcccgtcttcccactctcctcattgccccccttgcccatgtcgtccgccttctcatgtacgaccaatgccctcccgaccacactgttgacgccgttcagtgccaccaaatagtctttaatgtccaccacggccaccccattctcctgaacattatatttattggcatttcatcccctttcccaatgaatggctctttctcacagcggctttcacattgcccaggtcgcccacgtgtctttcctccgattctttgctcccgtggcgttttccgtgcggattgaaatgcgcacccgccgctttgcagctgaaaaagcaaacaaaagcggagaccaatgccaacaaaggagggacaaaacgaacgcctgggaaatgtcgccgaattggtgaaag

SEQ ID NO: 32851 - DNA, 871 bp, Heterodera glycines
aaaaattatactgatctgcttaggttataaattagtgcgacattttcgggtcattacttgcggacgaaactattctaagtaaaaaacaattgaaaatggaatttacgaatttgttttaaaattttcaaaattatattttttcttatatacagagatgtatatatatatatacatattttattttctgagttaaatcaaatcaaattcaaaaataatttgatcaaaactccttgaagcaaaaaaaaacaaaaatgaaatgaaataaaattacgatcctttgaattttcttcaattttaagcaattaattttaaaatatttgttgtttttcatgagagagttgaaagaattttttgttgcacagcacactttttagctttttgtgaagtgtgaaatgccgatgtgctattcgagaccgagttagggtttttagtggtcttaaatgcgcatttttaaaacagatgtaataactagagctcgacctggacctgctggatccaggcctggatttttcctggaaccaggtccagaatgagtttcaaaaaatccaggtctcgaggaacctggatttttcctggacctggatttttatccaggtccagcatggaatccatgtcacagtctttttcaaaatgtcgaactctagtcataactttcgtatttcattagttttctaaataagcgaaattttttattccattaattatgcttttatgaatataaatccacaatttcttttgttttagctgaatcgcaccaatcatcagcagaacagcatcagcttcaaaccgatttcttggaccagcagctccaaaacggcgcatttttggccgattttgccggactttggctgctcgggctggacatggtgcc

SEQ ID NO: 32852 - DNA, 818 bp, Heterodera glycines
ttgaccatttgatttgcaatgccaaatacgaccctttaattatctcccccatttcgctgattggactcggaactctctccccctcccctccccgccggctaaggtgtgcgggtcggacaagcgcacttatcgtaatgcgtgccacttggagcgtcgcaatgcgacgggcactctgagctcgactcatcgtcgatgggcgtccgcaactgcgactgatcccgcgggggaaagcgacgggtgggccccgctgagagtgctttacccgggcgaatgttgccccgtcgtggactgcccggccgaatatgcgcccgtctgcgacagcgaagggcgcactcatttggtaatgaccggcgggagggggcggcggggggggggggtaattattaaactattagccaataaaaatggcagaatctgtgcgagttcggctaccaacgatgtttggcggagcgaatgcgcgcccgaaatatgaccatcgccttttacgggctttgccccgactcccattgcccgaggggcccatgccccggcatttttgagccgatatgtgcgacaaacggtgccaaaaagtgcactaagaaatcatcagaaagaaacactttttgtcgcaggaaaaacgtatcagagtctctgcgaattgaacaaaacgatttgtgtgttgaaaagcggcggagagacagcgcggacaaacggcgtggaaatggtcgattcagtccccagcgggggctcacttggcctggattatatcggagagagagggcatttgatcagcacgggagacaatgacagatgctaatttaacagagacattttttatt

SEQ ID NO: 32853 - DNA, 1010 bp, Heterodera glycines
  misc_feature (861)..(861): n is a, c, g, or t
  misc_feature (923)..(923): n is a, c, g, or t
aaaccactaatgttttttcaaaagcatgacacacattattgtctcacactaaagtcacaaacaaaccactaatgttttttcaaaagcatgacacacattagtgtctcacactaaagtcacagaacaaaccactaatgttttttcaaaagcatgacacacattagtgtctcacactaaagtcacaaacaaaccactaatgttttttcaaaagcatgacacacattagtgtctcacactaaagtcacagaacaaaccactaatgttttttcaaaagcatgacacacattagtgtctcacactaaagtcacagaacaaaccactaatgttttttcaaaagcatgacacacattagtgtctcataaagtcacagaacaaaccactaatgttttttcaaaagcatgacacacattagtgtctcacactaaagtcacagaacaaaccactaatgttttttcaaaagcatgacacacattagtgtctcacactaaagtcacaaacaaaccactaatgttttttcaaaagcatgacacacattagtgtctcacactaaagtcacagaacaaaccactaatgttttttcaaaagcatgacacacattagtgtctcacactaaagtcacagaacaaaccactaatgttttttcaaaagcatgacacacattagtgtctcataaagtcacagaacaaaccactaatgttttttcaaaagcatgacacacattagtgtctcacactaaagtcacagaacaaaccactaatgttttttcaaaagcatgacacacattagtgtctcacactaaagtcacaaacaaaccactaatgttttttcaaaagcatgacacacattagtgtctcacactanagtcacagaacaaaccactaatgttttttcaaagcatgacacacattagtgtctcacactanagtcacagaacaaaccactaaatgtttttcaaaagcatgacacacattagtgtctcataaagtcacagaacaaaccactaatgtttt

SEQ ID NO: 32854 - DNA, 249 bp, Heterodera glycines
tttttaaattttttttatttaaaaaaatgtattcaaaatttcaaatatatataattatttgcaactgtaatcaatgaataattgtttgccttaatttaaaattattttcatataaaaactttgcacttttttgcccttaaaaatcatatccctaattataaatgaaagctgccctaaataattaatgcgtttttgcccaaattgggctcaaaagggggaacgcaattatggaggcgtaaatagggaaat

SEQ ID NO: 32855 - DNA, 542 bp, Heterodera glycines
ctgctgcacggttcggctactccttcattggcggcctcccaggccgctctcggtcacctcccacaacacggccaagctatttagttcgggagcgtcggcaaatggcggactgaaaacgaattgtaaacagagaataaaactaaaagcgccggtcaatgaaccggactaaaccttcgcgcgagcatttcccagagacaaattccaagagagaaaacgtcacaccgaaagtcgtaactaagagaaaaagcggcattcctattaggcacaaaagagtccgctttgttttgcctctgatcagtctccataaatattgtaatacctctcccctctgaacacttcgggtgccatccatgcggccgtgccacaagtgctcgccatgtccgtccgatgcttagcgattgtgccgaagtcgcaaagtttcaggacgacataatcaagagacagcaacatactgaaaataagaggaaaagaaaaaaagagccaatgatttgcaaatgccattcatttctatgaaaatgaacaaaattttgaaatgggtgacc

SEQ ID NO: 32856 - DNA, 1010 bp, Heterodera glycines
  misc_feature (937)..(938): n is a, c, g, or t
  misc_feature (970)..(970): n is a, c, g, or t
  misc_feature (972)..(972): n is a, c, g, or t
  misc_feature (978)..(978): n is a, c, g, or t
ttatggttttatgaaaattgtatgccaattccattttccgttcgccaatccgtcaacatccgccgcaaaattgttggtgtctttggagccgttgaatcgcaaagttccgcctcagtttcggcagcgccattttacgcccaattatgcagaaaatgccagtggggacgactcgtttcgatctaaggtatgggactcgaaaattgaatgcaaatacaaataagaattttattttattaaaaaaatatatttaatcggagggggggggcgggtgcgttccccacaaaaaaattttttttttttttttggtacttttccgttatggtataccccccgaaacttttttgtttacatatttttttcaacacctattttatgtgctgaaaacaaatccggcatttttttttacaagaaaaacgtgaaaaatgtgaacaattttttttcatttttacattttccacgtaaaatttcacgtgtttttttttgttgtaaatgacgtaggaccaaaaaaacaaccgagattttttttaagtgaaactgacactcgagcacctaaatttaagatgtttttacacggtataccccaaaacacagccgtcgaaacacagccgggaacaaatttttaaaaaattttcaaacagaattttttaaagaaaaaaaaatcttagaaaaattttttcttagaaacttcgatgacatttttttttttattttcagcgatttttttgaattttttttttgaaaaacttgtaattcatcagtaaattttaaaaaatcgccagaaaattttcaaaaattgttttcatcgaattttctaagcaaaattttgcttatacttttttcttgaaaaaattggctgtgttatgtcttgactgtgtttctgcggctgggttttgtcctgttccggtttttacagcaattaaagatattactttaattnnttgcagtattacataacgccagaattgggttntnattttncaaaaacttgataagaaaaaaactcatgaaat

SEQ ID NO: 32857 - DNA, 815 bp, Heterodera glycines
gtaagcagatttcctttaaaagaatgaccaaatattgagatttttggctaattttttaaggaaaaatagtgacggatcaaaattacttccttatttcaacatagtcccgtcatctcctaacccttttgccatcacttgttctttgtccaatccctttaattgtcagtgggcggtccgttcccgatcactatttaagcttttagcgcccctcacaattgttcatcccctggttcattttattccacctgtctccaactgtgcagacacgaatcgggaggtgttccacactgtcgactgttgttccccctttccccttccgaataaaggatattattcgaattaccgctacacaatgttttggggaatgcattaacaccaaactatcccaaccatatttttatttaatattcatggaggtcccgccgctgtacatttggagacggttatttgttcatcatttttttcaaccaaatattttttgatttgtttgatttggtaagaactcatttttgaacggatgaaaggctgactgatcagtgctcagagaattggaaaaaagaggaaatctggggaaagattggagaatgcccagtagaatgagcgatgagaagaggctcagatttgagagataaaactgatcagagagtgatcggttatctctaaagtcaaaaatgatccgagagggatcaaaaatgaatattttgaaagggaactcgaacatgagcaaattatgctgaaaaagatcagaaaatcatcgagtgattcggcagaaagtgatcagttatctgtaagcaaacgttctgatcagaaaatta

SEQ ID NO: 32858 - DNA, 984 bp, Heterodera glycines
ccctgcaaagttggtgcgcttctgatcagtttctgcaataaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcacccccccctcccacgcccttcagagcacgacaaatatttcaacaaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccttttttcgcaccgtgaatgttatttttattgaattctgaaccgttttgagtagattagactagaaaaaattgaaaattttgaaatcatgtttcccactcccttctcccaggggtattattttgtaaagtctttttttccccaataaaactttttcaaaccccattttttcgcacccgtgaatgttattttta

SEQ ID NO: 32859 - DNA, 952 bp, Heterodera glycines
  misc_feature (862)..(862): n is a, c, g, or t
  misc_feature (876)..(877): n is a, c, g, or t
  misc_feature (909)..(910): n is a, c, g, or t
taatatctttcctaaggctggaaaggcagaatttccattgacagtcgatatttacactgagcacccgttgaagcgggtgatgcgaagccatagcaaactgtatttttaaattctggccgcaactctaccaaaaacgtgtttagaccgcagtaactcggctcagagtgaagattaagggacgcaaaagagacgatttaaaagcgattcgaaaattctatcgactaatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttcccataggctgngaaggcagaatttnngatggcagtcgatatttacactgagcacccgnntgagcgggtgatgcgaaagcatagcaaactgtatttttaaat

SEQ ID NO: 32860 - DNA, 914 bp, Heterodera glycines
ttgaagcgggcgcgaagcaccgaggccacgaagtgttcttttgagccccacaaatttagaaatgggcgcgaagcgcccatcttagggtgtaaagcagcctacaaccccttaataacttttcaaaaattcattgctttcattatgttaatacatgttacatgttacatgctcagagaggaaattcatgaactccctccgttttcatgtaacatgtaacatattttgaagcgggtgcgaagcaccgaggccacgaagtgttcttacgagccccacaaatttagaaatgggtgcgaagcgcccatcttaggccgcaaagctgcctacaaccccttaataacttttcaaaaattcattgctttcattatgttaatacatgttacatgttacatgctcagagaggaaattcatgaactccctccgttttcatgtaacatgtaacatattttgaagcgggcgcgaagcaccgaggccacgaagtgttcttacgggccccacaaatttagaaatgggcgtgaatcgcccatcttagggcgtaaagctgcctacaaccccttaataagttttcaaaaattcattgctttcattatgttaatacatgttacatgttacatgctcagagaggaaattcatgaactccctccgttttcatgtaacatgtaacatattttgaagcgggcgcgaagcaccgaggccacgaagtgttcttacgagccccacaaacttagaaatgggcgcgaagcgcccatcttagggcgtaaagctgcctacaaccccttaataacttttcaaaaattcattgctttcattatgttaatacatgttacatgttacatgctcagagaggaaattcatgaactccctccgttttcatgtaacatgtaacatattttgaatcgggcgcgaagcaccgaggc

SEQ ID NO: 32861 - DNA, 931 bp, Heterodera glycines
  misc_feature (902)..(903): n is a, c, g, or t
ttgttttattaactcaattattgtacttgggcccccccaccgggcattcccagcagatttctgtgcctgggccggccttcaaatctttcatccgtcccccacaataccgccctttctctccctccaataaatctcccattttctgtgcccccccccccctctcctccacaaatgaaatggcattctctcctctcttcagtgccccgttctctttctcccctcgtcttttttctgcaatctctccctcacaccaaaatcccttcgtttgcccatcaattccccccccccctcccattttctcccatttgtctagggaaatgacgccaatttgtccgccagtgaattaatttccccgaaggaatgaatacaaagaccaaacaaatgataaacagaaaaaagttggaaaaaccctcaagcttaatggttatgtgaagaaagacaatatcatgagaataaaatcaacaaaaggaaagaaaatcccctcacaattccccgaattaatcgtttgtaccattcaattttctcgagttcattttgtttgtttcttctctttccatggtgtcaaaaaagtgccggaagggaacaatgaataacagcttatgatggatggatggatggttttggtttgcctcagatgttttttatttttgacacttccttttctctctccctctctttttttctttctttgaccctctcttttttctatgtttctctcccgccttttgcgcgccaaatgggtttttgaaaagatgtgttgtcggagaaaaataagtggaagttttcgcagcaacaaaaagcacaaacacaaagacattcattcccctttgccctcgggcaaattcggattctgccgaatggatgcaaattgatgacggctcagatggccttcgtccgactgnngaagggatggatgaattgtcgtcgtttt

SEQ ID NO: 32862 - DNA, 1397 bp, Heterodera glycines
gaaactatcggaattccaatagtttttgaatacttttttagggtgcattaggacctccccctcccgcttttttaattttcaaacctagaaaagctattttttaaattttataataaaatattgtttttcaaaaaaaattttttttgaaatttcgaaagtttaaaatttttaatatttcgggggggggggggggcaaactgcatttttttaacccgaggctttgccatttggtttttttttaatttagccgaaccgtcggggttcgtcttggtcgggcacagccgtgccctgctgtcgttgtacgggtaaattttgctgccccggttccggtgcaaattgtgcggttggacagcgaccgaaaagtcggcggacagacttttggccggaatgccggaaaattcgagttccgaaaattcgggcaaatttttgttggcattctgttgctgctgctgctgttggtggtgatgtgatgaggaatcatccgagccaagcgaagactgaaaaaaaaaacaaattacacaaatcaaaagtgatcatacatcagaggctaacaaattgcataaaaaagtgattagaaaaacaaaaaataattttattaaaagtgattagaaaaaaacgaattgcatcaaaagtgatcagaaaaaactaaagattaaatattaaactaattaacatatcaaaatgatagactaagtttgattccgcggtatcattaatgattgatcagaccgctttttgtcttttgtaaaaaaacaaatttaaaattaaatttatcgattacattaaaatgcacaaaaaatgaactcggctgaatcagtgagtaaatgcactgaatcaaaattggcacaaagaattttagtctttttcaacaatggtcactataagaataaggtcagcttaccaccaaaaaaaatcgaatagcttttttaaatttttgttttgttaatgctttttatcagcactactgcgattgtgccgtgccgatcattattcctccatacacacattattgtgcaacaacagatcaaccgatgataatttatgtgatcagagaatgcctgattattttcatatgtttatgtaaaacagtgctaaatcatattcctattggcttcacttgcctgcacacaaagcggcgccgtcgtgtccgagtgatgtgatgaggtggcatttgatcgggggcttgatctgctgatggtcgttgcttcatcaaccgctgctacagttgctgttgtgccaccgcatgtgccattggtgctgatcagtgccggcggcgaattggacgggcggatcaaaggggaggccgcttcgggcggaattgggtaaataactgcgcgctgttggccattctcatcaatgggttggccctggaatttgaatttgattaaaaaaatgat

SEQ ID NO: 32863 - DNA, 931 bp, Heterodera glycines
ctaatgttttttcaaaagcatgacacacattagtgtctcacactaaagtcacagaacaaaccactaatgttttttcaaaagcatgacacacattagtgtctcacactaaagtcacaaacaaaccactaatgttttttcaaaagcatgacacacattagtgtctcacactaaagtcacagaacaaaccactaatgttttttcaaaagcatgacacacattagtgtctcacactaaagtcacagaacaaaccactaatgttttttcaaaagcatgacacacattagtgtctcacactaaagtcacagaacaaaccaaagatatgcatttctatttcattaaaagttcaaataacattaagcataaacataattatttcacgtaaagaacacaaaaacaaaataaacaaacaaacagcaaccactaaatcaaactcaaacaatatactgataaattttttcgtttacaaaaaacaaatttatataacaaataacttaataaactatgaacatacataaaaaagcaaataaataggtacaattttaagaaagtttattgcaaaacaaattgaaaaatcaaaaccaaacattttcatttttcaaatgcttttttaacgcaaaacaaaacaaaaacattttcaaatcattttttaacgcaaaacaaaacagcacgccacaataacaaaacgccaggttacataaggacactcaactttagtatataggaaataaagtttccaacgcaattaattattctgctcttttttgtgtgacatcattcggacggaactcggcaaattgtgctaattgccacaaaaatggaccgacggtaatgcatttttgaaaagtcacatattcttgtttgcctaattttatttcggctcaagtacagtttatgcgtccaatgaattttttacatcgacttgtatagcatt

SEQ ID NO: 32864 - DNA, 1421 bp, Heterodera glycines
ttcatttcattccgctaaatggactgccgccatgtcaaggaatgtccaatcaaggcatttagactttcaaccgtaaattttggtaccaaattttgggctgtcccgcatcacggtgggacttaacagcattgtgaagcataatttaaaaccgaaagaaatgttcgtcaattttttactttaaattcaaagaccaaaaaaaaaatcggggccaattttgaaagcgaaatagtgcaacaaaaggaacaggtaggcgaaaagaggaaatttttagaaaagggtcgcaccccatctatattcccttctttcatttccatatccggctaaatgtgactgccgccatcgacatgggcatttttgcttcttcttagacagaaggaagagggagaaaatgtaaaagaagtattggcgacgaggacggcatttatttccattggcaattgatgtattgggatttgtcacaaacgaggcaaaagcaggggaaaagcagcgaaaacagggcaaatataattgaaatgagattgaattaaatgttttttctgtcttacttttttgtttctgtttgaaaggcgttaatttaaattcgggggtgaactgtagtgaacgccccgtgaaaaaatgggtcaaattatataccaatcgattcgtctcgaggagctaagcacggaaaaatatgtctcgagttgcggaaatgccaaaaaaccggtttttgaaccggtttaaaactcgaaaatttgagtgaaaaggggggttcctgaccttttaaaacgctcaaattcggacaaatttggtatcattcgaaagcgcttgatgagctaagtctaaaaaacaaggtataaactcgaaccaatgccatctaagcactgggacaactgagtcccagagaaaatggacacttctgtaccaaaaaaaaagttttcttcttatataatgcacgaaaatcgagtaggcttgaataattaatattgaggtaaactttgccgcactctcgactactgaatccagtatgtggggcgattgtatgcttgacagagtaagaactcgtacgactaatgcatagctggtgatttgagccaaaagttcttcgaagaatgtcgagaacaatgtttgtttctcagcaaacatttcctcaaacaactcatccaattgcgctatttcggaacaaattaggtcatctagtagaatcaacttctgcataagtcaaaggatgattttgtaactttgttcatgaaatatttcattggtagtaattggagttggaaccagcgatcaatgtagttgagcacaattttgtaaaaagtaacaaattggttcagaattttccgattgaaaaaattcatgtaaaacacgcggattgttcggcattgcaaaaagctcttttaataggtgccatttctctaacatccggatgaccacttttgata

SEQ ID NO: 32865 - DNA, 943 bp, Heterodera glycines
aataattaattactaattacgtcttcactcccatttctttatcatttttgatcattctttgctattttagatggccatcgaattgaacaacaacaacgcatgtgcatcaaccgaagaggacacaagcagttcaccgaacgcggccaatttgaccggcacgcccagcggagaggcaatgagcggtgaggaaagcgcacgactcaaacgaaggttatttttgcggatgaaacagttcaatcctaaagaaactcattgagttggccgatgcgtcaataagtaaaacttaaaagaagcttttaaatgtttctgtggtttctgggtggcaatggacccgtaatcagagatgggggggggaagcattcctatgaaaaagtgaaaggaaaaaactaatttcctttgattttttcggttgtcataaaaataatacttttgagtcttttatgactttttaatcaaattttcatctctctggactattacattacaccagagtatggaaaacaattgtgctttttcgcatttaatttctatgcattttcccttttcttaattttttacctgaccatagtttattctgcaaaaaaaaattgaaattttttgttcagttatgttctgcaagaattggtggagtccgagcgcacttacgtccaggacctggcctctatctcaggttctaatcccttcgaatgccggacgaattcggaaatcgcaaaatgcgctcctttcagacggttacatcgcctccctgcgggaaatggaactgagcgacgaggacagagagaaagtgaagatcattttcgccaacatcgagcagattctcgactttcacaaaacattctttttgaaagaaattgaaaagagtttgaacgattacgaagcggcgggcattccttcattaatatgtgactcatttgggaatttggacgcattttcgaacatttta

SEQ ID NO: 32866 - DNA, 987 bp, Heterodera glycines
  misc_feature (898)..(898): n is a, c, g, or t
  misc_feature (924)..(924): n is a, c, g, or t
aacaaaagaaagtaggtcctgaagctcaacatttccaccctttacagcagccactgaccaatctacagtatacaacagtccatcaaccccaaattgtgcaggatcaatttgccagccaaaatgccttagttcaacaacaattggctcagtcagtgcaacagcaaacccaaagaattcaccaggagaatcaatttatgggtcaacagaatctagctggcataaagaatcagtaatatttttctaactggaaatattatagtaaaactgaatgggtatctaatgtcaaaagaatatgggaattgatgaaatgggataaagcgtgaccggaaaatgcgtcagtgatacttttaaaataaagttctgtagtattaaatgttgtatttataaaagtagaattttttataagaacatcgttatcattcaatatgagatgattacactattttgaaccaaaaatgcttaattcgaaaatttggactttcaactttttgttcgagttcgggccagggattcgaaattggccgaaatggataccggattcgtgaacaatgaccatcaaaaagccaagaaacttctttttatgacattaaaatattcactgacgcattttccactgtcgcatttttcgggggcgaggatagagcacataagagaatcttcaagagggggaaatccgtagtttagttggttacaacattctattgttcggtagtaccgtagattcgagttcttaagtgtaaaaagttgtttctgtagtaaagcaattgagtcgaggcatttataattacaggcaattcctaataaattatcatggacagaatctgcaaccgcaatcagtgcagaatccatcacaaatgccgtcaacaggaaaatcaaaaatttcatggcaacaaacaanagaaagacacacgggcaatatgcacntcactagctcttcaactttatcatgccatcctctactagctcttcaaactttatcatgccatc

SEQ ID NO: 32867 - DNA, 436 bp, Heterodera glycines
ccccccaccccctctgtccatgtacctatcccccacttcccagcgatttttcaaaaaaaattttttttcccattttacttccatccacaaattattcattcaccttgacccattcgtccgccttaacgccgtccagtatgaatttgtcctccactttgaccagcaaaaacttggccttcgcctgcgttgggtccgccgcggtggcgacactgaacggcacctgccaaattgggctgttgttcgcctcgtcccggccgccgtccgccaaaaagcgcgtctgactgaggcgcaactcgcgccggtcgccctccaacacgcgctgctcaacgctgaccagcggaaagcccatctgctgggtccaggagcacatcaacgctttcacatcctgcaaattgggggtgaaaattttattttggcaaaatgaaaaaaattgcag

SEQ ID NO: 32868 - DNA, 523 bp, Heterodera glycines
acaaaaaatcgcgaaataggcacctaaaaagcattaaaaatcgcaaagtaggcattaaataggcacaaaaaccctaaaataggcacaaaaacaggcaaaaattttttttttattaacgcttttttggtattaaaacaagtaaaattttaaatatttcaattgtaaatgaaattattaaataaggacaaaattttaaaccaaaaatttttattaagaaaaaaatatattaaatgttgggatcatttttttggagaattttttcaattctaggggtgtgtttttcgtttttattgcatttttcttatggattttttcaaaagcctaaaataggcactttaggcacaaaaaccacaaaataggcaaaaataggcattataaaagtcatcgtagacaccccaaaccaagcggaaagcgcgtttttcgtgcttataaaataagaaaaagaagaaaagagatagagagagattaagagagggagagagaaagagagagggaaatggagagagggagaaaggaaaagaga

SEQ ID NO: 32869 - DNA, 1469 bp, Heterodera glycines
  misc_feature (52)..(54): n is a, c, g, or t
  misc_feature (99)..(99): n is a, c, g, or t
aagacagaaagtgtttcttctattccgcaaatgaattaggtttcaataaatnnnaccttcctctaaaaaaataatttttctgtcggacactatactaanagttcttaaaccgtttgctattgcaagatagaaagtgtctctctattccgccaattaattaggtttcaattaaatcaccttcctctaaaaaataatttttctgtcggacactatactaaagttcttaaaccgtttgctattgcaagatagaaagtgtctctctattccgccaattaattaggtttcaattaaattaccttcctctaaaaaataatttttctgttggacactatactaaagttcttaaaccgtttgctattgcaagacagaaagtgtctctctattccgccaattaattaggtttcatttaaatcaccttcctctaaaaaataatttttctgtcggacactatactaaagttcttaaaccgtttgctattgcaagccagaaagtgtctctctattccgcaaatgaattaggtttcatttaaatccccttcctctaaaaaataatttttctgtcggacactgtactaaagttcttaaaccgtttgctattgcaagacagaaagtgtctctctattccgcaaatgaattaggtttcaattaaatcaccttcctctaaaaaataatttttctgtcggacactatactaaagttcttaaaccgtttgctattgcaagacagaaagtgtctctctattccgccaattaattaggtttcaattaaatcagcttcctctaaaaaataatttttctgtcggacactatactaaagttcttaatccgtttgctattgcaagatagaaagtgtctctctattccgcaaataattaggtttcaattgaaattatattcatataaaaaatactcaatgggtggtactcaataataaagctcacaatgggtgtttgacaacaagacagaaacgactatgtgtgttagtcacaaaatactacgcttcaatgggagttagtcaaatatacaacacacaatgggcgttggtcaaaataccaccactcaatgggcgttagtcaaaacaacgccgcacaatgggcgttagtcaaaaaaccgcctacgacaatgggcgttagtcaaaaatccgccacacaatgggcgttagtcaaaaagccgccacacaatgggcgttagtcaaaaaaccgccacacaatgggcgttagtcaaaaaaccgccacacaatgggcgttagtcaaaaaaccgccacacaatgggcgttagtcaaaaaaccgccacacaatgggcgttagtcaaaaaaccgccacacaatgggcgttagtcaaaaaaccgccacacaatgggcgttggtcaaaaaaccgccacacaatgggcgttagtcaaaaaaccgccacacaatgggcgttagtcaaaaaaccaacgcacaatgggcgttagtcaaaaaaccgccacacaa

SEQ ID NO: 32870 - DNA, 932 bp, Heterodera glycines
  misc_feature (913)..(913): n is a, c, g, or t
cttcctcttcgcctcccttcctcttttctcctcctgttcctttttccctttccatttctcttcctctttgccttctattcctcttcgtcttctgttttctccttctgttcctcttccccttctcttcctcttcgcctttcccttctgttcctctccccctttctcttcccctttttcttcctcttctcctgttccttattccttttcgcttcctctttgccttctattcctcttcgttcctcttcgccttccttcctcttatcttctcctccctttcctctttccctttatcttcctctttaccttctattcctcttcgtcttctgtcttctcctcctgttcctctccccctttctcttcccctttccctacctcttcatttcatcttctcttcccctccctctttttcccttctaccccctcatgttctttttctctttgccttttgttccacttctgcttctcttcaattctcttcctcttcttatcctgtccgtctttccctttctcttcctcttcgcctttatttattcctcttcgtcttctgtttctcttctcctccctcctgttcctctccccctttctcttcccttttctttccctcttctcctcctgttcctcttcccctttctcttcctctttttaccttctattcacctcctgttctctttctctttaccttttgttcctcttctcctcctgatcctcttcccctttctcttcagttcctcttcgccttctcttccttttccccttcctcctcccctccttttcctcttcctcatactcttcaccttttattgctcttcctattctgttcctcttccccttctctttctcttcgcctttttttcctcttcaattcctcttctcatttgttcctcttcaccttctgtatatcttcctctttgtnctcgacttttgttcctctt

SEQ ID NO: 32871 - DNA, 940 bp, Heterodera glycines
ggttatatcgctttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacaaaatgctctgaaacgcaccaaattttatttacatgctagtttaggcactctgatgctttttctatcaaaaagggagatgaataaatttttaaaaatttttaattcctttttaacaggcccaaaagtttaggcttatcttttttttcagaaacttatcagaagcgccccaaactttgcagggatactgaaaggaaaagaattaacctgttttatcacattagcttgtcatcagtttttataaaaattttcaaattctgagtctcctattattttattatttttcaaattttgagggcggggggggggggggggggg

SEQ ID NO: 32872 - DNA, 1012 bp, Heterodera glycines
atagcgcgatagcgctttaaaacatcacactaatgcaattaatgttttgtatgttttaaaataacaaatgagggccatatattaccaagccacgcatgcacaccatagccaactggtcaccctagtttatatatatatagaataaagttgggtttcgtagaaaaaattataagtccccgtggtttgcccggaggctcctgaaagtgcggcattgcttaagcaactttttgaggcgcatctgggaaaaataaggatttttcggtccggcggccagttgagcgccagcggcgctgaaacggccaaataaaaaaaatcgtcgcggttttcgggctgtaacttttctcagggaaccgggagcggaaaaagtccgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcgggttagcgccgcttgagcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccatttttcgagctctatcgattggtggcatttttgaaaaaatttcaaaattttccggaaatagaaaaattttccggaattgagctccccatttccgtttgaggcttataactcgtcaggcgttgattttagcggaaatttgtctaagagcatttttgtagagaattttaagctctatctaatgtgctttatctcatgtttttaccatgagtttaaaaaaagtaaaaaaattatttgtgattttgaaactcaaaaccatagggggggaccccatggtttttgcatttcatgaaaaatttttttactcctaaa

SEQ ID NO: 32873 - DNA, 647 bp, Heterodera glycines
ttttgttaacttcgtccaattcccgcgctttcggcattaaattaaatcctccgatgaatttgacttgtccatgcccttgacacttctgtaattgtcaaagtccacttcgggttgtgaatttacaagaaaaaagcgcgtcttcctgaaaatgtcatccaatcccgggaaattgtcaattgcatatttttgctctgccaattgttggtaaattggatcctgaaaaatgaaatttataaattctctttcaatttatgatgtgaattcattcattttgggtttaaaataaattaaaacatttcttttttaagcctttttcacaagggaacagacaaaattgggcaaaggtgtagaattgtggtcccgatgggaaaaatagtaaaattttaaaaagcattttttctgtggtagaaaaatacgctgatcacgaatctgaactcagattttgaaaaatcattgattttgtctatgactttttatcaagtatttgattttttccaaaaattttaagaaaattaatgggcagtaaaaactcataaaagatgttttagagcttaaaaagagctttcgaatgagctattgaatttatagagaagtcaagtatttaattttctatgattttttaaaatttagcaattaatccctagggg

SEQ ID NO: 32874 - DNA, 1043 bp, Heterodera glycines
aaaaatattgaagaaaacttgaataaattatatttattgttattgaaaaatttttaatttattaatattaaattttaaaaatattgctttaatataattaaatttaattatttttattgaaactgagacaatttccggttcgacctagcacttccaagatctaactaactcacaaattccttaaaaatttcactaaatttttcctaaaatccacaaaattacctttaaaagcgaataaactagttttgtatgtcctgatttttcacgtttgtcctgtatattcatatttttgttattgtaaattaatgtaaaattaatttcttggatcccctgcaaaaattttgaaaattgataaatcgaccatttttaaagggaagaaacaatttgggaacgaaatggagaaggaatgaaatcatttaatattaatacatatttttcaaaagcatataaatttaaaattgttgaaattaaataactggcgaaaaatcacaaattacattttttatttatttatttgcagtttttagggagccgggtcgttactcaaaaaaccatcaaaataaagttgttgtttttttatataattttgcttaaaagcaaccaaatttttagttcttgatagcattcaatagacttaagtgttttctattattttgcaaaatttcataaaaagttataccaaaaatgttcaaaaaatattggttttttgaatttctcatgtcataactttatttaagcttaacaaaactttttgaaatttttcaggtaatttgttagagctatccaattatataatgattataaaattgtatccattttgggcgaacttatgaatcattttctgtcaaaaattttcagagcctaaaaatgtgtgaaccctaaatagttataaaaagtacactcaaattttacgaagtttttcagcaggcgccagcaaaacaatcgcttagtcttgttttttattattatttcactcggctggaatgcgtcagacttgggagggatgaaagttttctaaaaaatttttaacaatccctcattca

SEQ ID NO: 32875 - DNA, 172 bp, Heterodera glycines
cttaatttatgtttttaataactttattttacatttagataggtttaattttgtaggccgatagagcctgttatgaaatttggccatggtcagtgcgaaactcaatgaattgccagaaaataaaagttgaaaaacgattaaattttgaaaaactttcccgcattattaaaca

SEQ ID NO: 32876 - DNA, 909 bp, Heterodera glycines
  misc_feature (850)..(850): n is a, c, g, or t
  misc_feature (856)..(856): n is a, c, g, or t
aaattgggaataatcaatttattcatcgattacgataacaatatataaaattttttatgctaaatagtaaaatgaatttaatgaaaaatcttttttcattttgccaaaaatagtgacaattttatgcgatcgcaaaacaataaataatttatcccatacattcaattaagaaaatattataaaggatataatcatttttatcatgtaaattttaataatttaatttagttttccgagttctttattagtctggtccataaataattgatattctaaaatttattttctcatgcttatttccagagcttacgcatagttttttgctaatctattatcattgaatgcaattgtttatttatgcttttttgtacttttaagtttttagtttcattatcattttttcatttttattcattatttttttaattatatttattggcttccaatagcaatgtaggttggaataaatcctcctttaattaattagattgactgaattcccattcatttaataaagtaaataaataaattaaaaaaaattaattgtttttagttatgaaaaagatagatattatatttgattatataaattctttgtaaattatatataatttatatattctttatattttgtttaataaaatttttgattctaactaattgattttttaaaacaagaatttattgtattcagcgcataataatttattaaattaaacattttaataattttaagtaacattatactgtttaaatatttaattttatcttttaaataaattagtattttcttccttgaggtattcatctttttgggcgctagtgcgtttcataaaactgccagccatanaactanaaaccatgtgctttcttaaactgccagcgcgtttttaaagctgccacccacta

SEQ ID NO: 32877 - DNA, 870 bp, Heterodera glycines
tgtgtgaatttggttttgagtggtcgatcaaaaaataccacgagtggaaggggatccaaaccagcagtgtgaatgaagaagaaagatgactaaatatttttgtggctgtcgttgaaaacatgtgatcgattggacggaggctccgtcagcataaacaaaaattgatcggaccggaaggatcaacaacagtgacaaaattagtagatgaattcgatgggaatgggggacgggggtcggtaatgttggttttgaacaaaaccagttgagtcaaaactgctgtatatgtacatacataataattagggatgcaacttttagtgacgaaaaatctcgaaatagttaactaaaatagtgagtaaaaatgccaaaatagtgaccaaatagtggcaaaaagtccgaaatagtgacaaatagtgacctaattttcagccaaaaattaagcaaaaataatttttattcactggttgcagttgcaaatgagctacatttcctttataaaattctcttagcaaatattgacattttttaaatcaaaaattttgggggagaatttttgaaaaatttttccaattcttagtggtgtatttaaaaaaaatttttttggtcgattcttaggggtgtattttttgattttattgcatttttgctaataaatctctgaaaaatgtcgaaatagtgaaaaaaagtgacaaaacgccaaaatagtgaattttcactattttagtgacgaagcgtgaaaatagtgatttctagtgatcgatagtgagatccaaatcgaaaaatttcaacgcagaaatgcgttttttgagctcctttcttcaaaacaatcgagcaaaaaaaatagttaaatcactaaaagttgcatcccta

SEQ ID NO: 32878 - DNA, 982 bp, Heterodera glycines
tcacaaccccctagaattttttctcaaccttcccgattttaactgtgttttatgggtgtagattagagaacaacatgtacctggatccagccctgtatttttcctggatccaggtacaggcacaggccatttttcggcaacctggattttcctgtacatttattttaaataaaatgcatattctttttttctttttacgattaaataccattaattttaaaacttagcggtcatttgccccgcctgcgggcggcaaaaactactgcggattatgaggaacatgatgatgatctgatgcgaaacaatgctgaacgttttttgtttctttttcagcaccgctgtggcaaaaattgcagaatgaccgttaattgatggcaattacataatttgctgtgatgagaatgagagaaaataacaataaatgttgcaatcaaaatatttgtgttaattgataaatgaaaagtaagcttttgctttttagaaaaattgtcaaaattatcattgatatttcctaaaccaattaatggcacaattttttccgtgaaaaagcaaaatagacaaattttcaccgcttagctacatataaaagtcataactaggctgggaatttataatggtcataaagtattgaccaaaaaacatgaaatatggaaagtaattgcaagaatatggacacaatttttcaaaattaagggtataatttctcaaaatttcttcagattcgctaaatataaagtaaacgcttcacaaaggctaaataggtatttaaaatcatttaataaaaaaataaaggcacaatttatttaacgaaaaaacaacctaattacaaaattttgtttatttttgaacagatttatcaatctttaagagaatttgaatttaaactatgtcaaaaagaaaaatttactattaaatgaactttacacaatatggacaatatgaaaaaaatatgacataattcccgaaataaaagaaaatatgg

SEQ ID NO: 32879 - DNA, 193 bp, Heterodera glycines
agtaatgctttctacgtatataccgcagtttggtatcatgaatgaaaaaagaatggatattatttatcactaatatttatccatttaaataattcattcaaaattatttcaaccaatttaaaatattctagataagttatttttatgcttagttgaaaatatcgtactgaatgagttgtatattaattaaaaa

SEQ ID NO: 32880 - DNA, 991 bp, Heterodera glycines
  misc_feature (970)..(970): n is a, c, g, or t
tcttccaagtctgaagcttgagtccaagctgctaaaaacgtatttggaaaaacttgaataaattgttcaaaattgtgcaattattattatcaaataaatttttattatttaaaaatggatgggtgatattttcatccaattttttccaatttattttttttttaattctgattggggcaatgagttcctggttcacaatcagcagatggtctcagcgattaaaaaaattcttgttttttaaggatggaatttatatttatgaaaatccaaaaaaaaaaatatttttcaaagaaaaatcacaaattattcatgaaaatttttcaacttttttttttgttgtaaccctcacattttctctgtgctgtgcctctttgatgtattggtccaggatgaacagctggtcgttcttcaccagtgtgtaattgggcgggatctgttgcaacagtgttgggaatgtgccatggtccggcttgggtcggcccgcgcattcttcgccacgttcgttgagcagtcggacaatgcacgtcacacagccgctggccactggaaaatttgggggaaaaaagggaattagtttaatttaatcaattttatacaatttaaatattggcattaattaataataaccctacccttctttgcggtgtcaattatttcaacaccaagctgaaaaaaatagaaaaatgcattaaatgtttttaatggtaattgctttatgctgatgtgagcagtaaaacggggtgcaccatgtttcttcgcccaaaaattaaaaaatttttcaaacatattagaaatttaaaaaaaaaccttaaaaaagtttttaaagaattaaaggaacatttttttatttgagtgatgtttacagttttcaaattgtaaaattttttttgaaattttataattgtaagtttgaaaattttcaccggacgagtttgttggaccagctttttatgcttctcaaccataattnttgaaaataaaaaaaattcca

SEQ ID NO: 32881 - DNA, 803 bp, Heterodera glycines
aattttttaatttcgtatttaaggatcatgaaataaaatggattgggtttattcatgtatacatttaaaagtgagtaatttctatttaatttatatttataaaaacatatcccttcaaaagttttccttttctatggattcaattgacgagaacacataaatattggtaaatttggtgtttttcgatttttcgttgaagcgcagttttctcgttcataattcggattaaaaaccctttttatattttaaccatatttaataaaaaagcctcaattaatttttggcaaatgaatgaagtaaaaatcgtcgttcgtaatgcattacatcagtcttatttttaattattataatttataaaaaaaacatatccttttataagttgtaatgaatttttttttgttaaatttttcatctaaaagagattgaagaaaatcgaactcttctcttaatttatttgtttggcgaattatttaaaatgtaataataattttacaattttcaaacaacaattaatgaaatgttatttgtaaaattaactttattcataatatattaaatagaatatttttacattattaaatatgaacgaattttataataacaataaagtattctgcaaaaataaaaaaataaacagtttaaaagtctataaatatttataaaaaataataatttgtcaaaatatggcatttgaaacataattactatacataaattcaatatatcgtccgtttatcgttttgttttgtttaaataatattattttattttatttttcaaatttatgctgctcaaataattca

SEQ ID NO: 32882 - DNA, 259 bp, Heterodera glycines
caggattggcctggagcgacgggcctggcctggactggagtcgccccgcaacacccgcgcaactgcaggctaacggcttatcggcagacacggtggcctgctggcacgagcacgcaggctgggtgcgcccgccccagctcattgcccacctgctgaacgacccggccatccgctggcgcggcagcgcggcggtggcggagttgcgccgcaccaccgtcgacggccagcccctctggcaggcactggacgccgaagggcg

SEQ ID NO: 32883 - DNA, 566 bp, Heterodera glycines
aaaatgcatttgatcactgatgaattatgatcggtcgatcgatcattcttaattaattcatttcttcttctgcggctgatcactgtttttgttcttttgtccgtcactaattgtcagcagacgacgcccctttttcgctgctttgtcccgcttcttgttcttcttctttcggtggcggagacaatggcctaaattaagcgaaattttaattatttaaacaaaattaaatgccttttttaattgctcacccaatgcaattggagcaactaaaaagacgaatggacacattgttacaattgttgtcccaatttccgtcttcccaataaaccgccgccgtctccccaaatttgcatcgtttcattatccaatcgatgtcccattcatttgttttggccaatgtcagcttttcctttgtccattcgttcaccaattcaaatggcaccattggcattgacggcgcaggaacagaaaaatgaatttggtaactgacggaagaaatggcatggcacgaagaaaatgctaaacattttgattggaaaacacaatcagtgatttgtcgaaatatg

SEQ ID NO: 32884 - DNA, 1359 bp, Heterodera glycines
  misc_feature (106)..(106): n is a, c, g, or t
ttccaattccacgattcgccaaattggccgggtttcctctaaggggggaaaattcgaacagcgcaaaagcgaaaagccctgaatcggcagaaaattcgagcgcaantagccaaaaggaagagagaagagaaacggaagaaaaagcgcaaaagcccaagcaaatgaaagagaattgaaagggaaagaaagaaatcagcggaatttaattatttattatttgaattcattggtcagagaaaattgaaatttgtgagtataaattattattgagaaaagcattcaaagagcgtaaaacctattaaataaatacttatgaaattcaaaaaaaagaagttaaaaatattccgccgaaccccccaatatttcttattttgaaaattcttttaaattttcatttctggcacaagaccttcttgctttcaaagttgaattaatttttatcagcagtacttaagtgtgctgttagggacaatgatcatttatgtaataaaagtaatgaataatttatcaacaaaatatccgtgacgcaatggcccaaaatgcatcatcaacattagagttcgacctgttctggacctggatccaggctcccaggtccagtaatcacgaaaatctttttcctggataatatttttatatttgttatttcgagtgacccttttttatttctttatcaaaaatgttaaaacgattttaaaacattgcatttatttttatttttttgattttcctaagaaataattgatttttcttaaaaatttatttgctttttaaacaatttcaaaaaatccaagtccagagcctggacctggcttttcctagttctttgtccagaaaaaatccaggtcaggcttttttcagaatgcacaactctaataagcaacactcttttaaaacatcaaattaatatttgttatcacgtacagcatcatcagcaccaaaaaatggtcccagcgacaacgaatgccgcgactcactgaaaacatttggcaaattttcaaaataaaagatggacttaattggcaacgcttaattacctaatcaatccaattagggtcaatttgcgtatttgtgattagaaatttaacttttttttcacaattttgccgccaattgggccattttggtctcattttggctccccatattccccctcccccctctctccctgaccaaccgtaggacaattcctcaggaaatgccactttcacatttgaattgtgcgccccgacatcgccaactgcgcaaaagcagtaactcaactgttccccccaaatttcggttgcgattttgctggtgccaacttcgcattggtcctccgtacgtgccgcagtggaaaaagccccatgttgagccatt

SEQ ID NO: 32885 - DNA, 955 bp, Heterodera glycines
ttgacaatgaaaccgctaaaaacggaaaaatgataggtgatcaatggaaatggaatgttaaaatttattgttaactattaattgacagctgtaaattattcaggaaaggttatgatgaattaggtcggtgaaaatcggcggatggaaacccatgcgaagacgaaaaatgaagcggtgccgaaggcaaggaactaaaaaagaaatgattatgctaaaatgaactaaaatttcaacatttaacctggccgtgcttttggcactgtccgtcccctctcccaaacttatttccgcggtcaaaagtggcgacgcggccattgccgctgcgttctccaccactccgttggcacgaagaaaatcagtcagtgcttccaagtcagaagggtcgccgcgaagcaaagtgcgcattcctttttagggggaaacatttgaaaaaccagaatgaaaaatatttgaaaagggtgcaatttgcagaaaaagaatggcgtaaccgatacccaaaggatcatcagtttccaaaaatgaacggacgaatacgtcgtccgttttgggtatttccgctgatgacagatggaaaatgggaggaaatgcggttgaattaccagcgaaggaacgaaaatttgtggaacaaaaaaggaaatgaagaaaaaatttggagtattgccagtcaaatcaatttatttctgctgaaaatttaattacgtgcaagaaggtgccgcctctccggcccatacagctcgagcagcttttgggcgaactccaaaattggcatttcacgtgcgcgccaacggcgcattaaaatggcgaatttgttcaattcatcatgggagagacagacggaaagctaaagcgtagggaaaataaatttgggtaatgtgcaacttccgctaccaaaatataaccattaaaaaataatgagaaagggacaagcaacttaaaataaaaaaagaagggaatc

SEQ ID NO: 32886 - DNA, 1044 bp, Heterodera glycines
  misc_feature (925)..(925): n is a, c, g, or t
aaccgttttttaggcctagctcgaaaaattttgaaaattttcgaaatttttaaatttggaaaaatcgagcttccaaaactctacaataagtctgctgggtacctttccctcagataaaaccccgactcggtattcgcctggtactgaagtgtactttttgagcaagcttcagttgccattttctgcaggccagggggtggctctattaaaaaaataaaaaataccagcatgtagaggacactttggcggggtgccctcgcagcgggcattttttgattctagttttagaaaaaaagttacgggccatcaaacgcaagcaaaagtgagaaatcggccgccgggactcagttggccaccgaatcggaaaacccttatttttcccagatgcgcctcaaattattgataaaaaaatgtaaattaaaaatttatttattattaaatattaaatcaaaactattttaaataaattaaaaacatctaaaaataagcaagaaaaaatactttgaaaaataatgtgttaccgcccggattcgaacttgcccccgccccctcaaaatgatgcctcagaatccccaatcacacagggattctgaggtcataacgatgtcaaaaataaaatctgattacgtattcgtgatcagcggcacaaataacccctaaagacatgtttttggaagatttttgttgaaaaaaatttttcactcaaaaaatcgtatgctcacccctttggtcccgaaccccaaaatcacttttatttttgtatctttttttaaaaaaatgataaaaaggtgaaataaaatttatcttatagagcaaaaaattgcggatttttttagtattttactcttccctaatgacttttctgaaccgagttctgattttttttctgaaaattcgaaaatttccagacattctggaataactnttattcttttgaagctagaaatcctaaaaatcccataaaatttctccgattttttgctatttttttatgctttaatgagctgaattggaccattttgaggcgagttatgaatttttaaa

SEQ ID NO: 32887 - DNA, 939 bp, Heterodera glycines
  misc_feature (10)..(10): n is a, c, g, or t
tctaagaganatctttgaaaaaaaatttagtaaattcatcataaaatctctaaaaatccgctgaaactttttcaaaattaataaacaagatgacgatttcctaaacaagtagctttgagcgacttaaatttttattgaaattttaacaaattcttttcatttaaattgatttcaaattaattatgaccctataaattgtttaaaaatgtttgtctaattatatttaagtgatcagcaacttttctgttgcgattgggacactctgagcagtgtggccgactgttgctccatacaaatggcgccatttcattgtcggacaccggctgatgggtgcagcgaggcgagctttgtgctggtcaagaagcggctaaaggtggcacaaaacaaaagggaaacgaaagcggcggcacaaattagggagataatttaatcagggggatcaattaagagaaaaaagatttacaagcactaattgggggcaaggcggcatcaattagaaaagagattaacaggcactaattaggggataagcggcatcaattaagggaaaagagatttacagtcactaattaggggaaaagcggcatcatgggatcgtccataatcgcaaatttgaagcaatttgttaacagattttgtccaaaattgaccaaatttaatgccttttgggcgggaaaatttgaattttttgtacgatttaattgcggattttgcgccaaataattccataaattaataaaaaatattggtctaaaattaaaaaatgtaagatttagaatgttttttcgaatgctccttttcaaggacatcttgaattgaaagacgaattttcaagtgcgagggttaaatttcaaggacggacgtccgtgtgttattgggttactgttttctctcaactgtggactttggttattgttgtccaagtcttcattcatgctc

SEQ ID NO: 32888 - DNA, 827 bp, Heterodera glycines
agtgatgccgttcaatcagtgaatgaatggtgtctccgtactaaggtggggggagtacagtaagcgaaaataatgcccaccgttcggatggatgcccttcggatgtgtccgttttggtctctctcctcggccgtttcttccgccacaacggcgcccgcacgacgcgcagtgtccaaaacccagtccaaattgtccacttcgaacgcaacatcctttgattggggggggggggggcggtaatcagtggaagggaaggggaaaagccgaagacggagaaaacggcggagaactgaccttgacacctaaaaggaaaagtgatcaaaaaatggtcaaacggcacaacaaaaataatcaaatgaacaaaggatggatgatcagtgatcaaagtgaattaattatgccaattatggcttaccatcgccatgtttggccaaatgtgcgctcatttccccgttgttaggcagcagtgccgactcgaacacaaaaacgatctgaaacggttggttggtgggcggtgagtgttccttctcccccggtaaacttcactttgtcctgtttcactgcatatgccaccgtttttcgacttcccgtctcgaggcccctgaagggacaaacggaaagataaaaggacaaaatgaaagaaaaaggcgggaaatgccgaaaaggagggacaaagggaaatgccgaaagtgattaacgagagacgacacctgtaggcgaaagggatgaagccgaagttgacgcaataccaatgggccgcctaaaagccatcgcaattattaaagacggcacaatcccttccgccacccggcacaatcagtcagtca

SEQ ID NO: 32889 - DNA, 1169 bp, Heterodera glycines
  misc_feature (893)..(893): n is a, c, g, or t
  misc_feature (992)..(992): n is a, c, g, or t
  misc_feature (1075)..(1075): n is a, c, g, or t
agaagtataaatttataataacctacgtttgaattttttcgaagccataacaaaatttgtatttggtcgggttcgactgtaactttgtatttttaaaatctacgaatttataacttataatgttttcctttttaggtttggtaataaattataaagataaacggccatttttttaatttattcatgtaataagccgtgtgtacaaatattatttaggtatttcaagtgcaacaaataaccgagtgcaaactaataaaatggagcttcaagaagttcttttaaattcccggaaaccggaactttaatgcagtttcttccgtctttagatttataagagcccacgggacaagcgcagatttttcctttgttcatgttaagacactgttgaccttgaaaaacgatgaattgtccaaagtgaaaaaaaaaacaaaaaaataacctttggggcattcttcgtagagacattcgtctaaatccacgcattggagaacatcaaaacgataaatctgaaaaaggtttctaacaataaatctgtcccttcccaaatggacctttgaattgtcaatgctcccatcggcagaggcacaagcgcagctcaaattccagcggttctgctgaaatttgagaagacgatgcgaggacagtagctttctattaccataatcgcaaacaaatcatcgttaaaaggactttccaaatctaaaaatgcatgtttttcgcggaaagggaacttcggataaaagcattgctgggggtcggttggtgcttcgcttccccccccccactcacagcagtagtgcgtgttgacaacgctgtttcctgcttcggtggcgttgtgccgttcctcttcgtcttcctccaagtcctccgcctcttccgtcgtcgatggcatnacgttccgtcgtcccctccccgtcgccttccgccgcccccttaggcaatccctcttttcggtgttttcttttttgaagtgccgcgctgccattttctcngttgagattttttacatttctgaaaagtcaaaatacagcgtcaaatcccaaaaaagaccatggcacaaggcggagtgggcgcnaaagccaaagaagccttgggtttttgctgacttagaattgtcaccgcctccgaaaaaacgaagacttttccgacacaacatggatcaggacaga

SEQ ID NO: 32890 - DNA, 968 bp, Heterodera glycines
gcttacaattaacaattcaagactttccttttctgtttttacactcacatgtcggtattggtcgatctccgcctgtgcttcttgtttggcttgtttgagccgctgtgcttttcgcttccgggcgtcattaatctgcaaaataaaaataaatatatttgaaaaatcaacatcaagtcaaaccttttcagcagctcgtttttcggctgcaagaagttgttggatgccggcggtgtgcgacgccattaatctcggaagttgtaacgaagaatgtgcagaggttggcaaaccgttaattaaattagaaaatgcttaaatctaaataaatatttgcaattgaattttttaataaattgatagaaattttcaaaatggacccaatcctaacccacccgccctttcattcaccactaactacgggcttggatgtatgtatgtaaatgaccacattaaacgaaatcaaaagttatttgattgatgaatcgatctttagttcttgttggttaggttgatctaaatgccaattatccaaaaacataatgccacgaaaaataattcaaatctttttaattacctaactttaatctgtacgtgtttgggctaacaataagctgacacttatgtacagcgagtaaagaaaggattaacagaaataattaatttatatacaaaataaaatttaggtgaaaacttaatgtattctccatttgatttgtttttggtttcttcgggtcgtcaattatcttcattcgctcatctctttgtgccaattaattgccggatttttgcgccgaatattcgaaccatgtcgacaaagcctcccgctgataatgagtccaacaatgaaggtcaacagaagagcagtaactcactcgcacgagacgggaattatgaagatggaaatatgaagaatagagacaaacaaaaagagttcggaggacctgctggtccggagccactcgatacgggga

SEQ ID NO: 32891 - DNA, 951 bp, Heterodera glycines
  misc_feature (863)..(863): n is a, c, g, or t
cccccccctcttttccctttgggttgcctttggggggtgaatgggtcgtcgtcgtcggtctgtctgtcgcatggatcacttcgacttcctttcgcgcactcttcagccccaccaattttgttcacgctccccccgagggttttgtcggacgaaattgtaattataccccggggcatcataagccatcataatattggcggttcatccgccgacgggcaatgtcccgcacactcgaaaagacttgaacaatgccccaacaattcaacaattaccttcccccccccccttttttgctctgatcagttacgtttgtttctgctactcttttttttgtccaatcacaacccaaactcactcttcaaatttcttaaacaattcaattaatcattttttggttggctaattggttttgtcaatggcttttaaatgatgccaaatttgagtgttgatcgtcgctgatcatcagacagatgaactaattaatgtccaatccccaatcattaaatattattattatttcttttccattattaaaaaaaataattttttcgaaaattccgttttttttgtattagcgacagaatgagccaatcgaattgttcagcagctttaatttccctctcatcacaactgtgaaaattgttgttgttctgctgtggtggaagaaaaaggagatgaatgctctcaactcgaatttaattgaacttaagtgcccgagggagaaagatcaattggcgaattttatggaaatttttagagtaaaaaaaacataaaattaaaaatatttaaaaaaaaacgaaaaaaagagtttaatctttcttcgctctttttttaccattcggtagattcagcaaataatttanatttgtgaaatttaattcgcttctgctaggaaattgcagtcgaattggtcaatgagtcgaaggaaatgttgcgataacgctaaacaaa

SEQ ID NO: 32892 - DNA, 617 bp, Heterodera glycines
cattaatcactgctactgaatgacctttaatgaacgacgacggatcggacgatgcctaagggcattcccgtgggcatgaaatgctcaaatttctgaaattaggcgtgccttacattgtgacaacatatatataatgccctaacattcccttccaaaatccttttaatctcaaaattagcaaaattagccaaaaacccaacagacgcccccccccactcaaacagattgaatttttggcaccctccccccctccccaaattgttgtgcactttttgttccccgcggggcaatgctttttatccgtgggtctaccggaggaggaagaagaataatgcccatgtgcatccattccattagccattgcctgccgctgctgatgaataattcgggggtggcgtgggccctccctcccccccccccttttcgcctagaaattttccgtgcgttttccatccgtccgaattccaacaaacagcagcaaaaggcattttgtgccggaaaatgttttatttgccgcccccccccccaaacatttattttatatgcgcggccatcgataggccccggggggcggggaagcggagaacagatgaatgaatacaaacagaaaatgtaaa

SEQ ID NO: 32893 - DNA, 885 bp, Heterodera glycines
  misc_feature (798)..(798): n is a, c, g, or t
  misc_feature (808)..(808): n is a, c, g, or t
agatttaagatttttttttcgcgtaaatttgaaaatttttctggctgctcaaaagttcaatctttaggggtgtattttcaactctcgcctctcgtcccaaaaaacgagaggcgagagacgagaggcgagagtaccaaaaatggcgagagttggcgagaggcgagagatatagagacatagagttgtcccacccctgatatatatatatatacataaaattctttgaaatgcttctgcccatttgagtgtcactcaatgaagcgaaaataattgaagcccatgggacgacggacaccacaaattagcaaaatgaaagaaaatgagaaaaaaaaaaaacaatgaaaaaaagaagaggaccacccaaataaccaattaaatgatcggagagagaaattggaaattcattttttattttgggagaaaataatttaaaaaaaccaatgcttttaacggtgccacggttcgaattggcttggggcacaaagaatgaaatccggttttaatggtgccgtcgtccgtacccccgggggatattaattagattttctattgaattcacaaaattaaaatctctgtgccgtgctccgtcggcagtgtgcaaacacagcacaccaaatcagcagcacaccgtaagccaaacagtgctttggtcggaaggatttccattaatttggccaattttgtcaaaaaaaaaaatgccgcaaaaattggccaaattttgcaacaaaaaaatgaggcgaagactgtgaacaatgtggtaaaattttgtttaatgacctcatcattagtgcacattanattaaaaggngaaaatactaatcgaaaaaaggcaaaaaaaaaaaaatgggaaaaagtgccacccaaaaactttcaaaagattttttt

SEQ ID NO: 32894 - DNA, 291 bp, Heterodera glycines
tcgattagatcccccctctcgaataaagccccccttttgaggggagttgaacaatagagcccccccccctcgattagatcccccctctcgattatagcccccctcaaaaaaattaaaaaaaaaatctttggaagcagaaaaaagtaaatgctattgaaacaatttactttaataataaaacattaacaaaaaaatattatagatgaaagggcctcaaagacgagaatttttccattcttgattaccggcaaaggtgtagaattgcggaacgggccacttcagtctggccag

SEQ ID NO: 32895 - DNA, 80 bp, Heterodera glycines
gtcgtcgtgatgccgagcgcatctatgtaggcaagcgccgcgctgaccattcagtgccgcaggaccagatcaaccgcctg

SEQ ID NO: 32896 - DNA, 876 bp, Heterodera glycines
atcagaagctcaacaaattttgcagggatattaaaaggaagagaatcaacctatttttaactaattcatcccataaattttgtttaaaatattttaaaaattttaaacatttcatacaatttttaaatatgcctattattttaggattatatttaaaaaagttttatcgaactttactttttctataataaatcaaatcgcatattccccggtacaggactaacttaacctgaaaatatttcaacgcttaatgaattttaaaatttattttttttactattcccctctttaaaaaaattcaaaaaatattttgaaattttcaggtccgttccaccacaatcacgcagtccagcactgggcctccagggcctattggtcagcggaattggtaaaaacaaaaataataaaaagaaaaatcgtatttaattacttaaattttaaacaaaataaaaaaatgaaaatatttttgcgcccctcaggcactttgccgtcaccagtgatttggggatggttggtggacagtgcatgtttggtgtgggacaatgaatgtgagcttggctcgtgtcaagtaagtgggcaaatcctctttttataatacgttgttaattaaatttaatatttttatcgtttttaaaaaaggatttatttaaaaagaaatatatttaatgatttaaaaatttttaggcattgttaaacaaaacttgtttggagatttttaattattttcaatttatttttaaaaaaatatatttttaaataattgttaaaactagagtagagcgggaccgggaccaaaacacggacaactgagtacaactgagtaccgaggtcccgggttttttccggttttccccagcaaaaattccccggtttttc

SEQ ID NO: 32897 - DNA, 905 bp, Heterodera glycines
aatgcagcagaaccaacgcaagcatatggacagatgggtggcgggcgggggaatatttggggaccattttgggcaggattcgcatttgtacaacgagtgagtcatcgcgaattggtgggaatgctcacctaaaagaagggtcgaatcaagttggaaactgacaaattattaattaagccgccagcatacttaagtttttgttaaaaattcaaaaattttgtgacatttattttgacaaaaaataaatgaaaaacgcgcggaagacacaatgaataataggagaagcggtgaagggatacttatcagtagtaattattaattttatctgttctttcggtcattgggtcgaaatgccaaaagaatttgcgtgcaataatagttgatttcataagtaaaacgcgcccatgtaaactaaatgtttataatccggcttatgtttctttgctctttggttccaatttcaaacagattttttctcttttttctatttttaatcttttatctacggcaaaattttgttttacatttaataaatttaaattttttcctcagtttttcttgcacaattttttggcgagttgtattaaggacaagttaaccatcgttttattaaatcttccgaaaaggctcatgccaattgcttcatctgcacttatctcaaagagacttttttttagaaaaaaatcttcaaaatttgttatatttgcattaatcttttaaacaacttctccaatgaataaaaaaatcgaacaaaaagttgaaacttttttaccccaatatatgcgtaaaaatcgatcaaattttggagcgaattgctcatttttattcaacactgttttgaaaaataaataattgttatatgaattcgagtctttcccagaaaaatgagtctttggaaaatcaaa

SEQ ID NO: 32898 - DNA, 850 bp, Heterodera glycines
aaagggcgtctccttgttttcgttatacctgaaaaaaaattttttgttatgctttgtccctcttttcttaccatttttcgaatttagcgtatttctctttattcatagatcctggtgcgtaatcctccatcggtggtagatgttccaaacgtattccataattttctttcttgttgtagtaataggggaaaaaggccttgtcctcacagcccaaattgaatgtcgccttcatcgactcgagtttcaccggcattaataagcatgagtctctccatatcagcattgaatgtttcttcgagtttcgcactttgaattcataaattttcagtccattgatgagcggtagcgggttcttcccggtacggcagagataattaaatacaaaatgtcctaaaattttagggttaaaaaaaaattaaattttgaaattaccgtcaaaacgcccggcgttatgcgcaaaaatgtacgtatcgtaattcgtaaaggccattaaaatccattccacaaaatccttcgtcggctcgtgtccctccgcctcgctccaatccttggtcctctcctccccgcaaattttacaatttgtcctatttttgtcgtcacagcattccgtacacgtcactctcaccgaaatataattaataatatgttccttctggtcccccttataaatcgaatcctgcgatgtttccgaatcctgaaattaaggcgtttttttttttgtatatatatatattttttttttgcttaaacttacccaaacgacaattcgagagacatccttttcctctttttcctctatcggcatgctataacgaccccgtttggggtcgtggcacacactacaaagctg

SEQ ID NO: 32899 - DNA, 486 bp, Heterodera glycines
tagacaaaacaccaaaatattactaaataaatttaataaaagacaactcaaattaaaatagagatttttgtttttgcaattttatacaaaaattattattcagaaataattaaacaataaaaagaacattttgttaagtttggaatacattactttgctctgagcatgtcttttataaaaacaaataacacaaaatattttttcataacaatatacacataggaaatatttattaataattttaaaaaattataaaatttatccatttgatttttatgtgtcactgccaagaggatttaaagcatggttttatcaacaaaaaaaactataaaatgaaaaaatgtagattaaattaagaaaatcatttaagctaaaaacaaatttatctcgtttctgggaccttcctttgtcagcagtttatccagtgttttgcgtacaactcatcaaacaaaaaaattcgcttacatctatcttgataggcggtag

SEQ ID NO: 32900 - DNA, 1051 bp, Heterodera glycines
ctttttattcacatgaaaaagtcacaagtctcttctgatctccggttaaaaattgatttgaaaaaggaaaatagatgattatattcttcccaactgaccatttatttaaatgatttttttaattaaataatttatttatttttttattgtattgattaaaaaagagaaataattcaaaaatattataaaataaaagaaaaaattatgcaaaaaggaagaaaatattcaaaaaaaaaagaatggaataaaattaatttgaaaataacaaaaaaaattgggaacaataaagaatttgggcttcaaaaatttatgtcttacaaatcaaaaactaatgaaggaaaaatagaaattgtactaaaattcattgaaatgacaaatgaatataagcaaaaaagaaaatattcaagaaaaggaatggcaccaaaattatgatgaaatttgtaagaaaattggagtaagccaaggaacaattaacaattagaaaatggaaggaaaagctcggattaagtggtcaaagaatcactgagaatgaaaaaaatcgaaaaaatgaaaaatgttggcaaaataaaaaaataaaaattcaaaaatgagtgacaaagaaattgatcaaattatgaaaattgatagaagagtatttctattcgtacgaaataatttggagaagaaattttggaagaatcattaatttctgttattaagtattacactttaataaaagagaacaattaaaaaaagaaaaaaattgtagtaataattttgttatttttaaaaatttggcatattatgatcactcatttttgcattttttcatttaatttttttttcattaccaaattatttcttcaatttcctaattatatcataaattaggcaaattttcttgctaatttcggcgggatcagaaatggcacacttattaattaggctcattagatcctttaccttgacaataaaaatgagttggacagcatttactcccctttgacaccgaactctccgacagatttgaagttgatgaccaaataccaattatttttttcaaaaaaatatg

SEQ ID NO: 32901 - DNA, 976 bp, Heterodera glycines
agtaattattttaatattttttgaagtttacttttttgcaactaaacgaaattttatggaattttgcagactaatagaggactgttgaggctatctaatgatactaagaatgtttttttttgaatgttacaaaaagttatggtgcattaaagttgtcaaattatcatatggtcatgtcttttttttagggtcgtgtaaactgcaataaagccaaatatattattatcactaaatttatcaattaaaataattgccgtattttctctaattatccccagactccatttatccccagcaggggggggggataaatgaaattttttggtcaacgtaggattttttgggtcaacgtaggacctttatcccatttcgaaaaaagataaatattttgaatttatcaaaaactgtcccagcataaccttttgaatcgtgagtggatgatcggacaatgaacaagaaaataggcaacaaataaattgatgagtttgtgggaataaccctaaaaatgaaaagatgtgaatgtccgcttagtatcgaagggtgtggaacagttcaatcaacagccaatttctttttctttgttcagcaataagctatttttcaaaaattgaaagaagttaggcattggaattaattgtttaagatttcaccaataatcaacaagacggcacggcattcgtgtgcgagagatgacaagaaaaaagttgcttatattcaacaaatgtgcaaccgtcgtttataaaatgctaaatccagcaacgagcctattttctttctttcttgatatggcataatcggtccctttcggcgacagaattttttttatctttttgtgtattttatgtccgattgtccgggagcatttttgaatatattctattgtgtatttgcacggtatgtgcggaaattatcaacggctaataatttttactcttaccccaaacaaaagtttcctaaatttagaaaacaaaacacg

SEQ ID NO: 32902 - DNA, 989 bp, Heterodera glycines
  misc_feature (14)..(14): n is a, c, g, or t
  misc_feature (895)..(895): n is a, c, g, or t
aaattggtgaatantggtaaaataaatcaaataaatagtttatagtcacaaatagcaaatataggtatcattaggaaagcccataaaaaatgctatccaatggtatgctacttatctgttgaaattggaaaatgacaattttatacgcaattatttttttcaaagcatgatgggacaacacttatgaccatgactgtatgaaacaaaataattgctcccccgattcctaatgtgtgtatataattgccaatgtattgtatgtattgttgccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcctaatgtgtgtatataattgccaatgtattgtatgtattgttcccccgattcccaatgtgttgtataaaaaatctttcaattgatttatttttactagaaataaccaagctcgaagaaatttagaaaaaatttttttgttaagacttgnggaagggggggggggcacatattacacctatttttcatccgtgtcacattaagcggcgaacctttccgacgacagaccaaaggagcgtttgctc

SEQ ID NO: 32903 - DNA, 954 bp, Heterodera glycines
tcatcgcggatcagaaaggcacagaacggatggtcagcgacaaaactgtgttctttgctcgaactggcactatcaaccacacggccttttgtggctgccctgtggcaacagtgccctcctcattcacctaaactttgttgtacaaaattagttgtttttttgagaactgaggtaaacggggacgggacaaaatctcgccgcagaaatttcaaaaaaaaaatttcaaacttaaattttagaaaaggaacgagaatagaggagaaaacagtattatcataaaatttcaaaaaaaaatgctaaaaattttcaaaaaatttttttataaattttttattaaaaattttctaagaattttttttggaaaatttgttagaaaaatttttttttgaaacttgcgatgagattttgtgccggcaagattcaggcggcgagattttggggtgtacccaggtaaaactggtcagcgaatatttgattttctctgaaccggcttgtgattttttttatattgcttgtcgattgcggcaaatttgacaggcatggagccagagagggaatctcccccccccctcccggaaatgaaaatttttccttaaacaatttttcttaataaagtgcattaaattttcccggcgaacgtctatcggcaccgccggacccccaatattttaccctatttgaaatgctgaccctaaatggcaaactgacaaccccccttaatatttcaggcgacttactgtgccctctgacaccaacggccgcacttcgtcgtcctcgtaagtgccgcctccggctgttttggcccgctccgaggagttgaagctgtacaacaaacagaacattggcacattcaaaggaaaaatgcatgaaaaagtgtgtgaacgacctgagtgtcctcgaaataaatgaaacatgccttaaacgcatcacaaacattaacatttgtttttgcta

SEQ ID NO: 32904 - DNA, 1368 bp, Heterodera glycines
  misc_feature (1212)..(1212): n is a, c, g, or t
aattcagtgcgaagtctctcgttttccaacaaaatgtccattggatttggcagtctttgttctatcaaaaggaagaaacttgcaaataataaagtaataaaattattgtattacacctttgtcatggactcttcgaaattccttgacatttttcagcgagatgttctgatgagcagaattattgttgatcttaaagaattgcaattaataaatgtaattaatataaataacattagtctgaacagaatgcaaagtgggcgaccgaagaacaacaactgaagatggctgtttgctgtgaacactgagtcgagaaccgacaacatccaccaactcaaactcgctgttttcgctgcttaactcgcgcagtgattgcagcgagctcccagcacttccatcaatcattgaagccggaaaaaatatgtacgaatagtaatttaggtagaacttcaattaaaaatttaagttgatttggtatttacaaactcaggactgaagtgtaaccaacaaaaaattagagctaaaagcttcaaaccaagttaccaactcgtttttcgtggtgcgtatttgcatagagaatgggcggagagagtgggcaagaaaatgtgttggagggagagaatgaggaggcagggaaaagagtgaaaagatagagaaagtagagagagagagagtgagaacaaaaaaaaggtggggaataaaggagagagggagaaagagtaagaggggaattaaagagaggagaagacaaagaagaagagagagagatagagagagcgaaagagagagaaaggcaaagaaaatagagagaagggggagagagagagggagagagagagcagttcgtgatataaagaaaaaaaaaacaagagagacaagaaaagagtgatatgaggaaaagagagagagggaggagaaagagaaggggaagacagagagggaagagagggggagggggaatagagagagtgttagagagaaaggagcagagaggaaagagctgagaggccccaacagatcctgaaactatttttctatgttttaatctcctccaaagcgcatctaacatcccccgtgttacagactttaacgtcaaaactataaactggggcagaaaaattcattcccatttgctcgggagggtaacagaattgtcggaatcaacttcgataaagaactaataaaaacaaattctttatatcaatttaaaaccgnacttaaaagttcactagggtaatataaccggtaaagctagaacaaaaatacactcataagtagggttgtaaattatatgattttgcatattttttctgcgcatatgctatgaagaaaggggctcaaaaatagcatttctgcattaaattttttgat

SEQ ID NO: 32905 - DNA, 1586 bp, Heterodera glycines
ctctcgaacatgaaacgaagtgcggtgcgccatggccattttatttttcaaataatttttatatttaatagatattccagaaaaatggctatctctatttttgagaaattttctatgcaacaaacgctttcgaacatgaaacgaagtgcggtgcgccatggccattttatttttcaaataatttttatatttaatagatattccagaaaaatgtattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctatttttgagaaattttctatgcaacaaacgctttcgaacatgaaacgaagtgcggtgcgccatggccattttatttttcaaataatttttatatttaatagatattccagaaaaatgtattccagaaaaatggctatctctatttttgagaaaattctatgcacaaacgctctcgaacatgaaacgaagtgcgagtgcgccatggtcattttatttttcgaataatgtttatatttaaaaaaaagtccaaaaaaaggggaatcccgccctttctgatcttttctatgccattccgacccctctacatcgagcacgggagcgagggccgtggtcaggtcgttattggattaatgtttttgaaatcccgatattgctgaaatatggatctcgctaccgttaatcaaatctctattcaaccaagatccctgacccggacttttttggaaatgagacgtgatcggaatcccggtaaaatcccggtgatatcccgtaccgatccgactctaatatataacacaacaattgccagcttcacaatgaaaagattaccacacagattaaagaagaggaaaaacgagacaacttacaaaaaaaagtttacatatgaaaattagtttaaaaagcattcctattcttagaattacatttatttcgatacattatacccgcaaaatcagttgatacaaaaacgaattgaatttcgtggtccgtcccaaaaagcatcctgaaaattttaaattttttttaaattttgcgattattaattgatcattttttcacaggagacagcccgcaaacggataagcactatgtgctgaccaccatcgaaatgtttgcattgagag

SEQ ID NO: 32906 - DNA, 822 bp, Heterodera glycines
atgccattgtatttccgtcctcccatttgcctctttccatttcataaaccacacaatgccaatgttcgcttttgaattgctactgccaatttccaattttttgttgcagtccaaaaatttgtccatttctaaattaaaatttataaaattgcagtttatttttgggaattttgtcactttaaagtcataaaaaatagaaaacaaaaaagacgctctttaatccgaacgaaataaattctaattttaatttaaaaaaagttttttaaatgttgaatattttaatagataatttataaagtcataatctgaaatgatctgtgaactcctatttcgttcttcttgcctcgagaactcttaaaaaaacaaacggtaaattctattttattatttgtcctaattcgataattaattttttctaattgcctcattaaaacattcaatttttcattttttaaataattatttttaaccttccaacaaatttcggagcaaaagtgcgcatttcggcgcattttccgcctccgctgcgactgtttcgtacaaaatgcgaaagttcagcaaccacaaattggtcaaatgtttgctcccaatttgggcactaatttggtcagtgttgtccattagcaccagcaaatcggccatcaaacgggccgacagtcggtcgacgcccttttggccgccgccacgcacaattagcgagtaatgggccaacaacaggtggtttttgttggtgaacaatgaaaatggaaattaggtttaatttttttagtaaatattatctttaatctctatcatatgctttgtttaaaaaataaatttttt

SEQ ID NO: 32907 - DNA, 304 bp, Heterodera glycines
aaattttctccggcggcgcctaacggcaccgccggacccaaaattcttacttttattttaaaaaagtagctcaaagacgcaaaatttggtcattttttggacaaaatccgttaacaaattgcagtaaaatttcaaaattttctccggcggcgcctaacggcaccgccggacccaaaattcttacttttattttaaaaaagtagctcaaagacgcaaaatttggtcattttttggacaaaatccgttaacaaattgcagtaaaagttcaaaattttctccggcggcgcctaacggaaccgccgga

SEQ ID NO: 32908 - DNA, 805 bp, Heterodera glycines
cagtgtccgtttcggggtactcaaacaattataggggagcaaaaatccaacgcagaattaaagtacaggctatagggaagctattccggaaggattcggtatccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaatcgattttttcaagtgtccgtttggggtactcaaacaattatggggagcaaaaatccaacgcagaattagagtacaggctatagggaagctattcccgaaggattcggtctccccataaatctgggcgcatcggggtcggaggggactgccccgaaaac

SEQ ID NO: 32909 - DNA, 686 bp, Heterodera glycines
cgacacccgtgccaatgccattgtttttgttgcggaggacgcgaacggcgaagatggagccgcagtgggcaaaatgggcacggatttggtcatcggtggcggtgtatggcagattgccgagaaaaatggaactgattgatggggaaaatgatatgaaaaaagtcattcaatttcgattctgtcaatgattcttctaaatcagaaaatgggcgttctatacaatgaacggattctaatgaaatatgatatctttggctaaagcaaagtctgacgctacttgcaaagagggggcttagcaaaaatcctaagcataattagcccacaggttatagggaagctattcccgaacgattcggcctccccataaatctgggcgcatcgtatcggtgggactgccccgaaaactattacatccattttttcaagtgtacgattggagtactcaaacaattatggggagcaaaaatccaacgcagaattaatgtacaggctataaggaagatattcccgaaggatcctgactccccataaatctggtcgcatcggctcgctgggactgccccgaaaacataaaatcgattttttcaagtgaccgcttggggtactcaaacaattattaaaaatttttagatttttattcatctccctttttgatagtgaaagcatctgagtgcctataataactt

SEQ ID NO: 32910 - DNA, 372 bp, Heterodera glycines
gatggggcccaattgacttccttggaccaccaaattaactgagcttttccattgcatagagcgctcttacagaatttctgatgggcgcagagggcaaagctgaatgttaacacacttttgagagattttcatcgacaaatctgacaagattttaatatctatattttgtaattaataaataatttgttgattctgctgctctatttacgtgttccttcatatctaatgtgtcattagttttgataaaattagatactttatttttgcttgggcctatgccttttgactaatatgttcgtcaaaaggatgatgggtgaatacattcgatctgtttgatttacacggcatttcacttgcattttgaggatccag

SEQ ID NO: 32911 - DNA, 894 bp, Heterodera glycines
aaacgttttcgcatgaaaccaatctcttccacatctctcagctccgtcgtttttcgttattacaattatcaattttctctaaaacattatttaaaaaaaaagttttttcgattaattaacaaacgtcgacgttcacggtcatctctcgcttaatccgaattatttaatttatcaatatttttattttatttttgctacataagaaattattttatcggaattatttaatataaaaattttcacattttcttgcattacaaatttttagattataaaattcaattattttgggaatgattcgcgtacctattttttattttaaggttgttaattttataggtaacaattaacccacccattatatgtaatagataataattttattttaaaatttttcataattattcaaattgctgtttaaattttagtttatatttgatttttaggttaataaattcattataattattagattttaaaatagaacagtttttattattttatatgatctattatttcggcagttttctattttaattttaaaaatatttaatttttcgaaaaatattttctatgagataaaaataattttctatatctaggcaagatatacttttttagattttttcaataaaaaaactcataaatttattttatgactaggaccgatatgttaaatcatcagctgatattaatatttcaatttttttcgtataagagagagagagatagagttaaatgagaatataatatttttgcttgtctaaataatatatattgcattattgtttatataaaaatgatttaaaatcaaaaattaaaaattaggaatttgggaattagcaccgtcatgtttattaatttatgtcagggtggctattgtttgattgattt

SEQ ID NO: 32912 - DNA, 377 bp, Heterodera glycines
tctagagtcagccgtggtctcgccagcatcaccttctgtgagagggaaatcggcattgaggaatcggctgtcattgattgtgcacactacatgcgcgaagtttgtgccagcttcattctgctccaacagcaacaccaaatcggcgggaacaacatgaccgtcgagatcgacgaagcgctgttcaccaacaaaaataatgttggccgtgtgctgccggagcagtgggtcttcggagcagggctgggcgaagctcggcttagcactcgaagccgaagccgaaggcgaagcccaatttttattcgaagccgaagtccgaagctcgaagcccaaaaacccgaagttttcgaaggtttcgaagccgaagccgaagttttttc

SEQ ID NO: 32913 - DNA, 465 bp, Heterodera glycines
catgatagtactagggctggtaattaaatgcacataaaatcttaaaatatgcacataaaaaatgaaaaatatgcacataaatttttccaaattgggggcaaaatattcacaaattcttcaaatttgttaaatttaagcataaaaatctcgaaaatagctaaatgtaatatgaatcattttagaaccaaaaatacaaaataaatgtaaaatttatttattttgaagaaaattgagaaaaactggaggattttctattttttggcataaatttccaattttttaaaatgttacattttttattagaaaaagctccaaaaaatgatatttttgaaattttttggtcattagaggcaaaattggccgctttaatagagggggtcgttttaatagaggatttgttgaaaaatgctcaaatatgcacataaaatatgcacgaaatgccaaaacatgcacaaatatgcatat

SEQ ID NO: 32914 - DNA, 1019 bp, Heterodera glycines
ttgaaactaattcggaaacaatgttttaatgatagtttttgaccccccaaaacaaagcataaaaatgaaaaaatttataattttcttgaaaaaaggaaggatttaaaaagaaaaattagccaaaaagcaattgttctatgcaaagagacaatttttttttgtttcatttaaaagattaaatttaattgcaaccaataaataaaattgtttgtaccgattttaatttatttacatagaaaataaacaatttttgtaaattttgcatctctgttttgccattttcgcccctatttctccattttttttcaccaactctgtcatttaggggtttttgctcaataaaaatccgtgtcttaatattaaaaattaatcaaacacatgccatgtgagaatctcggaaagtcggggcccatgttcgcattggctcaaatggatttgcaaagccttcacaaattgttcctggattagactgaccttcaaaaaaaaaattattgaattcatttttatatgcattttaatagcaataatttaacgcttttcctgcctttaggataccgtttttttttgttttgtaggtaatttcatggactgaatatttttcaaaattttgagcgccggggtgaaaaacatgaatttgtagcggttttgtgctaacacatttttatcatttggggtcaaattttcaaaaaataatggcacaattgggtcctgcgctgccaataggcgctgccgggaaaatctttttggaaattttaatgaaatatgataagaaaatgtacaaaatttgtaaaaaaaaaacttgcatatttattttatcaatttgctaatgggcttaaggctaaaaatggttgccaaccccaatatttgggtcccaaactcgagactctcgagcaagaaaaaagattgaacacaaaaaatctaaaatggggtaactttagcgaaaatagtcaaactgaatattttgattgcttatctgtgccataaatatactaattttagtgtctgtttttctgagattt

SEQ ID NO: 32915 - DNA, 1014 bp, Heterodera glycines
taaagttatttaattcatttttaattttacatgcatatgttgattattaaaaaggcttgctgaaggataattttagatgaaaaaaattaaaaatgagaaacaaaaagagtatgaaaaaagctcattacaatctaaataaatttaaacactttaaaaacaaaataaattaaaattaattatttccaattaactttaaaatcaaattgaaccccgaactaccttaatgcaattttcgacgaactttttaacacaaaacctgaattcgtcgaatgtcaaatcctaatgagagccgacaagtgcaaaagaatggtaactggacatcggaaatcctattttatctttagaacttagtataatatttagattttattttcaaaattaaaaatcatttattatttatattttaattatttaatctaaattatttaccatataagtagtttattaaaatttgaataatttgatttttcctttttaatacactttttaattgctttttaaatccataattttattatattttacataaatttatgactatcgttaacatttttttatttttatatattttttataatggcttttcaaaattaaatcatatatacatataaaaaaaatatttagagtaaacacacacttttaattttttgccttacggtcttaattttgctccctcctgtaaatacatacaaaattttcagtaatggatttttttgtaggtaaattcatttgtgtaatgcccattagtgataaataaatattcccaattgtaatcgaataattttagaaatcactttgttgtaaattatttaatcatgagggaatatttattgtgatcggcagttgggctatgaactaatgtttgtcatattaaaataaataattaatagtatataaaatttgaatttatttttaaatgttgaaattgaaaaattgaaattgagttcataacaattcaccttaagaaattttatacatagaggataatgaaaagtaataatttttaaatcaaat

SEQ ID NO: 32916 - DNA, 1035 bp, Heterodera glycines
  misc_feature (6)..(7): n is a, c, g, or t
ctctanngagtcacatccgttactaaaagtgatttattgttgtcaattttttcatgacactcactcaacttgttttgcatacacaatcaattaattaattgtcattttgttggtgccttattagcgtcgtccttcaattaattaattttttttggtgccttattagcgtcgtccctcaattatttaattgtttttggtgccttattagcgtcgtccttcacccatattcaaataaattaattgctgtaattaaatttaatcacaaccgaggcgataactttcaaaattaaataaataataataattttggatcgtttaattattaattttttaaaataattttgtattattttgcattttttcttttttgatgatataaaaaagcccaatagacttttttcacgtttcgttgtacacatgaaaaaaaattgtatcgcaaatgaactacatcggttttaattgcaatatcaaaatgatattgacattcgtcattaattgatcaaccacgctgcaaatcaaaaaattcaactgatcattgccagttttgtttcagtaaattttgatcaaattccgtttgttgtcgtcgaatcagcatccgcaccattttcatcctgatcatttggttccagatccgatccatttgttgtcgaatcggttgcttctgcttctgcatcactttctccctgatcagatgagtttgtagcattctgatcagtaccttcttcatctattgcatttgattcagttgttgttgtcgtcgaatcggttgcttccgttcctgtttcatcttcatcagttggcccagtggcattctgatcattgtcatttggtcctggatccgatccaactgtcgtcgaatcggttgcttctgtatcactcccatcttgatcagttggctgatcagtaatcccatcattcggctccattatgtcagatgaagcattctctggcggatcatctgttgttagctgctgttcctccgatgtttcgttgtcgtcttcttcgttggaagatctatcatctgctggcaatgca

SEQ ID NO: 32917 - DNA, 1157 bp, Heterodera glycines
agtttcttcaccaccttctttttggagggcgcatatctgtagttcagggtgttcttgaagcacctaattgttgtataaataagaattgattttattttgatctgtgttactcaccaatttgtgttcttcagagaatttttttgccatttcgaagtaaggtttctgaaaacaatcgtttttgagaaatttgggaaaggtcaccttttccttgtccgacattttcttccatttttcgcccatctgaatctaacaatgtaatggtcaatatgtcagcacaacacatcacgaatacaaattgataaatagagaaacaaataaaaaaactcacagctttgctcacttcgttcatctaacaaattgatcaattcttttttttcttaattcgcccgtccactcaccttcattttgggatcgtccgttaaaattcgcttcctttcctgtcttgtccatatcatataagcattcaatggccttttgatgaatttatgagaggaggaacctccaagcgcattgttgtgtggatggagttcaatgtttgttgagatattggccaaggagggagaacttaaatgaaaacatttaataaatttaaattatgagaaaataaattgacttattagtttataaaagacattccaattaaaatataaaatttgttatttaaaaacaaaaatacggtggtgcattgtcatcgtgaagagagtgatgagaaatgttggtgtgttcgttggtcgatgctcgagaatgacagtcgcgaagagacgaaggcgaagcctataaaattaacagaccatttaagggtaatcaaaaaagggaacacacactgcctccgcaattcgactcttcttctccctcgggactgttgccattttgggcttctaagtgattgttttcagaggcaatcataggggaaatgagaataacagcacagtcccaaaattctataaacaaaactttaatagaaacgtcctggtaagaggaattaaaataacaaaaaaaaaagaaagaaaagaaaaaataaaagggaacgaacgaacgaagtggccaaagcaataaggtaaatgattgaaagggaaagggaagcaaagggaacgacgggaaataaagggattgaagggagcaaagacgatgaaaaggatgaagggaaacggggggga

SEQ ID NO: 32918 - DNA, 963 bp, Heterodera glycines
  misc_feature (793)..(793): n is a, c, g, or t
ggaacttctgaaaatctgatccatcgtctggtttgtttgcattgcaagcattgctgatcaattgcagtcaaattattccgccgatatacgaaaagtgctcaaaatggttcttcagccaatcgaggcagttccaatctatcgaggtatttatgattattactttctatttaaatttgttttatttttgttgattaattgatagttcatttaattctgtttcatttcacctttaggttagtgggaaagctgcttcagtgcccgaaaatgaggaggagacggggatcgaagtgcgtgagactttgcctctcccggcatttgtcggtgttcgttgggtccccgattcggattgtgaccaatgtacatcttgttcgaggtaataattaattttctttttgtgcaatattttaattttatttttgtacatatttatttgaatttgaataattttgtatttcagtccgttcactttggtcagacgtcggcatcactgcagaaactgtggtcgaatattttggtgcaataaaaaatatatttgtaaatttatttattgccctttttcagcggtcaatgttccactaatgcaatcgctattcctgagcttggttatgacagaagggttcgttttgccccccccccaattgacacactattttaaaatgaagggattttatgggagtgttatgaaaattcatttttaaccatttttctttcttaccttattaggttcgagtttgcgatttatgctatgaaaatcggttgcgacaataccattccgagtccggcgatcaagaanatggttcgttttggagaggatggcgaaactgcaaatgctttggctgacaacggtccgacgactgcaggtccggttgggtcgactgggcatgagtgccctctttcgtctactcacattccgacattgtgcccgtgcatcgtcgcaccacagagggcgatgaaatttctgct

SEQ ID NO: 32919 - DNA, 752 bp, Heterodera glycines
  misc_feature (693)..(693): n is a, c, g, or t
  misc_feature (696)..(696): n is a, c, g, or t
atcagaagaggacaacggaggaggggagcacgaacggacgtccaaaaagaaagccatgaaaatggtgatgagcaggacgagggagaagcggcgagcggaacacttttatggaccaattgtcacaattgcggagggacgatcgaggagagcactgagcaaagtggactacaatttccacgcttatgacgaacaattacaggtaaaagctgactgaaagttggaaacaatgaaaattaaggaggccatggagacaattggcacggacgtaaaagtcgaaaacggtacgttttcacatcccgaattatgatgaaaattaaaggggaataggcatttgttaaaagcccaaatagttacagcgcatgaagaggcttcctccgctcgtggtaaggacatgcagaacatttacgaggccgagaagaagcagaagcgtgaggaggagccaagcgaaggggggcgggaggagggcgcaccggcgaggccccctaacagcggggaagggggcagaacgacgaagaaaggcggacgaaagggcaaaagactgaccgacttggacattggcaatgcgtccgagtcggacacggttagtgagaaatgccattccggagacatagaaaattaggacgaatggaaggcgagcagtgcagatgaaaatgaagaggacccagaaccatcggaggacgagtatcttccctncgnaaggcgatctgcgaggtgatttggcaaagagccacaaaaaagtaccaaaacatttt

SEQ ID NO: 32920 - DNA, 322 bp, Heterodera glycines
acaaatcgctttaaaaccacttttatcgtatagagtatggtcgatttgctattgtaaattttcggcttttttggtgtagtcgccaaaaatgatcagaaaaagtgatcaaatgaagcaaaaaattgctaatttgactcattttcctcttacattttaatgaccttttaatagagattttgtttgctgatcattcaactgcgtccaaaatacgcaccctgtattgtttgcactgaaccgctttacaacaaatgaaaaattataaatacataaatcaaaatgataataataactctcggctataaatggaaacggagagaatgta

SEQ ID NO: 32921 - DNA, 1016 bp, Heterodera glycines
  misc_feature (872)..(872): n is a, c, g, or t
  misc_feature (902)..(902): n is a, c, g, or t
  misc_feature (990)..(990): n is a, c, g, or t
ttgccagccctagtgtcaaccccttccccatcattacttgtcttgcttttccttgaacaaccccttcagaatttcacaaaaagctaattttgatctgggaaccctggctacaaccatcctatattttgaaaaaatggtaaaattcacaaacaccagcagttttattaatttaataataaatcctaaaatgttacataatgaatattcctacagtcatacttaatcggatgatgtcattaaaaaaataaggaagtgatttaaatatctaattaataatgaaataaaattattaatatcttctatgacatgaaaagtactaaaatgacaaaacatgaaaagtactaaaatgacaaactataagaatggaaaaagaatataataaacacttgcacttaaataatttgtttgttccgaaaattccaaattaatgaattcatttatctttcaaaagattgaacacgataaataaataaatatatcataaaataaaataagtatatgcttcaaatataattaggaaaaaataatttttttttataaaatattgcttataaatgatattaaaaagtaagtacaatgatcaacattaaaatgcaagaccaacattaaaagaaatgcagtcggacgaaaggcaactaaaaaggcaaaaacgaaaaatgggcacaaaaatagaaaaaaaaaaattttcttaacgcattttagtagcaatacacgtaaaaatagaatcaaaacttaatattttgcggaatcgtctttttggaaatattgccaattcccctaattccatttcctcccccgaatccatcgaacttggagaagtccgacatgccattcaagagttggttctgcgaaccaaccccccgctccgctanataaatttgaatggaagcacgaaaggtgcncaaaattgtccccaatttcgatccaaaatatcataaacacttaaagcttagtcctttaacccctccaaattctctgacgccaatatgncgactgaaaccgagccatccaaaatc

SEQ ID NO: 32922 - DNA, 728 bp, Heterodera glycines
aaattcacaaaaatttcggcacttataaaactccattttttcttaggccagcatagtaaagtaagcccaaaatgtaagggaatttaaattgttcataagaggcgtttaattttttatttatccaatcaattttctgttaaacttttcgagacaaagcagaaaaattttccaattggatctgatgcggactcaatttcttcaacaacaaaataaaaaatattaggcaaggaattctttttctatcctttttaaaagtgatgcataaattttcatggtaaatagtcacaaatcaccattgtttcactgccaattaatttcacttgcaggagaaaaaggcgataaaaatgcatatagatataaataagtcgtttaacaaaattatctcaacaattagtcgggaaagctgaaaaaatttctgttgcaataacctattggcacaagacatgtaagtggagccggctgaaatagaggaaatgccaaagattaaaaattcgtttttatgccccactctgctttgacgggccatacctagccagagagtggagatagacccttggttgatacatttgaaaatgtagagcgggcctagcgcattcgaagaacaccaaatttgtttgggtttgtccccaaacaattcgcttatgacgcgccggaagaaaattcacaaaaatttggcacttataaaactccattttttcataggccagcatagtaaagtaagcccaaaa

SEQ ID NO: 32923 - DNA, 1399 bp, Heterodera glycines
tattagggaccggatttatatagacaaaatatggacgaaaagtcctaaaatatgcacgatcccctaatttgctctcctttttacgagaaataaaaaactgtagttcatcgataaaagatcattaaaattctctttaatgaataaaagtaaaaattataatgacgagttcgttcggaaggaaattttatggctgcatttcgtgccaaaaatattaatcaacgcattattttaaaaataattaaatcagatttttaaatttttggcacaaattgctttttttaatggcattgcaaggcgtgtgtaatggcttaaataaattaatctacaataatttcagtaaatgatcattaaaacatgtgaaattattaaaatcactcttcaaaattgccattacacatttaaatggtcaataatgtgtggtgaatgtcaaaatttcaatggaaaaaattagaatctcaacaaagtgtaatcacaatcagcatcaaattattagtgggtgagaataaaattaaaaaaatgcttttttttaaatatatttatagtatttcatttatttattttttgttttattgcgccatgttttgttgatgttgttgttgctggtgatgctgctgctgttgagctgcagccctcgccgtgtcgttgatgatcaaatatttgtcaaactcatgcggattcaaatcaccagtggacagctcctaaaattgggaatggtatacgattactaaaactccacaaaaccaatactgtaatcaaaattaggcaacactcagattatatgtaataggaattttttttagggttatattcaaataataaaactattagcgcctcacctggaacagcgggtccaccagatagcccccggcttgatgttggaatgaatcgatttccattagctcctgaaaaaattaacaatactctgtgattaataattttgaaagcttttcctccttggctataaggctatgagaccttaaatatatgaatgaacttgcacaaaaatgatccggtcctaaagctataatcaaaaatgatcccttatataaattaggctaaaaccttacatgggggatgatcggattgtaaatctgataacacaaaccaatgatcgacttgtaagtctgtataacccaaacccgaacggccacctgttgttgttgctgttgttgttgttttgattgctgctgcacaaactgttgttgttgctgctgctgatgtgccaccatgttcatgtgttggaaattggctgcctgctgctgatgttgttgctgtggttgacgcgttaaaaaggacgcatcaagcagaccctgggcaggttaagcaaacactataaaatgtatcgagttttcattatttatttatttattgaaattggataactaatgcatatcttctg

SEQ ID NO: 32924 - DNA, 1048 bp, Heterodera glycines
  misc_feature (1011)..(1011): n is a, c, g, or t
tggaaaaatgtctagacagaaaagatttaactatgtgtcaagaattagcagaagaggccaaacaatcaatcgaaatagccaaaaattatcggcaagaaattgggcatatttatcggaccgcttactcgcagcccgatttaggcattggagacttggcaaataaactaaaagaaacaatgcgcgaaaaccaaatacggtttgaaaagcaaagacctcaggaagaatttagggatgaatttattgcttataaaatttaagaaaaaaaattcgagaaaatgaaactgcatgggaatcaaaggttgtgggacataaaccaaaaacaggtaaaaagggaaacaggtgaaaataggtgaaaaggaaacaggtgaaaacaggtgaaaataggtgaaatttcacctaaaaatatataggggcgtgtatttaatggggcatattagataatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgacactatattgattgaaatcgaagaggacataaaatatcataatttttctgcgggggcaaaatgctttttgggtgacaacaagaaatagttgatgatgctaagaaaaatccgagactccaaactgaatttagagatgaatttattgtttgtaaactataaataggatcaagaaaaaaaataccaattaaataaaaatgaattttcataaatcggaaaaagctaatgccattttattggaggcagctaaaagagagacggagagagcatggcaaggatgtaggtgcactagaggaagaggttagcgattttgccaaatcttctcgggaaactcttaatcgtgcgataaaatcccgagagaagcccatacgctaatggtgttcggnagtttacataaaatatccgactcaatctgggaaattt

SEQ ID NO: 32925 - DNA, 905 bp, Heterodera glycines
ataaataaaatttaaaaatattagcatggtaatttaagctttattaattgttttttttattatagttgccaaataaatgatgatgaaattcatccataatcgatatgaggctttcaatttcccattatgcgtcaacccagcttcattcaaatgattaatttcctgagagaatcgataaaataaaataaatatttataattttttcggtttctgatggtattagccggaaattgtttacatgaatattaaattgagctggattaaaaaaatattttaattgtttgttaaaattttaaataattggattaatcgtccgggaatcttcgcttctatctgtccgtaagtcggtcattttcggaaatgaatcaaatttttcgaattttcatccggcggcacatgtcagcaccgttggacctaaaactattaattttctaaattaactgaaatattaagagtttgccgtgactttagaaatagggaaaagggccggcggtgccgttaggcgccgccgacgaatttttgaaacttttgccccgatttcttagcagattttgtttaatgaaacaattatgtaattctgaaattttcaattttatacagtgtaaattattcacggaaaccgtggagagagaggcagagagagagacagcgagagagagagaaatgtaggtaacaaaaagaagagaataaaaaggttcaatttgcaattcaagattggccgacatatgcggcgctgacatttgcggcgctgacatttgcggcgctgacatttgcggcgctgacattcgcggcgctgacatttgcggcgctgacatatgcggcgctgacatttgcggcgctgacattggcggcgctgacatatgcggggctgacatttgcggggctaacacttgcggggctgacat

SEQ ID NO: 32926 - DNA, 379 bp, Heterodera glycines
acaccaattcagaatgattacctccgcccgtccctgacggggaccgattcatattctaattgtttgtctggcagtgcaattagccgggattttgccccttcaataactcgcgcaaaaaatttacaatttctgcagattggctcgaaaacgaacatattttggagcatcaactacttgaagatgtcgtcccaagcacatcttccaacgcctcaccaatttttggtccaaattttgagcggaatggttcaaattcgagcgtatcgtacatggttgtgtttggcgtgtttgaaaagagtacccttttgtaatttttttcacttttttttggtaaattttttttttgattatatttaatgaagaatttgcctttttttaacat

SEQ ID NO: 32927 - DNA, 786 bp, Heterodera glycines
attttcaaaatttaagctttcatctaacgggtgcaaacatttccaatgtttttgtgccatactttgcgtttgaccaatgcaagccgtaccacagcattactcatgacccgaagattgaatcccggaactttggtctgtactttttgacgaagcatcaaggtggacactgtgatgaggggtaaattgcgtagataattaggcataattaaattttaattgccatttagcatactgatctgctatccggggacactgatgcgcaatcatatgatcgatgagttcaaaaatatgtccgagttcaaagtgaaacggacattccaagtcggcaacaaagaagtaatgggaaatttaattaaaaaattttttttttaattttttaattttcgaacgattcgctttcattggagtgcgcccaagaaacggaacaatttgttggccttacagacccggagcaatggcgtggcatcaaagtgtacacgaaactgacaaactcatcaaatccactttcgacacgagagctgatcctggagacttccttgacaaatcgaaggtaatcaattttagggtaattagggttaattaacaaaaattttaaaattttagttacacctttgagccaatgactcgtcaactttcgcttaattttggcacccgaatttcactgttcacttgggtcacaactcattttggtatttaattttttgtaggcatttctatatattagtgcccggacttttgaaaaaaccaagaccaacaggatccgcggatttccaaggtcgactagaa

SEQ ID NO: 32928 - DNA, 960 bp, Heterodera glycines
ggggcctggctcgaaaatttttgaaaattttacatcatgtagtacaccattcgatagcattaaaattctctacaaaaatgttctaagacaatttttcgctaaaacccacccccctgacagttatgggcccgggactcaaatgtcccgctcaggccaaaatttttttctatttccgggaaaaaatcgaaatttttccgaaaaaaataccagtcgatagagctcgaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatctggaaaaatcgagctcaccgagctctacaataagtctgctggccaccctgcgctcaggtcaaagcctaatgagttattcaacggggactgaactgggcaaagttggtactgaaaagttgccaatttctgcagcccttccaagtataggtagaggcctggaattttttttgataattagaaaacacttcaacttagtttcctaccagcaagcattttttgatcagagttttagaaaaaaagttatgggccatcaaacgcaagcaaaagtgagaaattggccgccaggactcagttggccaccggagcggaaaacccttatttttcccagatgcgcctcaaaaagttgtaagacccttccactactttcggggcgctcccggccttcggccgggagattttgttttttgaaacgaactgcaacgtttctctatagtagtataaactagcgggtgcgtgaaccgtcggcattttcgctgggaaaaagcgcttcgcgctttgggagcttcgctacctagtctgtgaagcgattcaaattgatcgatttggttggagagatttttatgaagatataaaataattattagaggcttttagtccacatcgag

SEQ ID NO: 32929 - DNA, 1011 bp, Heterodera glycines
aaattaatcagccgccggcgaaagcgtgggaattggccattaagcaaaaacccccagcagtctgccgggactgggacaattattatgtcctgtgtctgtctgtgttgttcaaaaatgatacacaaatgttggccaaataatggaatttttaatgattttaataatataattaaattagtttacagaaaacgttaaatcagatgtgtaaagggttttttaaaagttgtgtttaattaaaatatgaaagaattaagaaatttttaatacaaggaacaactttttcttatacttaaagagaatatattaagaattaatatctatttttttaaaattaaattagttaattttaaattaatataattaatttaaaattaactaattaatttaaaaaacagtttttttaacattataatcaaaaaaactaaaaaaaaattaaaaattatattttttattttttggatctaattaatcttttttcctaaagttagctctttggaaaaaaaagtacaggtacaggctttttacaaaataccgatctctaatgcttatatttaaaattaaatttcaagttaattacctttttttaattgatccttttttggttagtatttttaattttggaatattaaattgacaaaaagattttttaattaaatttattaaataaaatattaaaaataataaaaaataaataaattcctcacaaagctcaggttttcctgcattttctaatatttttataactcaccacataagaatggtatttcaattttataattcaagtcctctttcatgttcaaaaaaaatttatcggctttatccaatgcttctgagcaaattcatttaacacattgatcagccacaatgtgttcgtgcttttccgtgcgacaaactgatcagtctgatagtaaacattatgtgaaaaaaacgtggcactgatcagcagcaccagcaaaagcaggcactttctgcgtaagtctgaccaatttactattattttttatttttaaa

SEQ ID NO: 32930 - DNA, 936 bp, Heterodera glycines
agatgctgttttgaacgaataaagggcataggttattttgaagaagtgtcaaataacatcagcaataagcctgcaaaatctaatgagtggaaaatacatgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaattagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgctttagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttc

SEQ ID NO: 32931 - DNA, 978 bp, Heterodera glycines
ggcctggcagggtcgtactcaaacaattatgggggaagcaaaaatccaacgcagacattcaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaattaaatttggtgcgtttcagaaccctttctgaaaaatatttaagaattaattttgcaaaaaataaataaaaacgaagactcagattttcgaaaa

SEQ ID NO: 32932 - DNA, 75 bp, Heterodera glycines
ccttggcggcaatagcggtatcttccgcgtcatcttcaatgacatcatccgtgcggtagcggtactggcggtagg

SEQ ID NO: 32933 - DNA, 760 bp, Heterodera glycines
ccctcattagtagggaacggaattgatgcatatgcctattttgattatgcactagtttatttaatcataaataatatattttctatttgtttaaaacttctatgttgacttttatttgtctttggtttttttaaaatattttcatccaaattattattttttcttgattaaaattttaaggtttaaaaaatgtaataatcattttaattttttgattaagtttacgtgtgttttgctccctaaaaatcctcaataaaaaaattaaatgcttttttcatgcctatatttgagggtttttgttctccttttcaaaaagtttttttagataccaaatttgttcagtttagttgggaatgaagcgagttatgattgatcaaaataaaaaaatacaaaaaagtatagtccggtaaaaaaaaatttccgggagcgggagcgggaatcccgtgaaaatcccgctcccgttaaaatccctcagaaattttacgggagtcccgggcgggagcgggagtaattcgaaaatttaattaaaaactaacaaaaatatttttaatgcacaaatttaaagggcaatcaatttattaaattaaaaatatatagaaaaatttataaaggagaaatttgaaataaaaaaatcttatttttgagtcaaaaatcagtattttttcaaattgcttcaaataaaaatttttaataatttatttgttgactccctttattaattttaacaatttttttgcggcttattttttgaaaaaacttt

SEQ ID NO: 32934 - DNA, 986 bp, Heterodera glycines
gactaaaaaagtcataaaaaatggccaaaaagtcacaaacaagtcataaaaagtcacgaaaaaatgaaaaaagtcatgaaaaaagtgccaaaaaagcacgtaaaaaatgcaaaaaagtcctgaaaaattaggcgaaagttaaaaaaatctcatttttaataatttatagaataacattttggtcgtatttttaagcacttatttttataaataggtacctaaataggcataaaaaagagattcttccaacaattaagaaaaaattcatccaggtttcattgcctttttatcggtcaaaattttaattcgaaattttctttgtattcttcggcattttcgtcccaaaaagtcaaaaaaatcacgaaaaagtcgcaaaaactcaaaaaagtcataaaaatccgaaaagtgtaaaaaagtcaaaaaaagtcacaaaaatatgcatgttagaagcttcaaacaaactttagaacacttttttagtcattttaaggccgtttagagtcagcaaaaaaaagtcatttgacttaaattcccagccctagtaaaaacatatagatatgccgatttattatgaaatcaattaatttaagttaatttttaatacattttatttttaatgaaatatttttaagttggttgtgaatttaaaattttaatttttttaaaggctatcgaaaccattgatgaatttgttgaattcattaaaaaatattcaaatgatgaataaagaaagcagaatgatgacgatccgcagaaattattgctttatttttcgataattatctaaggaaattgttgctttatttcgataattatttaaattgctatttgggaatcatttaattattggctggtaatttttattgaaattcttttcatatttcgcgaatatgtcgatattttgacatttttacaaaaaataaaaacctaaattaaaagccccttataaactaagcctttctgatccataaaggctcaaaaatgtt

SEQ ID NO: 32935 - DNA, 869 bp, Heterodera glycines
ttttccatcatccccggtgattggacggcgacgcgaacgacgagagagagagaaacgggagcgaaactcccgtcttcagcgatcggaagagttggcacgtccggagtgctggctgaagagctcggacttaggcagttgaacctgggagcaccggcttctcccccaaattgagtcggtggtgccgttattcaaacaacagcccacttcttgtttgcctcccacccttctctccattccacccccttgggaagggaccgaacggcagcgaagagagagagagagagagaaaagagaccgaatttgaggagtggattggagcagaaggaagggagaaactccccgccaaatcggcagagagttttcgccacaaacaaagttggtgccgttagcagggggaaccaacaacaacacttcggtcgccgaggaccaacaacacaagcggtcgccgaggaccaacacaacaaacgaattgtgctaacggcaaacaaagttggtgccgttagcagggggaaccaagcaacaacacttcggtcgccgaggaccaacaacacaagcggtcgccgaggaccaacacaacaaacgaattgtgctaacggcaaacaaaattggtgccgttagcagggggcacctcccactgcacatcaaggaacagcaacgagttgtggtcgccgaggaccaacaagcacatcgatttgtgctaacggcaaacaaagttggtgccgataagcagggggtcctgccacaaacaaggaccagcaaccgggagcacctcccgctacacctcggactaaccagagcgaaacgaaaaagggaacggaacagcgaaccgctcgatgaggaagcggaaaagggaatggaaatcaggggga

SEQ ID NO: 32936 - DNA, 878 bp, Heterodera glycines
aaccatgcaagcccaggcacggatatacatcatcaagccgttctaacaaagaaagggggaaggagggaatatggagagacaagtaagagtgaaagaaaaaagcagagaccaaggaagaggggatgggaagaaaagagagagtgaaagagaaaaagagacgaaggaagaggggatgggaagaaaagagagagtgaaagagaaaaagagacgaaggaagaggggatgggaagaaaagagagagtgaaagagaaaaagagacgaaggaagaggggatgggaagaaaagagagagtgaaagagaaaaagagacgaaggaagaggggatgggaagaaaagagagagtgaaagagaaaaagagacgaaggaagaggggatgggaagaaaagagagagtgaaagagaaaaagagacgaaggaagaggggatgggaagaaaagagagagtgaaagagaaaaagagacgaaggaagagggagagagtgaaagagaaaaagagacgaaggaagaggggatgggaagaaaagagagagtgaaagagaaaaagagacaaaggaaaaggggatgggaagaaaagagagagtgaaagagaaaaagagacgaaggaagaggggatgggaagaaaagagagagtgaaagagaaaaagagacgaaggaagaggggatgggaagaaaagagagagtgaaagagaaaaagagacgaaggaagaggggatgggaagaaaagagagagtgaaagagaaaaagagacgaaggaagagggagagagtgaaagagaaaaagagacgaaggaagaggggatgggaagaaaagagagagtgaaagagaaaaagagacgaaggaagaggggatgggaagaaaagagagagtgaaagagaaaaaga

SEQ ID NO: 32937 - DNA, 965 bp, Heterodera glycines
  misc_feature (871)..(871): n is a, c, g, or t
  misc_feature (894)..(894): n is a, c, g, or t
  misc_feature (904)..(904): n is a, c, g, or t
  misc_feature (933)..(933): n is a, c, g, or t
tttttcgatagatttcgtcaaataattatttaaataactttttacaaaatccattatattctttccttgaatttgatcagcgttagcctcaactattggtaatttatgaaaatttttgatgaaagacaaggcaaaagtgtcgctgattgattcacataataaagcttaaaaacggattcatatttaaaagttaatcggatttaataccttcttttgcattgatggaattaattaatctgaaaaaatataaagcataaaaatttacaataaaattttttctaatttttagcataattgtaaatttatgaaaaaaaaatgaatttaaagagacaggaacgatgaaattaataaaattcacgaaaaatcaatgaatatgtatgtattaattttcaatcatttcttataaaaattatttatttttttaaattataataacattaggaaaaaatgaataaaataataatttcttttatttttttaatagaataacattacagaaaaatatgaatcaaataaattggtataatttgcgggaatgactcaaaagaataacaaatgggcaaatattaattaaaaataaattaataaaaaaaatgcttcaaaaaacatagtaacattaaatcagagaaaagacaatttgtgaaataatttaatattttactttgattttaattatttccttcattgaaatggttgcttcggattataaaaatatatttcaatgtactgacttcttatatcccttttcataggggaccagtaaattggacactcggaaaattggacaccagaaaattggacactaagatttcctttttaaaaaaatcaagaattagaaatgaaccaaaaatgtgtgacgattgatcaatgngcctaaaaatgaaccaaaaatgngtgacgattngatcatgggccaaaaatgaccaaaaatgngtgacgattgatcaatgggccaaaaaatgaac

SEQ ID NO: 32938 - DNA, 716 bp, Heterodera glycines
tttttcggttcgcccacactgagactattttcggttcgacctagcacctgacattagtgttcagagagaaaagtaagtgggagagagagaaagaaagggaaagaaagtgagaaagatagagaaaccgagagagatggagagagagagaaggggaagatagattagggaagagggatgcgggagagaaagaagagaaaaaagaaaaagcgagataaagagagagtgaagaggaaaaagaggatagagaggagtgcgggtgaggggggagaaattaagatgagagagagaaatagtgagcgagagagagagggagaaagtgagagaacaggtgagaaagtgtgagaaagtaagagagaaagagagcaacagtgtgtgagagagagagagagagcaaagaaatcgagatacaaattggtaagaaatgagaaagacaccgaaagagtgaacgagaggagcaagagagagaacaggaaaaacaagagagagtgaaagagagagagagacaatactgtgaaagagaatgagatagagaaagaaagagagagatgagaaagagagagaaaagagagcgagaaaggggtgaactagagagagaaagagaaagaaagagagagagaaaaggggaaaggaatgaatgagagagagagggggagaagagatcggacagaaagggaaaataaaaaagaaacagaagagaaaaaagagtgaaagaaaaa

SEQ ID NO: 32939 - DNA, 775 bp, Heterodera glycines
  misc_feature (666)..(666): n is a, c, g, or t
attattaggaaaaacaacattccttctctccatataacttttttcaatccatacaatctgcaccaaattttgcatatcgatagagaaaaaaattctgcatcgattaataaggaaatttaatgaattaaccccgtgactgtgaccgtgagtgaaaaaacccgtgaattcacggtaaccgtgaccgtgattcacggcgcatctctattgattagagtgccacgggaccgggacttgccaggacctgagaagccgggaccgggacctcgattttttttcgggaccgggaccgcaagaaaaaccgggaaccgggaccaaccgggaaattttaaaaattcaaaaaaattttaaaaattcaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcacttttttcggagcgctttttcaaaaaacttttgggaaagaaggggtccccggcggtgccgataggcgccgccgggggaaattttaaaaatttgggtgcaatttgttaacagattttcaaacaaaaaaggntggtttttgcgattattaagctcaattggtaggattttcatttaaaaaatgataaaatatgtatcaatttaaaaaaaactatgaggaatcatattttctttataggaaa

SEQ ID NO: 32940 - DNA, 434 bp, Heterodera glycines
cctctctctctccccccccctctctgtcccctctctctttctctcttttctctctcaccccctctctgtcccctctatctctctctcctctctgtctgtatgaaaacagcgaggacatttcttcgacatttcttctgtcgtcccaatgagtaattataaaattttgattattcggtgaatgggaagggacaaaacagaaagcggggaggaggctgcaccagcttaacaaaaagcgaaaaagaagccaaatgtgaaaacatttgaaaaaatgtttggaatgaaaattaaagcgacaaatatccaacgggaagaaaaatttgtgggggaggaagaggaggagggggggggggggggtaaagtggacaaaacattgggtagggggagggacaaattgtgggagattgggggggggggggggtaaaagactccaaaca

SEQ ID NO: 32941 - DNA, 908 bp, Heterodera glycines
  misc_feature (864)..(864): n is a, c, g, or t
tgagggatgtcacatttgagggaatggcacctttgaggtatggacatttgagggaaggacatttgagggaatggcacatttgagggaatggcacatttgagggaatggcacctttgagggaatggcacatttgagggaatggcacctttgagggaatgacacatttgagggaatggcacatttgagggaatggcacatttgagggaatggcacatttgagggaatggcacctttgagggaatggcacatttgagggaatggcacatttgagggaatggcacctttgagggaatggcacatttgagggaatggcacatttgagggaatggcacatttgagggaaggcacatttgagggaatggcacatttgagggaatggcacctttgagggaatggcacattttgtgtgattggcacattttgagggaaggcacatttgagggaatggcacatttgagggaatggcacattttgtgtgattggcacattttgagggaatggcacatttgagggaatggcacattttgtgtgattggcacattttgagggaaggcacatttgagggaatggcacatttgagggaatggcacattttgagggaatggcacatttgagggaatggcacatttgagggaatggcacatttgagggaatggcacatttgagggaatggcacattttgtgtgattggcacattttgagggaaggcacatttgagggaatggcacatttgagggaatggcacattttgtgtgattggcacattttgagggaaggcacatttgagggaatggcacatttgagggaatggcacattttgagggaatggcacatttgagggaatggcacattttgtgtgattgncacattttgagggaatggcacatttgagggaatggcacattttg

SEQ ID NO: 32942 - DNA, 732 bp, Heterodera glycines
gtttgtcctacttactgctattttgtgaccccgaaccccacacaatttgttcgaaagtcggaaattttgggagcagaacccaaaagtgagcaaaaatgtcgggatatttgcggacaaaaatcgcaatagagctaaaggctcttgaaaaggcgaaaactgcaaccgaattgtatgctgagccggacaaaactctgacctcattggaaaatgaaattctcctggaaagcgcggcagagagaataaagtcagatgtggaggcagtgaatgccaaaatcgagcaaatttggataaccgcaagcaaatggcatgacgtcatacaaaaaatggacaaggacgaaagaatgtgagcagacagcgtatgaacaatttcaaacaacggagaaactgaacacaaaaatggaagcagccaacacaaagctaacagagctgaaggacctggagatgcaggtggaagcgggagcaaagctgcaacgctccaaagcggacagagacgcgcgagtggagcaaagagaacatgcaaaagcaatgtcgaagtcgaatgcagaagcagacaaaggaaatagcgtgcgagaggcaatgaaatgactgccgcattgtaccaattgccaacactaagaattaagccgtttgggggagacaaacgggaattgcccatttttgaagaagcatttaaagtggatgtggaccaaaagccaggaagcaaaacggagaagctaaatttgctgaaatcgc

SEQ ID NO: 32943 - DNA, 415 bp, Heterodera glycines
cgtcagttggtcttttttaaatctaaattttacaatacccaaagattgggagtaaaaataggtgaaataaatttggaagaaagctgccaaaaaacacaaaatttttccatggcagaaagtccgtccgaaccagggatggcacggaatttcgacttccgatttccgagatttttggggtcggaattccgatttccgaaaaaattttggtcgccggaattccgacttccgatttccgaaatttttgataaaaagtcggaaatttttttgagttttttttcaaaaaattagtaattttgtagaatttcagttcataaattgcactgaaattttcaaaaattttttccggcggcgcctttcgacaccgtcgtactctaaaaaccttaattttcttgaaaaatttacttaaaatcgctaa

SEQ ID NO: 32944 - DNA, 1266 bp, Heterodera glycines
  misc_feature (305)..(305): n is a, c, g, or t
  misc_feature (355)..(355): n is a, c, g, or t
  misc_feature (467)..(467): n is a, c, g, or t
aaagaaacagagagaagaagcagcggaaaatgactaaaaaacaaatatttagaaaaacgaattaaattagacaaatcaccgctttgatttgttccacttccatggttgaattcatatagcatatgagcttcttcggaaaattatcgtgacgaggcgtgaacagccatttggcaaccgtttggccatccgtcgcattggcactgtcgtcgggcggaaattcgagggaaatggcgccatcgaaagacacaaattgaagagactgacaatcattgagcattgacgggaccaattggcgcattcgacgnaaagcgatggggatcaacatggtgtcatagatagtgtccttgaacattgnccaatggtgcgaacacgaactccgaacgcgaacatttcatatcgataaacatgtgttgagcatggcgcgaaaaacgtggaaatggccaaaaaaggatcccattttggcgatngagctgaaatccaaaaatggattgggactcctttccatttctttttacctcgacccaggcttttgaagccaggaattttttcggaaggattgtgggaattggcaaggttttccctgggattgaaattttctttttttggcccattggccaaatttgggccaaattttttttcccatttcctttgcgggtttaaaagggcccccaaaaaaataaaaaacggggttattttccctggccgggccatttaaatggggggaaaaaaacacccccccccccaaacccgggggggaaattaaaaagaaaaaaaaaaagggctttaaaaaaataaaaaaaaaattttttgtttttttcttttttttcccccctttttgggggggcgccttttttgtggggggccccaaaataaaaaaaaaattttggaaaaaaatattttttcccccggggggggaaaggggggggggtgggtgggggggggggggggtgtccctttttttttttttcctccccacacaacaccgccggggggggggggtgggggcgccccacacaaaaaaaaaacaaaaaaacgggcgggggtttcctcccctcctctctttttttttttttttaaaaaaaaaaaaaaaaatccttttcttttttaaaaaaaaaaaaaaaaaaaaacccgggggggggggggagattacctctgggggggggggggagggggggggcggggggcccgcgcccgctgttttttttttttttttttttttttttttttttttctttttttttttttttttctccccccccccccccc

SEQ ID NO: 32945 - DNA, 131 bp, Heterodera glycines
cggacacggcgcagcccacggcagccagcagctctgccaccatcaatgccatgaaatatgcgcgcagattgatcgcgctgccgccatcaccgggcggccgcaccgacgcggcgccgatcagcaccaggccg

SEQ ID NO: 32946 - DNA, 189 bp, Heterodera glycines
acctgctgctgctggacgaacccaccaaccacctggacctggcaacgcgcgaggcgctgtcgatggcgctcaacgagttcgaaggcacggtgatgctggtcagccacgaccgcgcattgctgcgtgcggtctgcgacgagttctggatggtcggacgcggcgccgtcggcccgttcgatggcgacctcg

SEQ ID NO: 32947 - DNA, 932 bp, Heterodera glycines
gattggtggcatgccattctttgccgtgtcttttcctcgttcggtccgccgtcaaaacctcggcattttgtcttacccgctttgcaattcggacattcgcagttgcgccccgtttttcccccaccgcttttgcttttcgttttccccccggctttcactcgttgcttttgtccctttgcatttgatttaaatgcttcacgatgagagtttgtcgacactgatccattgtttgtttccaatggcatttgctgtttcattgtgccattctttgctttttctggcgttctgttgctcccttttttggcgtttcgttgtgccgccgttactgttgttgaacttttgttcttcaaaccggaatcggcatgtgttgtggtgggagtgaattgaggttgagagtttgagaaaaagcacgcatttccaatgttagcccccaattggttggagaccaaacctggcaaaacgaataaaactgagcgaaatggaaacccaattgaacttttaccacccatgaagcgacttctttcaattattcattaatttgtctttccctcctccgaattgtcccacctccaaaagtgttgccaaaatacgacgcaccattccatcctccgtttgactgtgccgaacttgtcgccgtcgtcgtccctgctgctcctcctcctcctccatatgttccgttaagcagcgcggccgtctcagtggcggctgcgctccattgccaagcggacggtgcccacggcgttactgcggcagcggccatcggtgccgccaattgagtggaatttgcgtacgttgaaatgacgagagacgaagagtcgagccacgattgggaacaatggcagaagaacactccgctgaattggaattggaaaagcgaatgaagccaaaaatgggatttgtagcatcagcacaaccttagtgtctgtaaatga

SEQ ID NO: 32948 - DNA, 957 bp, Heterodera glycines
  misc_feature (877)..(877): n is a, c, g, or t
  misc_feature (922)..(922): n is a, c, g, or t
ctgcggcgttttcattgtgccgttttgtcgccgtcgccgccgactcagcgccggcacggcacaaaatgcgcgtcatttgcgcacgttgctgatcgtccgtaagacaactggacacgaaaaataaagaaaatttgaaaaaatgaatgaatgcctggcgtaatgaagcggagaacgggaggcctaaaataattaaaatttaatttaattaattaaatggctcttgattttgtgtaaatatgtagatgagaaaaaatggaagaacagctcaattcttcatatgaatttgaatgattgcattttgccatagcaaccggcagaaaatgccattgtaaaaaaaagtcgggagcattaagaagatgagtaataagttaattaaatatttaaagagtcaaagataattgctttaaagtatttaattaaaattaaaatttaaatctaaattaatatgaatataaatatgattggattaatacatattaagaaagtttgaattttatcctagaataatgaaatatatgcaataaaattttatttgattagaataattttattaattagcaatttaataacaatttattttttattctagtataaaaattctttcatccttaattaatttggctatttccaattaatttaattgccttgtccgtcaaattgacacaacgcgggaacatcagcagcaaataacgcgccgcacgtgcccgtccgtgcaacaccttaattgaaattgaaaagtgattttctttgtgtgttaatttaatcgctcatcccatgccaatttattcattggcacggcacgtatcattaacaaaattatgaaatcaatattacaggatccggcagaatattttaaattgaaaaaaataaaattttnaaatttaattgttttttcttttcttttttttattttatgggattnaatatttcatatgttttttgatttttggattattt

SEQ ID NO: 32949 - DNA, 57 bp, Heterodera glycines
tgcccaattcgcggttgagccggcggatcacgttgccgatgtcggcggcgatcgagg

SEQ ID NO: 32950 - DNA, 403 bp, Heterodera glycines
cttcagtttcgctgactctcacggcactctccgctttcggacattcttttgtctgatgccggcgaatacatttgtagagcaaaaaacgcagcaggagaagcgatcagaaagtttcgaattgttgtacaaagtgagcaaatgggcaaagagacggaaataacaaaaggaaacgggggggaagagaaaaggggggaagagaaaaggggggaagagaaaaggggggaagagaaaaggggaggggaaagagaaaaggggggaagagaaaaggggggaagagaaaaggggggaagagaagaggggagggggaagagaaaacgggggaagagaagaggggaggaggaagagaaaaggggggaagagaaaaggggggaagagaaaaggggggaagagaagaggggagggg

SEQ ID NO: 32951 - DNA, 1008 bp, Heterodera glycines
aagcaatgaaaaactttttacctgtttgcacgcgtcgtacaccgcctgcatgtccgccgcggtggtaaagtcaataaagccgaacgcagtgcgatactcacgacgcaaagaattcggtttgatgcccacaaactccacaccgtcggtaatggctaaaaaattaggattaaattgaagaaatttttgtttttcaaatgaacaaaccttgaatttcgcgcatcagctcctgctggcccagcttaaagtctacaaaacggcccggcttggtcaattggctgaagtaaatgcgatgggtccattcccgacgaggcgcgatgttcaaaacgggcggcagagatggcggcgtttgctgctgttgtttgacagctaaagaaaagattaagtaaatcagtgaataaacggtttaaaatacatattatataaaacaaacagtataaaaaccacaatgtatgggtaaaaaacatcccagttgattgaaatttatataattaaaaaaaagttgaccaatttggtgttcgggattgtgctttgcgatgttgttgttgtgctgtggaatctcctttgacggagtaggtgccgtcggaccattcgttgcagcaacagcagcaggaacgtgcacggtcacgatgttatcaacattgttcggcccattccctcgtgcggcagcggcaatggccgcgtacgagccggccacgacagactttggcctttgagcccaactattgtttggtgttgttggccgcggcagtggtgacaaccgcagggttcggctgttgttccgatgttggtggtggtgcagcggcggcagttgcggccaccggctgagacaaagacggcggcggggcggtatcaaccgttttcggaacatcgacaatggaggagggaggagcaacggcggaaatcgccataacttcatccttcttattcggtgtagacgtcggagagggcaatgagtcaacaacggttggagcagcatcagatggcgcatccggctttttctccggttcc

SEQ ID NO: 32952 - DNA, 65 bp, Heterodera glycines
accaggcggccaaaatcgccgcgcaggctggcattcgggccgatgtacacgtgcttgccgacgat

SEQ ID NO: 32953 - DNA, 949 bp, Heterodera glycines
ctttctctgatcactctctttgggctgatcggtctctctgctaatctttgactctttatctgatcactctctttgggctgatcggtctttctcttgctaatctttgactctttctctgatcactctctttgggctgatcggtctttctcttgctaatctttgactctttctctgatcactctctttgggctgatcggtctttctcttgctaatctttgacgctttctctgatcactctctttgggctgatcggtctctctgctaatctttgactctttatctgatcactctctttgggctgatcggtctttctcttgctaatctttgactctttctctgatcactctctttgggctgatcgctctttctcttgctaatctttgactctttctctgatcactctctttgggctgatcggtctttctcttgctaatctttgactctttctctgatcactctctttgggctgatcggtctttctcttgctaatctttgactctttctctgatcactctctttgggctgatcggtctctctgctaatctttgactctttccctgatcactctctttgggctgatcgttctttctcttgctaatctttgactctttctctggtcactctctttgggctgatcggtctttttcttgctaatctttgactctttctctgatcactctcttttggctgatcggtctctctgctaactaatctttgactctttctctgatcactctctttgggctgatcgttctttctcttgctaatctttgactctttctctgatcactctctttgggctgatcgttctttctcttgctaaatcttgactctttctctgatcactctctttgggctgatcggtctctctgctaatctttgactctttctctgatcactctctttggggtgatcggtctttctcttgctaatctttgactctttctct

SEQ ID NO: 32954 - DNA, 1418 bp, Heterodera glycines
ccccaacgggtcggctatgatcagtggcaaatgctgttcgtactttaccggcaccgcaaattagtcgctgcttttgctgctgctgttcgaatgccggcacttccaaataaggccggaaaagccaattgcgcatcagcaaatcgccatccttttgtttttccatttcttttctgcttcaaccgaccctttctcctcaactgaccactctgctcggattgggctcagcattaagcgacgaagccgacagaaaaaggcaaaaaacgaagctgaacatggccaagtgggggaaggggacggagggaccgacggcacggagagacatcggcggaatgagagagcgaacgaccgacggaaggacgacggaaggaaaaggaagaagaagcgaccgaaggaaggttcaaacggtgccaaaatgcaaaagcactgctaaagaggaggcaaatcaactcaaaataacgaaatattaaggatggcataacccataattaattatgttttcgtcgagaacaatttagggagtggggagagccaaaaaaggagaaatgcttgagaaatgctaattaacaccgcaaatagacgtgataatcccctggggcggagggtgccgaaacaatagtgccggaaagggcaaagacattggggaggggggggggggagagcggtgagccgaatttgcatgttctgctcgagtttgggagattctgaaaaaggcacattaaatttggaaagaccgaatttttgatgccggaggaattggcgaaaactgaacaggtaaaactgggagagaagggaaatgaccttcgtttataagcagagcaaagatttttgtccaaaacggaagtaattggggaagacaaaaaattatagcggcggaagggcggtcggcggtgtccttttgggttaatttgactcatggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaacttgcaggga

SEQ ID NO: 32955 - DNA, 639 bp, Heterodera glycines
gtcgaccataaattgttaaaaaaattttagcagacgtttccttcgtctatcccccaaaaaatcctatttcaaaatttttggaacagtaattcggcataacatttttgtaaaattgcaagaaaatttttttaattggttaggaaattttcttttaaaaactttcggatggggggaggaacgacctgttccggtagttatagattaatcctacaatttttgtacacacctcaggctcaagttgtttggatgtcagaatgaccaggccgtagatgaggtcgcccactttgacgttcggtcggttccgtttggtggccccctcaaaggaagtgaagttgagcagtgccaagtcgatggagccaatgtcaacctggacaattttgttgcatttgaattttggagaaatttattaattaatcatatttagttaaaaaaaaactgggtctggatttttaaaaaattaaaacaaccaaaataaaaataaaaacctttaaattatcggtgggggtcgattgggccccgccgattgggccccgccggttgggccccgccgattgggccccggtacgattgggccccgccgattgggccccggtacgattgggccccgccgattgggccccatggggcagtcgctttttt

SEQ ID NO: 32956 - DNA, 980 bp, Heterodera glycines
atactcgatattcaaggctaaacgattttcgtgcattatataagaaaactttattttttggtactgaagtgtccattttcactgggactcagttgtcccagtgcttagatggcattggttcgagtttataccttgttttttagacttagctcatcaagagctttcgaatgataccaaatttgtccgaatttgggcgttttaaaaggtcaggagcctcccttttcactcaaattttcgagttttaaaccggttttttggcatttccgcaattggagacctactttttcgtgcatagctcgtcgagacgaatcgattagtatatcatttatgtcattttttccggggggttgactatagtatatcccttttcccggtcaaaacaggtaaaaccgggacttaaatactgttgtccgagttttttagtaccaggtctaggtcccgtatttactctagtttttatgtttagagcctaaaaaacttttaaaaaatttttaaaaaagcctattttagcctatctggcgttttgtcctaattgtttttataggtagtttgttttctttctcttcaaaaagcttttcttacaactctgataaaactagaccgaaatttgaaatatcagcgtaattaaaaatatatccatattttttctaattaatcatatgataattatccgtttttctaattttctttattttacttatgaatggacaaataattatatgtataaacaaacaaaaaatttaacacaggaaagatcattgatatgataatgctttcttaacactatatgaattaaaaggataaatagagctaaattcttttttatattaagcttgaggttaaggagataggtatttaaaatggcataagcttcttatttgttgacttagacattctccgtattgatgctgacaatttggtattccctcggacatttttctcatcgcattttccattgttttcttcttcagatgctgaaa

SEQ ID NO: 32957 - DNA, 970 bp, Heterodera glycines
cttcccggcaattcatggccgtaaaatgcgtttgaattttcaacttttgccatcgcatgcaacttgtgtttttattttcaacggcgtgttggcgttgtgaaataaatcagatactgtatccatttgcaattaggacaacccttttctatacaaaaaactgggtttacggtcatacagcgaccgccatcgcctttatagaaagtggccataaaatcagttcgtttaaagagagaactgcactttattctcatattagccgtcagatgcccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacgccgtgttggcgttgtgaaataaatcagatactgtatccttttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacgccgtgttggcgttgtgaaataaatcagatactgtatccttttgcaatttggacaacccttttctatacaaaaaactgggtttacggtcatacagcgaccgccatcgcctttatagaaagtggccataaaatcagttcgtttaaagagcgaactgcactttattctcatattagccgtcagaccccgacttagcttcaaaactggtaaagccacacattctcta

SEQ ID NO: 32958 - DNA, 690 bp, Heterodera glycines
gttttgacgagttaatcgcagtgggcaaaaagttgcgtcgaaagtggcccaatggaattggaagtgtccgcggcattggccgagttggacggactgattgaacttgttcaccaagttgacgagcaaattgaggctcaggagaaccgcctattttccatcaaaaagcaactcgcaaaaatggacgaacaggcgaaattggtcggcgagagaatgcgaacgttggaaaaacgggctgaaagaatgggcggaaagggcacggctgacccaactccgatcattgtgagtcgtccttctctaatcagtgaaataagcagtcgccaatcccttccgtattatttgtcgatttggtccaatcccttaaattttgtttaaagtctgatctcttaaattagtctgatcccttaaattaatctgatctcttaaattagtctgatcccttaaattttgtctaatcccttaaattaatctgatcccttaaattttgtctaatcccttaaattagtctagtctgatcccttaaattcagtctgatcccttaaattttgtctaatcccttaaactagtctgatcccttaaattttgtctaatcccttaaattagtctgatcccttaaatcagtctgatcccttaaattagtctgatcccttaaattatgtccaaccccttacaatagtctgatcccttaaattt

SEQ ID NO: 32959 - DNA, 929 bp, Heterodera glycines
ttccatatcgaaaatgattcatttccactttttccctttatttccctttcaattcgatggaatgtttcggtccgctggtgaaaagtccatttcattcattcattcgttacgttgtccattcattctcatattaatatttccgcttaatctgaactcgtttagctttgctttgctttgctttgcttccaaatgccattctctctgaaggctttgttcaaattcgccattttacaaaagaatttcatttaaacgactgacaaaactaacgactcacttttggaacattttaaaacaaattgatatttatttaacaataatatttataattggcaataaataatttttaatttttgcataatttctattcagtttaaatgtttttgatttttctgctcatcattttgctaacaattcttttatcggtgtttggacagaacatttcgggacaaggtcagtaaaactttattgaaaatataatttataaaaaaataataaatttaaatttaaaaattaaattattctttaataggaaaatcggaggaaaaattagattcaattaatgcaatgggaaaatttgacaaagttcggctgaatgaaaagaattatgggctcgttagaaacttgcacacgaattggtacgcgggtggcatcaaagcgattatgggcaaaatggggagagatttgttcagaaagttattgccgagtgagtgaaacactcaattattttcataattttacaatttaaatcaaagtaatttatttatttgacaatttaattcaacccttaattaaccctaattagcacagacgaacaaaaagtgatggccgattgtttgaatcaaattgaagacaggcgagatttggtgcaatcggccaaatgcctaacaaatttacgcagaatttatcttttgcggatcatcgcttcagct

SEQ ID NO: 32960 - DNA, 816 bp, Heterodera glycines
  misc_feature (755)..(755): n is a, c, g, or t
  misc_feature (762)..(762): n is a, c, g, or t
aaaaaaacataattcatacaaaaaataatacatatttaaaataatttattttactttaaaattatttacacagtacaataaagaaataaatatttccaaaaattaagtttgttgacacaaaaaagtatccgaatatattagtaatttggaaaaaattttaaacaataaatttattatcatagcatttctgcattaaaattttttgatttgctgaaggtttttagtgcatataaaagcatatttatgggttttggagaataaatgcatatttcggcatttttgcgttttagagcatattttcgtcattttttggaaattttcataagaaaaatgcaaaaaaaatgaaaaatacaccactaaggatcgacctttttgcgaattaaaaaaatatgccgttgaaaatcgaaaaattttgaatttttgtaagaactttcgaaattgcatatataaaattagaaaatcaaaattttttgcaattatctaaacgctccttagccattgttttttatgtttttatacacaattttggcatttattgagggttaaaagtcattttggttaattttttaaggcattttttagtgcatatttgggcattttggttaaacaataatcaaataaaattttgttcactttgatggtccgtttgtgagtcggcattccagatggagtttcgttgtgcaccgcctccatgttgaagtcggtgcggaaattgtacatctcctcgtttattgattatactttaagtttatganatggtanataaggatataaaaaaatatttgtattttaatactcattaatatattctctgcc

SEQ ID NO: 32961 - DNA, 127 bp, Heterodera glycines
cctttaattatttattatagtttcaattaggaattattatttggaattatctcggaattaatcttagtttagcagcctttgatgatttggcagatccaactaattgtttttaggtcaagggcaaaaa

SEQ ID NO: 32962 - DNA, 456 bp, Heterodera glycines
  misc_feature (62)..(62): n is a, c, g, or t
  misc_feature (94)..(94): n is a, c, g, or t
aaaaaattattttagcaataaataaattagctgactatttatatttctttaagtaaattatntagtcagggaggaatcaaaattaatttgcctnagtaaaaaaactcaaattaaaaaatttggtaaaaaagtcaaatttttaattttaatacgaaaattcgtttatttttcggctaaattcctataatttagaaattaacccaattttgctaaaaacaaccttccattactttgatatttgatgataaataggggatattatttatagttgataaaaactgctaaaacagttagttttggcggtacgacaattgcggattggcaattgcggaccggacaattgcggacgacaattttcggcccttccgtagacacatcaatcatccccttctatcacggtaaaaatgagttaaatattttaatataaaaatttcttgcaggctcattaattcataa

SEQ ID NO: 32963 - DNA, 849 bp, Heterodera glycines
taatcagtgccatcgatgctgctatcgtttgccgttcctccggcatcgctaacccggccacttgcagtgtttgtcgcagtttggcattttcacggcctaactcggcgtttttggcacgaagcgtgaaaatgtggtcgaccgcccggcgaagggtcgccgatttgctcagcttaaagtgaaaagaagtgtttaaaaaaagaagacaaacggcggactgacttttgtggcattttcttcggctgatagcatttcctaaagaatggatggaatttccgctgtgattatttaattcatttgctttgggtacggtacctttaactgattgatacggtcattaattgagcatcggtatttcttttcaatcaaattatgcgctgttcgtcgctccgttttttgtccttaattttttctctattattatccattctaattttggctttacttttcccacttttgtccccaattttagcattttccattgccccttccccccccccaaatttcggcacttttcttcccccctctcttttagcccccttcccattttggaaatttcctttgccccttgctttttggcactttcccttcccgttttatctcctcctatatttcggcattcttccttcctctttgcccaccacatttcggcatttttcttgccctctcttttcgcccctcttcgccctcttccccttttggcactttttcttcccccctctcttttagcccgcttccccttttggcactttttcttcccccctctcttttagcccgcttccccttttggaactttttcttgcctctctccccgcatttttgccactttccttttgtcccttgcttcccccc

SEQ ID NO: 32964 - DNA, 558 bp, Heterodera glycines
cataaatacaatttggggttttttaattaaatattttacgaaaatatttttattttttatcaatattttcaaaatatattggtaatttcaaaaatatcttttaacaattaaatgggtaaactttatttattatttttttattaagccaacctgattagaagatcaccgccaaaacatttaaaattggaaaaatttatagaaaatcccaacggttggaaaaattttttagaaaaaataagcttattaaaaggagcacaattctttacacaattgaaaaaaggaccaatggccacaaaactatacgacctgattttgctgatggatttatcaaaaaaatcttttcaaaaattagaaagccaattcttttcacgactttcggcccctttgggctgctgctctttgcccatcctccccattgtaattcaaatcctccaattctcatttgaatgcatataatatgtattatttatttgtcgccttccgtcggccgttcgttgcttttcctccctttcttttccccgcttcccccgtcggccctttttttggttacatttcgtc

SEQ ID NO: 32965 - DNA, 695 bp, Heterodera glycines
tttgtcataaaacagtgcaaaaccactgaccaaatttgtacatttggaaaatgttcggctggtactaaattttttctttgcttaaattaatgtctttattcgttaaggaaaacctttcgcttacagccttgtcatgctaccatgaaaaggcctatctcctgcgcgtcggctgtaagaattttgaaactaaacagaatgccgaactttcgcacttaaaattgaaatgggattgcaaatgcaaagcaggcaataccttgcaaaagttatctttcacaccaccacccacacaaggttgtttgtcgaaaagcattagtggtttcgcaactgaccaaatttgtacaagaggaaattgtttaagtggtaaatacaacattatgagtaagagatatgatttttagttttttccaatttttcctcggctcccaatggcctcaaacgcatcaaaaacaagttttttatatttgttaagctactagaaaaatcaccgctgaaatgaaaaattttctcaaaaattcagcatcaaatttatttatttatttccatgagaaaaaattttgatttttaaaacgttacttttttgaataggtttttcattttgcaacccataaactttaggcttttaatgcctatttcttttttagtgcaatttttaagaggttttttaacgatcgaaagccttgtcatggtaccatgac

SEQ ID NO: 32966 - DNA, 106 bp, Heterodera glycines
cggtacttgtgtggtttacctgacagatttcacgtacattttcagatgcatataaatgtgttttagaaattaatgaaaataggttttaaggggtttttgaggtcgc

SEQ ID NO: 32967 - DNA, 893 bp, Heterodera glycines
agttagtgaagaaagaaaagagagggggaggaaaggcacggcaccacgggggggggggaagacgcacaaaagagggcaaagtcaatggcacgcataaaaacgagaaaaatatgccaagaaatagggagagcgcgagagaaaaaaacggatgatttttctttgacttattaaaaattggcaaaataaattgcaaaataaaaaaagacaaaatccgtgttttctttatgaaagcgaaaatttgtgacattggcgaaaagaaaaccaaaaaataaaagtaaatgccattgttgggtaccaaaaatgccaaaagaaaacaaacgaattgaatattagtgaatgaaaggaaatggcaaaagtaagcattagccaaaagaaatttgaatgttttgttagtccgttaaacaagctttgctattgtctttttacctgacaaatattaaacatttcttattgttttttattatattcatagaaacattttacttaaaagctaaagggagaaaatcagaagtgaaagattggtggacgaagtcatttcagcacaaagcctaaattatatttaaattttatatatttttaaaaatcaattagttttcgaaatttgcgaaaattcaactgataatttttacggctattgttaaaattcgatcatcacgaatttgtcttcagtgttcggcataagacaagccccattcagaggtaattggcgggcacagaccaaaattttacattttagtggcttttcctttttccacgggaaaggttttttttcatattcaaaaaattttcaaaaaaactaagggttcggcggagtcgtaggcgacaacgaaattttaattggtgcgactttttgttaacagaatttaacaaaatgatcaatttcaattttataa

SEQ ID NO: 32968 - DNA, 805 bp, Heterodera glycines
aaaggattgtccttcaaatttatgcattaaaaatatttttgtgagtatttaattaaattttcgaattactcccgctcccgcccgggactcccgttaaaaatggacgggaatttctggaagcgggagttttacgggattccagctcccgctcccggaaaaacttgaactcccgctcccgtgaattattttttaccggtctctacttttaatgttttatatttatatgaaattttaatgttgtatagttgtgcagttgttcttatagaatgctgaatactcaaattgaaattcagcccactttcgggacggatcagcgaattaaaatatgaccattaaccacgttgaaattaaatttatttatcattattacattcaaaaaattaaatagattaattgtatgaaaattgaatgttatgaaaaaaattaatgaaaaattaaaaaattttaataagcaaactttgaaattataattttttaaaaagaaaacaaagtaaaaggctcgagactacgagtatgatgagacaaagggcactaccactgcaccactgaaatcacttaccttttaatatttttgacagaaatttcgaagtaaaaaatgtcggacgaattattgtccagcaaaatcggatgtttagcgaagatggaagaccaacaacattttgaaaaaatagatatgtaaatttttagaaaataccattaacatttcccttgttttggacaatgagatttttgtcgccaatgatttcaagtttctcatcacaattattgacatcccaataattctgttggaaatttaaaattgcct

SEQ ID NO: 32969 - DNA, 843 bp, Heterodera glycines
gctccctttcccctgcccttttttagcctttgtcccttcgtaatgccctccttgagagggttgttctgttggtgctgcgtgtcttcaattggttttatgccgtcgttgctgaagagcgaacgcttcgcacagcgaaaaacgcatcggccgccgtttcttccgccggtcttcgcgttttgtttaaaaagaaaactttgtcttttttcagagagtgctttttctacatttttgtcgcgtcaaatgtttttgggcccttcgcacgaaaaaaaatcgcaagagaaaagcgacgaaattggcattggcacagccgcggcacattcgccaaaggcaatgaccagaaaagataaaaataaaaaaatgttcctccattttgctttggttgactgatcagtctccgcattgatcagttccccctgatcagtctccgtccaaaccaacactttaaggtcgtcaatttctcgtttctcattggttccggcattaaaccttctcggccgacgagtttcacccattcggacactttaaattcgttggagccatcattaaaagcagcgtacaaagcttttattgtacgatgaattggtccaactttatggcattcattttgcctttaaaaggaacaactcaatccgaattcatttggccgctttttggagcctttggagtcggcgatttctgcgttttgcactcttttggaagtgaccaatttgacatttgttcggacttttcttgacgaacttttgctctaccaacggatgctggtacaaatcaatgccctcttcaattcatagacaaaataccattggcactttgactgttcatttcctttttgatcagattgac

SEQ ID NO: 32970 - DNA, 875 bp, Heterodera glycines
tcccgtgcccatcgatgcctcttcgggatctgttggctccgaatcggatggtcgcaaaaactttatttaaaaaaaacgattttggcattcaatttttgattttggcattttttacaaatgcttccaatgagcagttgcagtgccggatgacgaaaagtctcatcgtttgctcatcccatgggatcatgtccaagccgagcacccaaaagcccacaaaatctttgattttggcaccacttaatgccattttcttatactgcgcaacttttccatcttcaatgtcaatcccttcttctaaaatataaatgcattttaaaattaaatttaaaaataattttaaattatttttaccatcaattgtaatgtaagcagcaaaatggcttttgttgccgaaatgaatgttgaattggcgaaaaacatcgggcacaatgtaactaaattgcaatagcaaattttcgattatttataaaaactacagtttttcatcatcgtaatacggtagatcaaaattaccgaatttcaaaaaattacaatataaatggcaaattttaccttttctcgcagaatgatgtgtccaaaattgccgtgtttatcccagcactttgtctgttaagttttatgctaatgccatgccaagtgagttttgccattgaatttccatgctttttggctctgttttggcattcttcggcaattggattctaaaaaaaattttttaatttattttaatttaaaaatgccaaaaaattctttcacattgtccatgttgtcgatgttgaacatttcgttgcttaggtctacagtatcaactgaatgatcgttgtccaagactccggtggccattatgctcgggtagcaaatgatcagactgaaat

SEQ ID NO: 32971 - DNA, 724 bp, Heterodera glycines
gcctgaggtattttcaaaagatgagaaaattggaattgtaaaatgccaattgcctatcatcacatataaaatgggtgcgaaaatggtggacaaatgcaaatggaaaatcggaattggaaaagacaacgaaagcgaactgaacgaccatttgtcattggaacatttggcagagtttgagcagagactgaaggccaagcgcgagaaagaggtgagtaatgggaaaagcatttgggaggacaaaaagttaatttttaatgaattgggaattaattaacgaaaaaccaaccattggcatttgttatgggttttgtggaaccgtacttccattgctcaactcgcggtatcgccggcattcaaaaaggctcccggacatttggacagtggacacttcgacagtggacatttggcagttggacagaagcggacaactggacagtggacacttcgacagtgagtgtattttttttattattataaatggctttagcatcaatagaaaaaatatttttcaacattatttaagtaaatgaattttctttaaactgatcaagcattaacataggtaagtgattctttcgaaaactaagaatatttttactgtttattaatgagcgaggcgcttgtgaattgactattttgagcggagcaatataccaaatgccctaagaaaatatttttgtctttgctaaagccatttataataagtaaactaattcattcactg

SEQ ID NO: 32972 - DNA, 951 bp, Heterodera glycines
acatatcggttttggcctcgtcccccatttcctccgttcatcgcattaaattgttcgtcgatgtttcggaatcggctccccgttatttcttccggtgcgttcacatacggactgattgtgccgtcttttctgtgccattgcctttccctttcattcgcttttccatcgtttcgtccgtccattttaatgcgcgtcccttccggcggtggattaatgtctgcaattgttttaagcattttttgccttccattccatgctttttatgctctttccgtttgtcccattttacccgtgtcttcccttccatttgtctgttcgttttctctgtcgatggcttttaatgggccataatatcctggaattgttttttacgttctctctcgctttgttactcttcttaacttcgtccgtttgtcttcgagaactgttttccccagtcttctttgtattcgttcgtttgtcccgcatatttcgcctgaggccccatccgttcgccgtcaacggccggtcggatgtcttcgtgtaggaattcggacaaagggatgatatcaattactgacaattgtagttaaattcatgaaaaattattgatgccaattttatgtcacaaaaatctcgaaatatgaaaataaacaatgttaaaaaaaatgctaaaatatgtaagaaaaaatgtacaaaaatcccaaaatatgtactacaatatgtaaataaatttttctaaatggttaataaaattcctcttaaagggtgaaataagcacaaattgccattaaaataatctaaataggcttagagatcacttttagtattttaaaaattatttttgatatctcacttttggaaaagaaaacccgattttttcggtacccttttctaaaaaaaatttttaaatttttccacaagaaatttaatataaaaggggtcaaaaaatccacaaattggcaaaatatg

SEQ ID NO: 32973 - DNA, 109 bp, Heterodera glycines
ttgcggcaaccgaaaacacccgtatgccgccccatttgtagtcttcgcgtgcccccggcagactcaggcaaaagtccgctacctgcgcttcgctcatttttcccttaga

SEQ ID NO: 32974 - DNA, 275 bp, Heterodera glycines
aagtagttagccctgccacaccgtcgtagcgcgcgagattttcgcgcactagcgacagggtattgggcgtttttgcggcgcggatcaaagggtttcacgcgctgggcgtagggtttggggtgggtgtcggcgggatcaaagggggttggtcgggaccgtcgtagtgtgcgaaattttcgcgcactaagagttcgggagggtgtcggcgggggtcaaatggtttgggggattggtcgggaccgtcgtagtgcgcgaaattttcgcgaacatggggg

SEQ ID NO: 32975 - DNA, 1027 bp, Heterodera glycines
aaatatgcaatagttatgctctacataataaaagtggttttaaagtgattttgaatacttacagttcggaatgttcccttgtcagctcatcgtgactaatcgattggcatatcatttatgccatttttcaggggcgttcaactacaccgaattttttttatcccaactgaaagggtccgactaaaacactccgactgaactggccagactgaactgacccccaccgggcgaatgttgattttttagcacatataaatccaggccctggtcatttatttcttaattttttgcatttttgaccaaactattggcgttttcaccactggaactcaaatctctaatcgattcagattccttttggacgttggagccaatcccttcaaacgtgacgttaactcgtttgatgcatttcaaatggccgcgggttcatcggttgagtgccttaaaattcttttggaagcccatgaatgtgctctggacaagtaagtcatggaattcaacttcgacatctttggggccgaaattccgagtttcgaaaaatcttgggtgacagaatactgatttctgaaatttaaaaaaaaaaccgtagaaattttcttgttttttttttgccaattcagaatggtttcttttgtgtaaaataagtaatatagccactcaaattttcgaaatttttccaggaaggcaactaacggcaccgccggacttcccttgttcccaaaattttttttgatcgcgtttccttttattttttggttataaattttaactttagcctatcaaaatatgtagttttttcgaaaaatttacgacatttttggtgttgtcggaattccgattttaaaaattattggtcctcaggattccgattcccgaaaatttttggggcatccggaagtacctttatataaattagataaagcactaattgaagtgtcattttcagaaaactccagctgcttgaaatttccatgcagtccctggaaatccgaaagaaaaaggcaaatatagatttaaaaataaatat

SEQ ID NO: 32976 - DNA, 428 bp, Heterodera glycines
attcagcatttttcgagtatatttaagaatatattttttttcatcagttgtatttagcccagaatttaattatcataaatttagatttaaatctttgctttgataccaaggatactggcctcaatttccatcaatggaatttccacagttttcactgaagcaattgactaaaacaaaaataaatattagaaaaaaaggaataaatttaatttatatttttgtaccccaacgccaattaaagtgatgagatgggccacattgaaagtggccatgtcgaatttggcaattaaaaaatagggcaaacttttaaaattgttacttaaacaacaaatagctgaaattgccaagaaaataccatattttttaaatattacaactatttcttcgcaataaattaaattaattaaaaaataaataaataaaatttt

SEQ ID NO: 32977 - DNA, 954 bp, Heterodera glycines
tgccgtggcactcaaatcctcaatgaggcgagtgcttttggtataattaaaatgaaaataattaaatgaaataattttttagaagggatttggttggagaattgacaatcgttaatgatgtaaagcagcaattttttgagctcaacataatggaaggcagttttttaatttttattttaacataaatttcattgttagaaatcactattttgagcgtctaatacttttttttggagaattctttaataaaatccaataaaatactttcgaaaaatggttattttgggccgctatttaatttagttaaacttaatttatgggttttcgccattaaagtataattccaaagtgtcacattttctaaaaattccgattatgtttttaaaatctgataaaaataaaagatataaaaacaaaaaaaaaacattttcgtcatttgtttagccttgcttaccaattatgcactgcccgcttctgttgcggttgattcgattccatttggcacatttattaacgaattcgatagcatagcatttgccatcattgccatggaacttggccaggccattaaggaaaatgaggagggcatgaaaatgtgcaaaattacggtgggatttaattgattttatcgaaatatttgtttcgggaaagcaaattttttgaaaaattgtttatttggtcttaaaaatctgatgcatctattagtgggagtaattaccggttcggattttttaatggaaattatggaaaatttccgatttttcaaaaattgtgtttcattgtaaaaatgaccatttttcataaaaaaatatattggttaatggaggtccaaatcttttaccctttaaaatttgggaaaaaacatagcaaaaatatgtgaaattttaatgattttagataaatgaagaacctttttggtaaaatgaaaatttaaaaactaagtaatttcatgtt

SEQ ID NO: 32978 - DNA, 555 bp, Heterodera glycines
aactggcgtgctggcgcgtttgttaaaactgccagcgcgtttgttaaaactgccagaacgataaaaatataatttatatattttacattttaaaatattaattttaattaatattatatttaagactgacgtattataataaaagaatatgaaaatatttgccaacattaaattatagccaaagcgaaaatatttaatatttctgaagaagacatgtaagcattaattaatcgtaatattagttaaaaatggaagtatttttgaaggtggctacgatttagagataaaatcattggtggtgtaagtataatataaatcaatactgagttaatacgctgattttagcgttatttggccagcaatatatatattaagagaacatctagaaaaaagaatcacacccgcaacaggggcacacgaaactgaaaaatggatgggtaatttagaattagcggcagtcaacaaaatctttccaaataaatataattgtgtgtgaataactaacaggaagaaatttaccggtggcaaagtgtattccccaaatttggaaacatc

SEQ ID NO: 32979 - DNA, 743 bp, Heterodera glycines
ttattcatcattcaattcttctcccaatgtttcttcgatttgaaaatgatctgacgattaattttcaatatttttgaaattttctcgtcacttatttttgggttttgtcctttcatttagcaaataaatgttcacttttgccattttttctttctccgacattctttcgcccattccaaattgtttcttccatttttgaattgttccataatttactccaattttcttcacaatttctgcataatttttgtcccattcttttgtcgaatattttctccctttttgtttgtactcatttttcattgccataaatttttgaacaatttcaattttttgtgcatccgttttcaatttgcattggtatttgtataatcccaattctttgatccatttgtaaattttctttcgatttgtccccaattttttcgctattttctgttcaattgtattccattcttttgttgaatattttcttcctttttgcttgattttcgctttaattttgatgaatttttcaacaatttctctcttttgctgttcacttttctttttcttcccatttttctccaaatatttcttcaaatgttttttgctccaattttttcttttcacctccaatttcaatgataataattaaaaatacaattgaaaaggataatagacatatttttcattgctgaatttccttttaaaaaataaaatttatattttattcgatatgaaataaaatataaataataata

SEQ ID NO: 32980 - DNA, 658 bp, Heterodera glycines
cataacttttttcttacttggtcaatcaatacctacattcttgatatcaaacgaaaacttgaagtctatagaatttttagacttaattctggtctaaaagcaacaacacaaaaaattattcttgaatataatcttaaaaagctatttttcgtgttttctccttgtaattttttcattatcatcagtatttgatcttttcttacatttatgaatctctgagactttaagctttcgtctgataccaagaatgtaggtattgaccaagtaagaaaaaaattatattggatttaaggatttataagctggctaaaaatatgttttcgtgaaattctcatagaaacaaagccgtagaaaagcaaacaaaaactcctaagaagccgggcccttctcataacaattttactttgaattttaaagtgcaaattttaaagggcacattatccccaatatctgctgaccatgggttttcatttttgttttgatttaagcattattaaattagtggcgggcgacacggcgccacgtgaaaaaaaggagggggggggggggtgtttgtgagaatacggggagagacttctgttgttgttgctgctgctgttgatgaagcccctacataatctcattataagcaatataaatattatgtacacgccgaggg

SEQ ID NO: 32981 - DNA, 815 bp, Heterodera glycines
tgtactttaattctgcgttggatttttgctccccataattttttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagctttcctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaa

SEQ ID NO: 32982 - DNA, 1182 bp, Heterodera glycines
  misc_feature (13)..(13): n is a, c, g, or t
  misc_feature (108)..(108): n is a, c, g, or t
  misc_feature (117)..(118): n is a, c, g, or t
  misc_feature (131)..(131): n is a, c, g, or t
  misc_feature (214)..(214): n is a, c, g, or t
  misc_feature (217)..(217): n is a, c, g, or t
  misc_feature (240)..(240): n is a, c, g, or t
gagcaaaaatgtntagtatttgaaaggctatccaaccaagttttaaaattcgaaaatttcaaaattttcgagctaggcctaaaaatcggttttcgggtttttgaattntaggatttnntaacgatttttcncagagaaacgaagaccacttccaaaacatagtttttcgagctctatcgattggtaattttttgggaaaaattcgaatttttcncgngaaatagaaaaaattttggcctngagcgggacatttgagtcccgggcctataactcgtcagggatcggttttagccaaaaattgccttagagtaaaattgtagagcattttaaatgctatcgaatggtgtactacatgatgtaaaattttcaaaaattttcgagctaggccccctagaaattttcaaaaatttttttggggtcgaaaaagggggtgaaaaatttttttctggggtattttggggtgctgaatacgaatatgatgtttattttaagtttcggaaattttagaattttttaaaaattctttattttttggcaattttttggcccttggaaatttgggctaatattggaaaattcatatctagcctaagggttgaccaattttgagcaaataaagctttaaaaatagagaaaaatcaggagaattttatgggatttatttggttttataatgttcaaaagaaaaaaagttattccagaatttctggaaattttcgatttttcagaaaaaaattcataactcgcttctgaaaagttattttggaaaagtaaaataatacaaaaatccgcaattttttgctctattttataaattttattttagctttttatcacttttttgaaaaaagttatagaaataaaagtgattttgggaatcgggaccaaatttgaccatgatttctgagtgaaaaaattttttcgacaaaaatcttccaaaaacatgtctttaggggttatttgggccgctgatcacgaatatgtaatcagattttactttagacatggttaagacctcaaaatcactgtgtgattggagattctgaggggtgggagcgcccgtcctgaggacgcgaagcggccttaatagcccaacaaatttagaaacgggcgcgaagcgcccgtctgaggccgcgaagcggcctcaatagcccaacaaatttagaaacgggcgcgaagcgc

SEQ ID NO: 32983 - DNA, 1084 bp, Heterodera glycines
aaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcgggggactgccccgaaaacaaaaaaatcgattttttcaagtgtccgtttggggtactcaaacaattatggggagcaaaaatccaacgcagaattaaagtacaggctatagggaagctattcccgaagggattcggtctccccataaatctgggcgcatcgggttcggggggactgccccgaaaacaaaaaaatcgattttttccagtgtcccgtttggggtactcaaacaattatgggggagcaaaaaatccaaccgcaaaatttaaa

SEQ ID NO: 32984 - DNA, 448 bp, Heterodera glycines
tgtaaaataaccaatttaaaagaaacaattaacattcttttactcattaaaatgtaatttttgcattttagcaaaattcatactacctcggtttggcacacacaaagcgaatgcagcatataacgatgattaatttaataattaaattatttacccaattaaattaaagcttttcacattgcccggagttgttgaacgcttctttccccgtcctgaagaagctcacatggtcaaagccgtcagagaagtgctcacaaaaagttggagcatcggagaaggggacgaagaagcggaggaaataataaaagtgagtgaataatttgaaaattaaattaattaaaaaattgaaattagaaagtgaaaatgaacccggaaaaatatgtgatgaaatggaacgaatgtggagcttccatggagggcaaaaaaattttctttggtgatgaaataa

SEQ ID NO: 32985 - DNA, 858 bp, Heterodera glycines
  misc_feature (82)..(82): n is a, c, g, or t
  misc_feature (88)..(88): n is a, c, g, or t
acagacacatttctaaattctaattagtatgtagtccaagcctattattatttttttgactagtctctgaatggggttatcncagttntagtatcctttttgaaaaacaaaaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggcacttgcatccgatgcagctgttcacgggctctctaaacctatttttattttttttctatctcttctctgaatggagttataacaatttttcacaacagttttgcatttaacagacacattctaaaatttctaattagtatggtagtccaagcctattattattttttttgactagtctctgaatgggttatcccagttttagtatcctttttgaaaaacaacaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggtacttgcatccgattcagctgttcatgggctctctaaacctatttttttttttctatctcttctctgaatggagttataacaatttttcacaacagttttgcatttaacagacacattctaaaaattctaattagtatggtagtccaagcctattattattttttttgactagtctctgaatgggttatccccagttttagtatccttttgaaaaa

SEQ ID NO: 32986 - DNA, 727 bp, Heterodera glycines
tttccccactcatttccaagtcctcctgcagcattcctccgcccgtcccttccgcttcattctctgcttctgccgcgcctcctccgtctcccgcttctgtcaaatggacaatgaatgatcagtgatcgtttgtttccctctctcttttccgatttgtctcaccaattttctcctcctcatttgtgctcactgtcaatgccttttgaatgttcgtctccaactcggccaaatgcctttgcgagttgttcagcagttggttggtcagctccacaatttcttcggctttcaatgagtaggcggactggggaccgttgaagatgcgactgttgatcagaatctgatgaagatcggagaaatggatcattcctccttcctttttttgattagcccttttcacctgatcaatgtctcttctgaaggcggcaatcgttgtgtagcggtggtctttgatgttttgttcctgaaaaacagcacaacaatacaagcagagacagcaaattttaatagtgtttaattaattgactatgcgaatgtgctacaataacaccaacacttacaattgtccccaagtccatcggtcgctgaattttgtcgttgtaatgagggaactaaatgaatgaaacaacgaaattgtaaaatacagcaaataatggattgctgttggtaccacctttttgaggtcaactcgggcatgaaaagcggctgatttgggcaagtttttgcactc

SEQ ID NO: 32987 - DNA, 661 bp, Heterodera glycines
cagatttgaggttttatcctcattttgtgctttttgataggtcaatgaggatttttttgttgaaagaggatttgaggatttttgtgactttttgagaaattttgaggatttttgaagctttttgagaaaattgttaaaatctgttaaattttatgaataattttgataaatttttctaatgtttgaaatttaccgtatttgctcttttaatccccccccccctaaagtgctgttcgagactctcggtctcgactcgagaaaagtctcgggtttttaagtctcggtctcgattttcgagactcgagaccgagaccgagacttttttacactcctaatgattggattttggtaaacttatatttttataaattttaggccattttttgttcattttgttaacatatgctttgtctagtgggttgtgctctttgttatgttcttcgttttttcgttggatcagttccccttgaagttgttcacttttcttctaatttttcaaaattattcctttttccgatgagaatttaatcacaactttaacaattaaaagcgtaaatattgtcatttttggactaaataagttaataaattgcactaaaaattcaaaactttctccggcggcgcctattggcaccgccggcacacatttttcaatgaaaat

SEQ ID NO: 32988 - DNA, 217 bp, Heterodera glycines
aaagagtgattagtgaaaatgaatgaatagggggaatatttttgttggcattttcattgaatcatcagcttttaatattgatgaaatttaaaaatttttattttattataataccaatattactacttctcgaaaaggcaaatttcatacaaattacaaccaaaaataattagataatttgaaaaaattatttttcattattacataaaagcaggag

SEQ ID NO: 32989 - DNA, 780 bp, Heterodera glycines
atagggcggcgcaagtgtcgaggcgcaaatgtcggtacatcattttatttacgtatgaatctgacggatggcaaagagagcaattaaaatcataagaaggactgaatgatactttaaaaattcaaatgccattaatgtgaagaatgaatacaaattcttgccccattagagccaattagtgaaactgattttgttctactgtttttgtactaaccgatgatgcctgtttgatgaaggaaattgcgtaacagcgaattgatggatttgggtggcaaaattcaaaagcgtttaatttattaatgataatcagggcccggattttgaggtgctaaaaatcccgaaataggtacctaaatagttgctaaaactaaaaatgccaaatcgttgctaaaatagttgccaaaaaattggaaaataattgctcaaaaatgctaaaatttctaaaaaaaattcacaagccaaaatagttgctaaaaagtccctctaaatcgacccgaaatcatatgcacatgcatatattttacggatatattaaaaagtcgaaatgcccattattgtgaaggggatatttatttatttatttaattttttgattacaatttcttttccttttttgaatgtttttttcacttttacggcattgttttgttgttgttcttttaattggttgttcattagtttaatgacttgtaaatttcaatggcacgcacaaagcaaaaacaaaaaacatttggccaccaaatgacaaattaattaaatgcgcacaggcaaaagtacaaa

SEQ ID NO: 32990 - DNA, 700 bp, Heterodera glycines
aatcgctgacaaagttcaaggatttgctcgcccaaacccgctcagtttgcgtccgccgcttcgaatgatctctaattcgacaaaagacgagccaagagatcacatccctggaggcacacttcaacgccgcttgtgaaaatgccgagctcaccattgacaaaggagcggctaaagggcgtcatcctctggattgcacttatcgacgagcaccacgatttgcggcaaaggagcctaaaaatgctcgaagaagcacagagaagcggcacgcaaatcacgctcaagcaaattgaagaggagttaaggaccattcaattggtaaaagacagcgcactcacattggcttcacctcctgttgcaacgcatgccattcacacccggccacaacagtggaggcacccaaaaggcaaaccaccgcaacaacccaagaggaccaacaatgccaaggagcaacccgcgcgtccaccaaacaccaattacggcaaggcaagccgcggatcaccaactcatccatgcggctcatgtggagaatcggatcattggcgtacggattgccgattcaaggacgccacatgccataaatgccaaggacaagggcacattgcaaaggcatgccgacgcagctccaaccaagcggaaaatcgcagagaaggatccgcccacactggccgtggcaaatccccctgcatgggaattggaaccg

SEQ ID NO: 32991 - DNA, 569 bp, Heterodera glycines
atccttagggttagaggcaataaatccgtagtaaacctcactgggagatattaataatccttatttgtcagggttgccgttaaaaattccgtaaccccaaaaaaatccgtaacttttacggctagggggtgagggggaggggtaaaatttccataaatctttaggggttaggggctaaaagaattagctaatggtaaaattcataaattccccagttttgcccaaggctaaaattgtaaaataaaaattttgagctaaaaattttttgaaaaaattatttaaaaatgaaaattgtggcaattggctgtgctccgaccagcatcggatttgcttatcgccttcagcagctgaaagccgacggaattgaagaggcggcggacattgaacttttggtgttggagcaaaatccgacgcccggaggcctttcatgcacagtttggcacataaatacaaaaataaataaataaatttaattattttaaaatttattattttttaatattgggggaaattttaattaattattaaattgaaaaatttgaagaatttcattatacaaaaaagaataa

SEQ ID NO: 32992 - DNA, 1013 bp, Heterodera glycines
ttgcttctttcatttacatgcatttaattagttttgctttttgtgaattttatagcggaaatgattgtcaagttttttagattttgtatagttaatttgccaaaactttgaaattggggggtctattttttaaaatttttggtgaaaatcgaaaaagcactggtaaatatgggaaaaatggagttctgctgaattttttttaaatcgaaaatttctgggaaaactttcatctttatgtcagaaaaaccaaataaaaaacataaaaaattagcttaaatttccgggactcaaaaaatgaaaaatttataatgtttttgaattttttcgtgggtccaaggcagcaaaagtgccagaaattctccaaaatcataaacccctccctttcggcgaagagatcagagaccattattttcgtaaattgaccaaatccagtaaattgtgtacagttttatacaacactggcagcaaaatgtaataatgagtataaatgttatacatacagtatgttatacaattcaatacacaaatatgcatacgatcaaataccaaagcacatcggcaaatttacaatgaatatatttcttccgcttggattgcgcatgacttccttctcatccctcctcattcgttggccatcagttcggcgagcagtttgggcctagaaattgttgaaaattaaaatttcaaaaaaatttcctcaaaaactctacccaatgtcgctgtcttgaatgttgatgcacagcatagtgtccaacgtatggtttgcgtcccactcccacttcgccactgtgcgccgatccgtgccgctccgctggcgtacaaccacagcctccacgggcacacgccaacgcagcgtcagccactcgcccgtccgttcattctcccgctcaacgacctcgatgttgcgacgcgatgcccgatgacaaacgacgacgtagttgaccgcaatggcactcggcgcttcgaatactggaaaaattgaaaaattacaacaaaaaaaaaaatggaatcgg

SEQ ID NO: 32993 - DNA, 959 bp, Heterodera glycines
ccagtctctcctcccttctcttttcccctcttcctcccttcccctcttcctcatccagtctcccctcccttctcttttcccctcttcctccctccccctcttcctcatccagtctccactcgtctctctctctttctccacttcttcctctccccctcttcctcatccagtctccactcctctctctctctttctccacttcttcctctccccctcttcctcatccagtctcccccccccctctctttccttcttcctctctctctttttctctttctctccacctcttccttcctctcgtcttctgcattctttctcacacattctctcttccctcattctcatccaattgccctctctttgtgccctcctctctattcgttcctctcgtcttctgcactctctcctcttcttcctctcattgaccctcccccgtacagtcatttgctccttccgcacaatttgctttttgttttgtgccatttctgttgctgctgttgatgggctttccctccgccgctgacattaatgttaaaaacgaaaatgccttgatttttataataattcacaaaatttataaaattttgcttataactagggataacatttataattttttcactatttttttcctgagctccccgtagcctgaaatgcacgaaaaacatggttttttcggctgtcgttaagctacttttcgagttattagcaattattttattaatcgctttaatttcctttggcttcggctttgcaggttggatactgaaaatttgatattttttaacctgtgttctcaatactgttcactggaatcgctgacaatttttatctgaatcactttcacagctgtcaagtttttaaaatccctttcaaaaatggtaaaaataaaataaaaattaaacttcgcagtcgcaggtttatttttagcaataaaaaaaaataaaatttttgaaaaa

SEQ ID NO: 32994 - DNA, 954 bp, Heterodera glycines
tttctattggaatattttaagcgacgtaccgtaaatcatttcgactgtggactaccaaataaaatgaccgctaaggagaaatattcgaaaatattttttgaactctcaaatttattgaatcttcagttttctattgggatattttaggcgacgtaccgtaaataattccgactgtggactaccaaataaaatgaccgctaaggagaaatatttgaaaatatttcttgaaccctcaaatttatgaatcttcagttttctattggaatattttaggcgacgtaccgtaaataattccgactgtggactaccaaataaaatgaccgctaaggagaaatatttgaaaatatttcttgaaccctcaaatttatgaatcttcagttttctattggaatattttaggcgacgtaccgtgaataattccgactgtggactaccaaataaaatgaccgctaaggagaaatattcgaaaatattttttgaactctcaaatttattgaatcttcagttttctattgggatattttaggcgacgtaccgtaaataattccgactgtggactaccaaataaaatgagcgctaaggataaatattcgaaaatattttttgaactctcaaatttattgaatcttcagttttctattgggatattttaggcgacgtaccgtaaataattccgactgtggactactaaataaaatgaccgcaaaggagaaatgttcgaaaatattttttgaactctcaaatttattgaatgttcaattttctattggaatattttaggcgacgtaccgtaaataattccgactgtggactaccaaataaaatgagcgctaaggataaatattcgaaaatattttttgaactctcaaatttatagaatcttcagttttctattgagatattttaggcgacgtaccgtaaataattccgactgtggactaccaaataaaatga

SEQ ID NO: 32995 - DNA, 996 bp, Heterodera glycines
  misc_feature (861)..(861): n is a, c, g, or t
  misc_feature (927)..(927): n is a, c, g, or t
  misc_feature (931)..(931): n is a, c, g, or t
  misc_feature (933)..(934): n is a, c, g, or t
cttccctatgactcgccatggacatggattctttgttttcttactcaggtaaaaataaataaatcatttttagacatttctgtgtataatctgattatcctccttattaggaccttgcctattattttggccaccgtgccatccacggttagtttttgtgtcgggcgccagagggattgtgccaatcaaaagggtggttccaaattccggaaaatcgaagattttttgcacgaaaatctgtgttccggaaattttttgagcgcctacggtatcccgtattctggaattttttggcctccagaaccgcgcctggtgccaatcagggatggaacataattcctaattccgttcggcttccgattttcgaaattttaccatcggaattccgagcaattttgtgtaaatttttcggcttccgatttttagagatttcacaatcggaatttcgaaagaatttgtgtgaaaataattacttttttacaccactttttaactggacagagatcggcttcttttggggtgttcacacaattcaccactccagcgagtatttcaactattccacttcgtttcgccaagctgctattcaggtggagcaattttgaaatttaaaaaaatatttttcttgaaaatttcatttaaatgggattttccataaaaattgaaaaatatttttttgggggggtgtcgcattttcctggagcaaattaccctttttacttataatactggcaaaaactaattaaaattcttttgttaggacgcaggactggctgctcacgacattttgcaggtcgaaaattgggaaaaataaaaaaaaacatttaaaattgattaataattgattaaaattcacaatanaattcaactttttctggctttatccccatcgggactgatcacaaatctcgggcattttcgttcccnattntnngcttttccgatgaacgaaaacgaaattaaaaatgtcgaaaaaaaggggatgaaactaaaatg

SEQ ID NO: 32996 - DNA, 914 bp, Heterodera glycines
  misc_feature (12)..(12): n is a, c, g, or t
attctcctgttncatatttggaagtgaaaaaattctattctaggcaatttaattcctatcaggtgagcaacaattacgaatttttttgcattgattcgctcggttttcaaattgtaatgaagggattgaattctcaccaaattctcctgttcatatttgcaagtgaaaaaattctattcaaggcaatttaattcctatcaggtgagcaacaattacgaatttttttgcattgattcgctcgggtttcaaattgtaatgaagggattgaattctcaccaaattctcctgttcatatttggaagtgaaaaaattctattcaaggcaatttaattcctatcagttgagcaacaattacgaattttttgtaatgattcgttcggttttcaaattgtaatgaagggattgaattctcaccaaattctcctgttcatatttggaagtgaaaaaattctattcaaggcaatttaattcctatcaggtgagcaacaattacgaatttttttgcattgattcgctcggttttcaaattgtaatgaagggattgaattctcaccaaattctcctgttcatatttggaagtgaaaaaattctattcaaggcaatttaattcctatcaggtgagcaacaattacgaatttttttgcattgattcgctcggttttcaaattgtaatgaagggattgaattctcaccaaattctcctgttcatatttgcaagtgaaaaaattctattcaaggcaatttaattcctatcaggtgagcaacaattacgaatttttttgcattgattcgctcgggtttcaattgtaatgaagggattgaattctcaccaaattctcctgttcatatttggaagtgaaaaaattctattcaaggcaatttaattcctatcagttgagcaacaattacgaatt

SEQ ID NO: 32997 - DNA, 643 bp, Heterodera glycines
  misc_feature (556)..(556): n is a, c, g, or t
caaagaacagaccccgaagggtttcttcgagaatatgggcttgcagaaaacgccggacggcgcttcgctcggcgaatttgcagtgatgcgaatggacgacatgatgaacttgatcgggcgtggctctctttggttagctaacatttctttcttgcgatgcattaaacgaatgttttgtagtcaatggttaaagacaccgacgataatcccttccccactttttaagccgaaaaatttattttaaaaagttgtaaaaacatgttttttgtgagtcactgattgcgaagatatgtcattcattttggcatatttcggatctaaattctagcaagaacacatgcgaaaactctaactttttaatggggaaacaataaaactggacatcgaaatgctttatttacccaaattgacaaaactttcctttttgcattattatgccatttagcggtaaccaaattcagatgcatttcaccgctcctcgttgatatttgaaacaagagcatttctttaggggtttgaaaagtaattaactaatggtgcgatttgacgaattttnattccccctggagtgttttggaaattggccaatttgcctctcttgactcataatttggacccctttttcattcgttttggtcttata

SEQ ID NO: 32998 - DNA, 836 bp, Heterodera glycines
ttttgcaaaatgtaccaggatttgaacctgaaaaaccgcttggttaaatgcagaaagccaaccaaggtgccgaatttataccttgaattcggatcctgatccatgtatcacaataccggagttgaatccaaaaataatcaatagaatatcaatccaaaaattcgtcccagtccaagtgagtctatgtcctacttcctactgattaaaggccatgtaaccgaatcagaatccaaaaaatctgacaatgagccttatcaatccagaaatccgccggttttcgaaaccgtttttttaattccggccaatctgttccgctatttctccctcactcttctgtcgatgtcgttggccccagcattttctgctgttgctgctgctgccgtttcagctgctttctacggtcactcatccgtgccaattggcgcaatgccggcgtgccggcctccatcaaatacaatgcccggtgccattggctgagctgttgggcgccaaagcaacgggacaaaaagaaacagttgcgacggcgccattcactgttttaaacaaacgaaacattattgtggatgggatgaaactaaatacccaatatttcaaaaaaaaaagaaaaaaatgaaaattacataaataacaaatggccaaaattcttttggtcttcgtaggccgatttaagcaaatccatttgagcggaattggcggaacatttgcgcgcaaaatgcttgaacagaagccaatgggcgcgcaaagtcaacagggaatgtttgcaacactaaaattggaacaacaatttataagcggttggccgatttctgcgattttaaccaattttctgaggaaat

SEQ ID NO: 32999 - DNA, 295 bp, Heterodera glycines
ccaaaatttatgtcaacttttgaaatcttaggggaattttatggcacggcggcaccgataggcgccgatgtgaaaattttttgggattttcatgaattttgttaaaaaaatgtttaaaattaaataatttttcttcttttctccctttgccgccgacccactccccgaaatggtcatccttaacagtgtaaaaatttctcggtttctgagactataaacccgagaccgggaagcgaaaaacccgagaaatttcccgagtcgggaaccgataaccgagatactcgcacatccctaa

SEQ ID NO: 33000 - DNA, 973 bp, Heterodera glycines
  misc_feature (12)..(13): n is a, c, g, or t
tctagagtcatnntttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaactctcttccttaataattttcatgcaccgaggtactcactcggccgcttcgcggcctcgtggtgggccttcgccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaatttcaaaaactttaaaaaattcatagaaaattaaattcataggtactactgctaaat

SEQ ID NO: 33001 - DNA, 922 bp, Heterodera glycines
tccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacatactatagggaagctattccggactgccccaaatctgggcgcatgggggaccgaaaacaaaaaaatcgattttttcaagtgtccgtttggggtactcaaacaattatggggagcaaatcctacgcagaattaaagtacaggctatagggaagctattcccgaaggattcggtctccccataaatctaggcgcatctgctcggggggactgccccgaaaacaaaaaaatcgattttttcaagtgtccgttgggggactccaagaattatggggaagaaaaatcctacgctcgaattaaagtacagactataaggaagctattccggaaggattctgtctccccataaatctgggcgcatcagttcggggggactgccccgaaaaccaaaaaatcgattttttcaagtggccgtttggggtgctcaaacaattatggggaacaaaaatccaacccagaattaaagtactgactattgggaagctattccggaaggattccgcccccccataaatctgggggccttccgtttggggggggactgcccccaaaaaacaaaaaaaaaccattttttt

SEQ ID NO: 33002 - DNA, 871 bp, Heterodera glycines
ccatcaattatgtttgttgtttttttttgcccgaggcaaaatgtcgctaattactccaactgttagcgcaaaatgtaattttggataagcgaagaattagcttactcaaagtcagcacctgcaaagataattgttatacttttggtagctttattctactcaaatattcacaaaatttattcgccaaacttttttacaaatttgagcggctattaagtttaacaaatattttggcaattttattacttatcgccagaaatttttaatttttttcaaagcaaatgtcacactgttaaataagtattttaaaattaatgaatcatagaaaaaccaaataatggagaattatttaacattaaaaaataataattaaagatcaaaaagaattaattgtttatgcatagcatgcgtttttcacgcgctcagcgcgaccgcctggcaccaaatgcgttctttgaccaagttacagtaaccgtcgccggatgagctgaagtgcactttgttggtgccagttttgtcctcatcagctgccgaacaggtgaccaggaacttctgattggcatagcggcggtacaaagcagtttgaatggcattgaccgagccaatggcatcgtcggtgcggatgctctacaaaattagcaagcaattagggatatgccaatgattggataagtgatcagtttgccaacctcgtcaatgacttgtctccactctgtctgtgggcacggcgtttcgtccgatttgaagtggggctgaaccgcttctaatgccgctgtctcgcgcttcttccggtcacagcaaccgcctccgcctccgccaccaccgcaaccacaaccgcctcctcctcctcctcctgagccacaattgacga

SEQ ID NO: 33003 - DNA, 1012 bp, Heterodera glycines
attccaaccaaatttctcaaaaattactaaataaaaatcgtaaaatatttttcccctgaaaatagttatggcaaaaattctctattctaggcaaaaaaggtctcgtttttctctgcactccatttatttgttcatctcgtttttcgaaactatactattaaaaagtcaatacctgaagcttctgcacgccaaatgcaacaggtaaaatctttgaagcgccccaaacgaggccgtcgcattggacggaacgaactttcgcctcaatctctttgatgtcaattgtgtcgtcccatggcttcacgtcgtaaataacgttggatttggcgaccggcccgggcttcttcgcctttttctccgcataagccttcaggcgctccttagtgatgcgctttttttcctcgtcgtcgctttcctcatctccgaagaggtcgaagtcctcctaaaaagatgagatgagaaccaaaagtaaaatgactctctccaaacctcggcttcaactttctttgccggagtctctttggaagcgacagtctgtgttgtttgtccagctttctttgaccaacttaaaagcacggtcccaaatttttgcaaaacccatcactattattgtcacatggtaaatggaaaaattttggaaatggcaaaaaagggaatagctgtagaaagaattttatttcatttaatttagggactcaaaagacaccaaaaattttacttcaaacgttcaacatcatcgaagctttgaatgtgcttgtaccaacgagcaacgtgcgcatattctttctcggaaggaacagacttgatacttttaaatacgtattggtcttcttgtgacggaaggaaactgaattttaatttttacataatattgaatattaatgtaacccgtggagataagcacgagtcgacaggcaattattgagctcatttaattctttgctgacagtcatcgtcccgatgtgagcttattgtgagcattcatgatagaaaatgaagtggtgcacatgctatt

SEQ ID NO: 33004 - DNA, 853 bp, Heterodera glycines
tgcgcaaaaagaatgccggcatggacaagcgctcgctttgacggccattgtcactgtccatgtcgatggtcaactcactcactggcctatcggtcagattgccgagctcaaaagtgcgagtgcgacggtagttcaactgtgacagtaaagtatttcaggatatagtttttgcataattaatatacaaaaaggaaatagatttggtacttttcggtttcgtgtatacacctcaaaattttcaaaaatatgccaacaaaagatgcactgagttttttggtcgcacaaatgaataatttgccacaagaatacatgaggtttttgcaattttaagggtaaattattccatttgtgcgatcaaaaaataaaattttttgagagtccaagatcccgaggccttttttgagtagtaagcttttttagacctttggttatcccattgtatgaatcaccataacccaaaacagacgaaacctcgacgcgaacatctttgatcaccgtttcgacctcggaccagtccttgggagtgaagtcgcgcatcgacggacgcccgcctttgcgacgctgcggcagtatttccatgacagtgtccaccaaattctttgactcgaagaacgccgcaactttggctaaaaatggttgtggtttggctttagtttatcattgtcagcacccgcgacacttcccgaaacttactgtccaacaccacagccgccttcggcgttctgtcgtcattgcgaaccacacgaacacccttagcaatgccggaacgcaaaatcatcccattggacaccttctcgcggaacaaagtcggatttcgagcgtcgtcaatttctgtgaatcgaatattctatga

SEQ ID NO: 33005 - DNA, 915 bp, Heterodera glycines
  misc_feature (15)..(15): n is a, c, g, or t
atatatttaaatttntcgtttacaaagagatatgtagaaccaaaattttccctctttgtttgcttttttccactaaaaaatcgttaataaaaatttttatttacctattttggtacctattttggaatttttgtacctatttaatacctattttgagattttttttaacctatttaagtacctattctgggatttttcttacctaaaaatcgcatccctagtaattacatttcgattagcgctttcatttacaaacaccagaagatacaggatggatttgggatattattttttttgaaatttaccaatttaaccattggttacaactttgaaaagtaacgaatcccccccccccctttaattccgttttttctattataatataatttatattgtatgaaattgcccgtcatgaacagctcctccgtcaactttttgcccaactcttttcttttctccgcctcaaattcaaaagtgccgtagtccgaataattttcggcgaccattttctgcaaatgttcgccgagcgttctcataacccattgaatttgctcagcattaaaatttccccttggaacaaatggaaaattgtgaagaacggcaaaataaaccacaaaatttgtggccataaaatggaaagtcatttttgggacggtgccgtcggattcaaattgcaaaagttgcactctctgatcctaaattagtcatacaataattaattacaaaaataatttgccctgcaaagaatgcaaaagagggaaaagtcccggcacatttctcttccctcaaaattgcactgataaaagccgcgaatttttgtgctgaggtcgaaaccgtcggggaccatacaaattggcttcagagattcgttagttgcttttaaaaatacgaaatcggcatttggaagcgaacttc

SEQ ID NO: 33006 - DNA, 648 bp, Heterodera glycines
cccccccccccccccctccattttgatgatgataatccgccgttggttgccaacccgcctccctcgcgttccaatccaaccaatttcacacattgtgtgagcctcgttaatcataggggcgctttgatgctttgtggaagggcccggagggaaaagtgggcgaggcgcaaaatgtggaggagcatttatttggaggacaaatggacggagggggggggggaggaggggaagcgcgagaacaaatgccaaattgagtcaaagagaggggggaggggaggaaaaatttcactgacagtgccaaagtttatttgtgccgaagttaacgggaggtcgcagcacaaaacgtctgttttacattagaggccagtaattagaaaagttttcggatgcgagaaccgaagcttttggctttttcttgctcttcgagtccaaaaatttttccggtatattttacaaaattatagacgccatggtatatatacctctagccagttgttgtccaagggactataagttttgcaaacttaacagaatgttgagttaaaattttcaaaaaatgtagagtattcttggcattctggtcaacatgaaattcaaaaattcggtgaatgttacaatttttttgatccccaattctctttttggggg

SEQ ID NO: 33007 - DNA, 805 bp, Heterodera glycines
  misc_feature (763)..(763): n is a, c, g, or t
ataaatagggatgcaatttttaggtttttacctattttttcctcagctcccagtgacctgaaaagcatgaaaaacatgtttttttcgattgttgttaagctgcttttcggttattagtacttacatattttctagctttttacaaccataagaatcgtcttaaattttttttccaaaatacaccccctaagatcgaccttaaaatttaaaaataaacactcctaagaaatgaaaaaaatttctcaaaaattcatcctccaaatttttttgtttcttgacaaatttttgatttaaaaaatgtcaatatttgctaagaaattattagaaaggaaattacttcatttgaaacagcaatcagtgaataaaaaaaaatttgttgctcaatttttggctgaaaattatgtcactattcgtcactatttcggactttttgtcacaaatctcattaatgatttggcataatatttctgaagaaaattttcgtttttacaacaccctaaattcggaattttttggcacttaaataaaatattgccaaaatattttaaactaatttttaattattattttgtttaaaaacaattccaatttaatgctcagtcaaatcacttattttcagctgttcttatccatttttcaatatatgtgcgatttgtccccaatttcttagctatttttatttctattttaacccattcttttgttgaatattttttttcttttattttaaaattttttcagttatttctcttttttcttctanattttctttttcttcccattttttccaaataattcgtcaaat

SEQ ID NO: 33008 - DNA, 342 bp, Heterodera glycines
ttgctgctatttattgtccgcccctgctctctgtctcatatttgcaataattttgtttttcttactcactaacggatctttggggaaaagagagatagagaggagggcgggggacgttcgttcatcgccggagggggcgtccgttcatcgccggggggggcgtccgttcatcaccaattctcagcgagtgctgagcaattgattgcttcctcagctcaaccgtttggacatttgggttgttcgcccctccctccctctctgtcccccccttctttcggatgttgccattctccgccgtttggtctacgacgttgacttcggccaaggagtggcggtgggggg

SEQ ID NO: 33009 - DNA, 922 bp, Heterodera glycines
gcttttcctttccttttccttggcttttcttttcctccccttccttttcccccctttgtccacccatttggccaccatctgtcactaaagtccatcctttcccaattcgagtttattccttcacatctgtgccataacaaactcttcctctccttatagtaatggcatcgcttccttcccaatcggttcaatcggaatgccaactttttgtcttttgtcgcttttttgggtaaactcccctttcgctgtattaattgtattattatataatgccccctgctgtcccatgttgtgtttgttatcccaccccttctcttatccctttgccgatcacatgcattgggcattcattgcccgaggcaaaaaacggaccgacgaacggacgaccaaacacaaagaatcgatgcccatccgtccgttcatttcccaattcaaaaaattactgaagcgggggaggggggcaacggaggcacaaaatttgatgaaataaattaacattcatttggtgaatattttccttaaatggtcttctttctctcatcccgcaaccaacggcaccaaaatcagaagagattgaaaagaaaaggccaccaaaagaacgaattgggggaaagaaagcgaaaggaacgacggaatgaagaaaggcaaaaataaatgaggaaaaaaatgggcactaattgtaagccaattcgacattcattccattcgacgcctttcgtctgtaatgtttaggggaccagagcgtttgggccccggggtcgtttgggccccaacccaaaaatagaaaaatgtgcttttttaaaaaataagattctaaaaactaagcctgagggatccctcgccacttggcataagttaggtttaattaacattcgctcatttttacaattttacttattccaaatcctattattttttaata

SEQ ID NO: 33010 - DNA, 144 bp, Heterodera glycines
ccacaaatccggccaaaaaatgagccccagcaaccaccactctctgctggaaacaacaggacaaaaacgtcaattgcgttggtcgcctcgtcagagattcgtgcagtgcaacggctaaacagtgccaatgacggcaatgggcaa

SEQ ID NO: 33011 - DNA, 1101 bp, Heterodera glycines
  misc_feature (1021)..(1021): n is a, c, g, or t
  misc_feature (1048)..(1048): n is a, c, g, or t
  misc_feature (1059)..(1059): n is a, c, g, or t
  misc_feature (1061)..(1061): n is a, c, g, or t
  misc_feature (1072)..(1073): n is a, c, g, or t
aaatatattcagctaaaaaaaatatttttttacgcctagaacactgtgaagtgataaaaaaaagtagtatttttatggattggtaaagtaataaatcgataatttttaaaataatattttgacgacagttgaacggtaaaaatatagcttatactcatattccttcagaaactggggcacatttgaggaggaataccttaatggagaaattttctgaagaaaagaaaaacaaacggtttaaataaaattgtgacttttacggttatgctcttaaaattgcattgcttctaatttattttcattgagcacaacaaaggtgaggcttaaataataattattttatcagcgttggctttacaaagaaaaataacgataataaatgaaatatattatgtatgcaaaataaattcagctaaaaaatatatttttattacgccaagaacactgtgaagtgataaaaaagtagtatttttatggattggtaaagtaataaatcgatagtttttaaaataatattttgacgacagttgaacggtaaaaatatagcttatactcatattccttcagaaactggggcacatttgaggaggaataccttaatggagaaattttcggaagaaaagaaaaacaaacggtttaaataaaattgttacttttacggttatgctcttaaaattgcattgcttctaatttattttcattgagcacaacaaaggtgaggcttaaataataattattttatcagcgttggctttacaaagaaaaataacgataataaatgaaatatattatgtatgcaaaataaattcagctaaaaaatatatttttattacgccaagaacactgtgaagtgataaaaaaagtagtatttttatggattggtaaagtaataaatcgatagtttttaaaataatattttgacgacagttgaacggtaaaaatatagcttatactcatattccttcagaaactggggcacatttgaggaggaataccttaatggagaaattttcggaagaanagaaaaacaacggtttaaataaaattngtacttttacngntatgctcttannattgcattgcttctaatttattttcatt

SEQ ID NO: 33012 - DNA, 937 bp, Heterodera glycines
aaaaataatttttcaaaattaagtaggcaaaaaaatttcctcccttaaatatttttcgccgctttttccgatactttcgttcccgtttgcatatcgcgttaatatcgttcattcgcttttttccacccgccgatcacgcaatatcggacgacaaatctcgtcgcggaaattttcggcataaatctcgacgaccaaattatttcggctcgcatatcgcaattaatgtaacggtaaatcaataaaatttaaaaattcgtttttttaatttaggatatccatttggctttaagtttatattaccttatcattataagcacttttgcttatatcataatggtttggactagcatattggtatcaaaaaattcttggacatcgaaaaccaaatgggtaaattaatttaaaattattttttatttaaatttttgtgtttgaagcgtttcatcttcttctgaaatagccaaaaagatgattgaagtgaataaacaagtttctcgaaatctaatttttcaggttaattgagcacttttttgtactaatttaaatataaattattcaatattttgttatttaatttacatttattatttaggcttctatacccatcatcatttatcggttcatttatttttcaacttgtgcttctgcttttcaaaattgatatacaaggatgggatgggcgtctggatttcaatacattctcacctttcccaatttttttaccgtccgctttaaatccaatcgtatcattttgcaccatcaaggcttaccgtatcaaatttgtttcgaacataaaatggttcggtatggtgataattagttgacagtttgatttaatggtttttaatttaggttgattatttaggaaaaagcattgaagcgttcgtttcgcatgaaaattggtgatcaaaatgcggttttcaatattcagatgcag

SEQ ID NO: 33013 - DNA, 924 bp, Heterodera glycines
  misc_feature (13)..(13): n is a, c, g, or t
  misc_feature (843)..(843): n is a, c, g, or t
  misc_feature (848)..(848): n is a, c, g, or t
  misc_feature (900)..(900): n is a, c, g, or t
aaaaataatatancggaagtaaaaaatatattaaattaatcgtttaaaaaatgatgaaatttctattcatttaaaatttaaaaaaatttacaaataaatattattttgaattttgaacgttggctcccaaataaaaacaaaatatcgaatcaaaatcacaatatcaaacaggccaatatattatttcgaattgggtttataatttcattatttcaggcagaaaaaaaattaaaaaaattaatactgaatgctataaaactaaaaaattatcattgatataaagaagttaataatagctctaagattattaaatactcccaagaccagtgagcgtcgagcgtagaacacttctcatttaataatcctaaaaaatgcaatgtaaataaagaaagaccaaagcaatattaaactttatgagattaatttaaaagaataattaattaccagcacgcttaataacacaataattcgaatattttttataaaatttttataagccgcgtttttcattttgtaaatgattaataattttatattaattaaataaatataaaatagataaattttaaagtatatttataaataaaaacaatcaactttttaaaaattattttttttaatttcaaaaacaataaatgtaagaaattaattattcagaaaaataaagaggagatgccatttagcagtaaatactcaaaatctaataaattgtttaatttataaagaaaaagttaacaaaaaattaaattaaaagataaacaattagagatgctcactggtaaataactctatagaggtccaaaccgcaagataatgtgaaaaaatgaaaaacattgaactttnaatanatattaatgcagatataaaatgaaaaaagattttaatcaaaacgtattttanagttttaagcttaatattgctaaa

SEQ ID NO: 33014 - DNA, 847 bp, Heterodera glycines
tttttaaataaattatatcataagttcttttttaaattttacttcgacaaattcaacacaaaatagaacaaaagttctcttttcgtttttgtgtcttttgttctttccttccattcgccgccacttttattttcccccgagggaaaagcacaaaacacaaactctaaaataaaataaaataaaagcggagagtatttaagtgacaaattcattgggtgatgacaacatttttccttctgaattattttcaatttgtcctccttttttgatcatttaatctctctttttttaatttagcatttcatcgcttttcctaaaatatttttcatttttaaatttgcccaatttccttccaaaacgccaatttatttctgctcctccccaccctcaaaatgctcgtcgactctctccgtcccgccactctttcgtcctccaaaaaacgttcagcgcattccatggacgacaccgaccaattcattgaccacagtcccccgcacaaaaaacaactaatggacgaggaaaatgaccaaattttgacacaaaatacaccaaatgattcattggaccggcggaggccaattgcctttgccacaaaagcaattcacgcggggaatcggccagaacagtgggacatgaaccaggcaagaccatttcctccttaatagataagcgtaattgggtgcgactggcaaagtgatcatcctcaccccccccccccccgtctttaggtcgttccgccaatttcgctgtccaccacttacaaacagtcgcgaccgggagagcccaaagggcacgactattctcgagcccgtacaaaacgaaatgaagcaaattcaaaacggacgct

SEQ ID NO: 33015 - DNA, 946 bp, Heterodera glycines
attattgataaatcacttaagctcaatctcgttgggaatgaatttgtctgaatcataatttatgcaacccacagcaatttgtgctttgttttcatttcaattattttgtgctcttaattaaaagatgtccatagttttggcttaaatgaattatggttttcagactttcaaggacaaattttttctataaacagttcactgatgttgcggtgaatattaaaataattcacccattcatttcaacatggaattaattactgaatatctgttttttataaaaataatgaaaaatctctagagctcaaacgtgttttggaaatgcgtttgtatgaatcgtatttatgaacccaatggcaatttgtgatcagttttcaactcaattattttgtgtccataattaaaaaatgcgcatatttatgttttaaatgaaatgtggctttcagacgttcaaggacaaatttttgctataaattgttcactgatgttgtggtcaattttcaaaaaaattcatcaattcatttaaaatggaattaattacagaatgtataccgtttataaaaattattgataaatcacttaagctcaatctcgttgggaatgaatttgtctgaatcataatttatgcaacccacagcaatttgtgctttgttttcatttcaattattgtgtgctcttaattaaaagatgtccatagttttggcttaaatgaattatggttttcagactttcaaggacaaattttttctataaacagttcactgatgttgcggtgaatattaaaataattcacccattcatttcaacatggaattaattactgaatatctgtttttataaaaataatgaaaatctctagagctcaatcgtgttttggaaatgcgtttgtatgaatcgtatttatgaaccccatggggcaatttgtgatcagttttccactcatttattt

SEQ ID NO: 33016 - DNA, 887 bp, Heterodera glycines
cctttttccctttcgtttgtcacggacacttcgaacatttctccgccgactgcaaatgttttgcgcttatcacttcttttttggccattcctttgctgctggtctttccccccatttatcttttgcactcaaacctttccttgccataattcgtaattcatttgaaagattttcaatttgtcaaagaaatggaaaatgctgcgaccggtggaaagagagtcccccgtttctctcacagcgcggggacagagggcgccgagggggagaaggagccccaggcggaggagccgccctccgccggcaccgccggcgccgatagacctgccgaagaccattccctgctgctcgcccagctgctcgccgccttcgccctgttcggtcttgtcactgcgctgctcttccaattgcccgccttccgcgtgcgaagtcgcattggcacggacggacccgtgccaatccatcagttggacccgcaaatggccgaatgtgcgaagacatgcaggtagattagcagaaaagaggaggggaagagaattaccgtaacaccactctcagaatcgaattggtcgagagcattccccaaaacgtgtcttttcacctttccctcggcaattcgcccgctttggccatcccaacattctccgcttggatgcaactgatcagcgaggccaaacattcgctggccattgcggcttataagacgagtcttcgcggtgagccaacggcggagggagcgaaaattcggtgcaattttagggaaacacgtgctgggggaggaccaaggcaattactcgacccaaggagagacggttttcgatgtgagtgagcaaaaaagaccaatccgaagcccaatttgttgccaggctctactcgatgccggactgagg

SEQ ID NO: 33017 - DNA, 1020 bp, Heterodera glycines
ctttcatttttatgtatattgccaaaacggacaaaatgatcacgacaaaatccgacatgataaaagtaaactgctgggccataaaaacaaaatttaaaaataatgattaagggtttatttcaattttccaatccacgtgaatttatggcaatattcaataatttgtgatttttcatttttcaataacaaaattttgtcctttttgccgtctcgcagaattatgggtaattattgcattcattaaaatttcaatttgtttcaagacggcgcctgttgagtattacggccgtactcaaaattttttaattttgaccaaaaaaaaccacaaacatatttatggaaaccgtcgatttcatttaaaattaatttttaatggtaaaataatttttttttttaatcatttttgcagcttcatgttgtccctagatgtattgcttctcaaaggttattagcattaataataccattccatttcactaatggatttgcgtgtcccgtaatgaattccatttaatattttttgcagaatttcatgataatcatactcaaaaattaattctttcgttcggtgcggaaattgacgaattcaaaaaaaatgtggaaaggcttttaaaattatttaattccttatgccttttttctatttttttttctcttgcccaattatcatgtagacttttcaagaacattctagcaagaataattcaaggactaacacgaagtaaagatttaattttccttgacattatcgaaatttcttatttttatcttcattgtttttatctattatgtttaattatctgtagaacataaaaggtaactcgccgggtgggaatcgaacccatggcctttccatatccatgcaatgttctaaccgactaagctatcctggtgctcccttgcgagctttcgtcctttatccaactttctcccaaactccattttcttctggcatcacatttaccattaccataaaatggcaaatatggattacaaatttcaaatttattataatttttt

SEQ ID NO: 33018 - DNA, 1047 bp, Heterodera glycines
ggaaaggggaagaaggagcaaatgtaaaaggatcccttagaagatgaagagaaaaggaaaagaggaaaaagaaggaatagagggaaggggaaggaagaggagaaggaaaggagaatgagaggatgaaaaagaggagaaaaatggcgtacagcagatgacatggcaatggtctaacattttgggaactatatataacagtatttgtttttgattagaatggattatggcccaaaaattcgaccgttgccatgtaaaaagaaaaaatgttgccaaatgactagtgatgctcgagaccgaaaatttcccgagactcgagaccgaggacttgaccccgagactcgagaccaaaaaaaccccgagacttttctcgagtcgagaccgagagtctcgagcagcactacaatgagaaagtaaacaaactgatcaaacatttcttctgtttctattgttcagcttttcctattccctctttttgtgttcttttaaagtctgtcatttttagggctttctcttctttaagttttaaatgttctgtcatttttcttcggttttccattgtaaattttctgtcattttagcaatttccattaaaaaaaaaaaaaattttggcaacgaaaatcgaaacttaaatggtgcatttgcattaattagtctgttctatgaacgtgagcatatactgtattgtagaaattcttgatcaaaaaattaaaaacaaaattatgcctccagaaaaatttggcgccttttaggaaagactgttcggtataatgtgatcagaaaacaattaattatgtaagtcacgtaggcctaaatgaatgcttaatgcattaatgatttcattccaaatgaacatatactaaaattggaacaatgcagagaagattaacatggcccctgcgcaaggatgacacgcaaattcgtgaagcgttccaaatttttttttcattcattcctcacaaaatattcaataatgggaaaaaaagtaaagtccgggtaaaaaaaaatttcccgggagcgggaaggcgggaacggggagttcaaaatttt

SEQ ID NO: 33019 - DNA, 950 bp, Heterodera glycines
tttgaataaaaatggtaatgttcggttatatcgtctcattaaaaaatgtacaaatgtcattcattcattcttcactctctctttcactttttcccttcgcttttcctttccttccctcactttcccatcgctttacattcattcaccgctttctttccgcactccgcgcactttggtgccgctggctttttgcattcttttttgcacttgccactcgcgcatttcacacaatccgtcgcgcatttattgttcgtctttgggcacacacttttgcattcgtcgatgattaaactctgacaaaaaaaagatggaaaaacttaaaaattcagaaaattagagaataaattattatttttctttgaatttaccgcttcgttaaaagagtttaatgcgacgacaaaaataagacaaaagagaaggaaagcgcgggagaaatgtttcattttttgcttttttaataaaaaaaaaaattaaaaaattccataaaatatgattttgttttcggaaaatgctttaaaactttcaaaaattgctaccaaataaaagtgtacgaatgaatgaatgttcgttcgcctttctttctgctcggccttctcgccttttttcaatgttcaaataaacaatattttcttcaattgcctgtgtaataaataatattttcttttttcgtaattgtgtgactacggactgtccaaataaacaattttttatttgattatttgggaatcaaatttcaaatttcattttaatatttaaagtttattttaaaacatgaaaaattttgtattagtaaaatgaatttaaaacattttattaatacataattttttaagattttgaggatcaggaaatgtttccgaaaatgattgacgggaacccaaaaagcatcgcaaaatgacgtcataaacccgttttgccactgggtgagtgttcattgcctctcttctgat

SEQ ID NO: 33020 - DNA, 437 bp, Heterodera glycines
taacgccttctcggccgtgaccgattcgggcaccgatgttcttgacagacttggcaaaatcagcaagggcgctttaaacgttgtcaaacttgctgggccccttggccaactcattcacacgggcatttccgtgacgcttagtgtaatattaattaatctaaaaatgcatcaccgtgcgtcacttaataatttgcatgtatgtttaaggaagactcggatgaattacgggcgattaagcaattaaatgagaaaattacaacgaagtttgatgaacttgcgcacaagttcgatgtgatgctgaatcaaatggagtttgcggacatcatggagttttatcaagatgtatttttactagagtgcagcggtaccgggaaatttgggcaagaccgggaccgggactttttggctgggacaaccgggaaaaaagccgtgaattt

SEQ ID NO: 33021 - DNA, 971 bp, Heterodera glycines
ttaatttattaactttataaaatttaaatatccgttcctcccatgacaaattaacaaattttaccgcagagttcgagcagtaacagaaggtaccagaatgatgtgctgccaaataatcttagaaacatcataaaattacgggtttgaaactttataaattttgaagggacaaattgtttattagaatgaagtaattaatattaatacatatgaggattaaaatggaaagtccgctaatttgataaattgttgaattatgctattttaatttttgattagtaacaaaaaagaaaataatttaaaatgagtttttttggcttagtttttgcactttaaaaaaattttctggaaaaatatggattaaaaaaggtcgaattcttgaaaatgattcaactgatgattgatcaaatttttaatgcagcgaaaaatgatggatgaacagtcaaaacaagttttattgcccgtcgtccgtcaaatcatttcgttggagcgaaaataaaataaacaaaatttccgttactttaatcgataatattgggcgaaattttacagcttatcattcgcgtaaaatatttttgttaaaaaataaaaaaaaaactttttctaaacataaatttataagaaattgaaaaaatgagagaatttggcaattaaattttggccaaacttcaattttgttttaaattcttttgggccatatgttggccaagagaacagcagacaattagttaattacttaagtccaaacaaaatgtcgtaaagtcatatgttttatggcagacggagaaaccataaaatttatgtaattaattaactaacgattaaacgttaattttttcttcttttgccctaggggatgattgttcgagataaaactgaaagggataaaaaaattgatagaaagcaataagtcgatattcccataaaattcataattttaatgtaattaaaaaaacatacataatattaaa

SEQ ID NO: 33022 - DNA, 551 bp, Heterodera glycines
tctctctcctttccttttctcccctctcattttcccctacctttccctctctctctcctttccttttctcccctctctccttttccccctccctttccctctctctcctctccttttctcccctctcattttcccctacctttccctctctctctcctttccttttctcccccctctccttttcccctccctttccctctctctcctctccttttctcccctctcattttcccctacctttccctctctctctcctttccttttctcccccctctccttttccccctccctttccctctctctctcctctccttttctcccctctctccgtttccccctccctttccgtgtctctcctctccttttctcccctctcgttttcccctacctgtcgctctctctcctttccttttctcccctctcattttcccctacctttcgctctctctctcctttgcttttctgccccctctccttttccccctccctgtgcgtctctctctgctctcctggtctccgctcgggcctgatccccctcgctttgccgctct

SEQ ID NO: 33023 - DNA, 1025 bp, Heterodera glycines
  misc_feature (912)..(913): n is a, c, g, or t
  misc_feature (943)..(943): n is a, c, g, or t
  misc_feature (958)..(958): n is a, c, g, or t
  misc_feature (966)..(966): n is a, c, g, or t
attattcttttaagttttttcaaattaaataattattgtattttcatataattttaaataaaatatggttcgagctgtggtgccgatagtcacatcagcaggagggaaattttggcaaatttaacgaaatttgttaaaaaaatttttagtgtttttattaaactcaaaaaattatatttatttgattgtttttccaaacaggctcaattactcgccgtgtgtcaaacgggacaacattggccaatgtgatcccacccgatcacttgcaaacattggtggacaatggcactgacgcattgctgccttcaacatcggatgcgccaaggaggtctcgtcggatcgcggccaaagtgagttttgggcgggtgggaaaaaaaaagaaatttgatttattttttaattagtttaattaattttacataattcattttttaatttatcgattactttttgattagtttttaagtccaaaataaaaaattaattaaaaaacgcccattaaaatttttccaaaaaaaataaaatcaaaaaataaaccatgttaaaaaagtgtttaattaattaattaattgcatcaaaaatttaagaatggtcaacaggctatgtcaacatcaaatccaattgcagcattacaacctgtgttaccaatgaacccagcccaacagaaattcaacccgcgtgaagactcaacgccaccgcccgcgccactgagtaaaatttaattaaattatttaagaattgtgattggaaatggtttcctgatcagatcatcatttataattatttttgcacattttcaaggatttcctaacttgatggaaaaccatccggaagcactgaaattttatttttctttattctgttaacttttgaattggccctggtacaccgttaaaattacgaattcacaannttaaagtgaattttttgactcactgcttgnaaattgacttttgtngggaattntttgaaagctgaaacgattgaaaattcgacagttgcaagaaaagtgttttaaatgccaa

SEQ ID NO: 33024 - DNA, 587 bp, Heterodera glycines
cgtccatactggaatccacgagttcggctcttgacggtgcagctgcttctacctcttggaccacaatggtagggtataaacgaggcactagcaatgaaaagcaatcataataattaaacgaatgtactttctgttattaccattgctcttttctgattcaatttcgatagaaatctttggggtatttttggttccaaccgatggctcaaccgatgacaaaacagatggataaattgatgcaattggagctgagagcgaatgagtctggaattgtgagtgtttttttaacgagtaaatgaagattaaaaaataataaaaaacatccctctgtttttgcttgaatcggaatcaaaaacaaaacgacctcgaaaatgttggtttttttaacgattgggatgaggcagggggacagattacaaaaaactaagaataattaatatgaaaaatcattaaactatatacacgcttttttgcataaatgtgcgcacgatcaacccaccctttccagttccgacgatgatgacatctgctgttgatcatcttcccttcgcccgggcagagaatgctgttcttgttcgccttttccg

SEQ ID NO: 33025 - DNA, 577 bp, Heterodera glycines
gaaataagcattttttgggattctgaaattttcaatgcgatttgttaacagattttgtccgaaaaatgaccaaattttgcgattttgagcaaatttttgcttgtaaattaaggatttttacggtccggcggtgccgataggcgccaccgggggaaaaattaagaatttttaccatatttttagcatattttcattaagaaattctttattttgcggtttttctcaaaaaaccacaaaaagcctcaaagcctcattttgaaaatttagcctcattgacctatcaaaaaaccacaaaatgaggctaaagcctcagatatggcagctctgattataatccccaaaatgcttccgccacagaaactctgacatataagtatcgtacaatgatcttgcatccccaaatcttttttttgccttcaatttcattttttgccaaaggctttcattcgggttcggggttcgaaatggatgtcggattcgtgatcagcgaccccgaaaaccccaggaaagacgttttgatgaatttcaaaaaattatttttttttaaaaagagagggggataaaccctactattacc

SEQ ID NO: 33026 - DNA, 1115 bp, Heterodera glycines
ttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaaatggggtatgaaaagtttattgggggaaaaaaagactttacaaaataatacccctgggaaaaagggagtgggaaacatgatttcaaaattttcatttttttctagtctaattcccccaaaaggggttcaagatataaaaaaaaaaaaaattcccgggggcgaaaaagggggtttggaaaaatttattggggaaaaaaagacttttaaaaaaaaaccccccggggagaaagggggggg

SEQ ID NO: 33027 - DNA, 1007 bp, Heterodera glycines
atagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaagcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcagtacaaaattggccgaaaaagagatagccattttctgaggcccgaaggaaaatttgagagggctaatttatatgtaatattcgaaagtgccagctatttagcgattcaggcgcacatt

SEQ ID NO: 33028 - DNA, 1012 bp, Heterodera glycines
  misc_feature (962)..(962): n is a, c, g, or t
  misc_feature (977)..(977): n is a, c, g, or t
tttttgtgctaggacaacaccaaaaagatgctctgcgctgtcctgctcttctccggccacactctgatcatgatggtcgccactttgactgtcgaccgttacattccgtccgcctttcgtttgctgcgccttttgccgcgtctttttgcactgatcggtgttccatgcatggtgatcagcaggtggggtgccttttactaatcatttgcttaatacggacccaagggatcggctaatgggataatggcacggaaaataacacaatttggctgagaatttcaatgaatttatttggaaatattttttcgtttttaattcttttggagcagtttaaggtgaatgtgtggatttagatgggcaattcgatattttgtgtcttaaactggcatccttttcattggcatttcatccattaattgcttttttcaccaccatttttgccactttcaggacccattacacttgcgacgtggtcattgcctatctgtctacaattgccatattttcgtatgtttttctcgtccattttaatggcaccgatttttcggcaaaaaattttggttttaatttttgagaagaaaaaattgtatattattagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatccatttcgaagtgtttggggtaaaattgtctttttttgataaatcatttctataaattgaaagttccagcagagaacttcgaaatccaatgacgaattaatgaattcgagatttcattagttttctacatcgaagaaaaattttttaatttgaaaanttatgtaataattangaaaaagtcgattttttaggggtgtatttttcaat

SEQ ID NO: 33029 - DNA, 909 bp, Heterodera glycines
attcgggggaggggacctccacactgaatgatcacttttattggagcaatttaaacatttctttatttagcaccaatacatcatctctactgaccaaactgtcgttggtggcatcaacggaagtggcgctgtttcttcacacaaaattgacgacgcgacacttcgccaattgttcctttcctattttactgcggaaaagtctaaacaacccgaaattgcaattgtgatgtcaagaatattgggatattctgcagaagtaagtgtgcttgttatttctttgggaatgatttcggttggcgcttaccaaaattttttccgaaaacagtttttttgagtacgtttgggtcgaatgggcgaaggccccttcaccgattattttttcttttatctccaaaaaattggtaaagagatgttactttagttaggcattgcatttaaagaagaataaatgaaatagaaattaacaatttaaaacgaaaagaaaatgaaaaataatgtttgacaatatgaactgggaattatgatgttcaaatgggctggtgttcatttggcagcctccatttgaaccagtccgttgtgtgtgtaatttatggttttgccccttggatcagagacccgaaacctagtaattcacttccttttttcaaggaacaatcccaaatcagcgcggctttgtcaaagtcgtcctcctccgcttcgttttggttcgcccccttttcctccactccgtccacttctcctggtccgccaggagggctttcccttactgaacaatttgtacgctttttggaacaagaatccatggccaatgctcgcgcattgcttcagccacccatccaagtgctaatttcaaatgatcccttcactttttgctttttcagtctctccctgctgacagcgcaactttcc

SEQ ID NO: 33030 - DNA, 952 bp, Heterodera glycines
  misc_feature (898)..(898): n is a, c, g, or t
  misc_feature (923)..(923): n is a, c, g, or t
ggggccttcgcgtaagcgtaagtgatatgggcggacattcaacggaaaacccaaaaggagggaaaggcaaataattgatggatggcattggccaaagaaaaaaaacgaacaaacccaatggacataatctgaaaaaaaacgaatcaacaattaaaaaccaagtcacttggataaggggacttacaatggttatcatcgagacaccttaaaaaggagcaaagagaaagaaagggatggaatgactcactctcgaggttcactccccacagagacatatagccgagaacgcctgaggcaattattggaaatttgaagggcacacaaataacgaaaaaccaattatctatcttaatccaaaacccatttctgatttttcttcgttttttcaggcgcccattttcttttgatttttcattttgatgaaaatttaaaattaaatgtcagcgaaaaaatcagatggaaaaagcaaaaaatgttatggtttttggcttatttattaagctctttcaaaatgaccaatgtcaatggaagcgatggccgcggtgatctgaataaaagcggcaaattttattcagcttatttcggtttcattgttcccaaaaaaatgccaaccaaaaaggcggcgtgccaattcggaatcatcagaaaggagacgaacatcatgcagaccatggccaggaagcagttcctgtcgatgggtgtgcatttgcattggaaaagagtgacgtaaccgaccgaaagagtgccggcttcagttccaagtactgtaagggcaatttggtggacctggtcaatgttttagtcccacctgatcagcgaaggggtaatactcatggaaagtggtcacattgaactcggcgaattggtcggcaatggcacgcatcaaccgacagcctanaaatgcactcaaacgaagtgatttncatacaaatgaattgtctccgtgccattt

SEQ ID NO: 33031 - DNA, 898 bp, Heterodera glycines
gtgcaaataaaaattagatgcaaatgcatgtggttgtgtgcgtgctatggcgcaggtaggtgtgtgtgtgggtgtgtcaggtgcagttgcaattgttgttttggtatgtaattgtaggtattcatgcccaaaagataggtaccaaaaagcaaaatacgcataaaaataaggagtttcatatattttttgcaaaaaaaaatgaaaatatggtaaaaagtagaaatgaatatataaaacaaaaatgatcgagaaaactaaaataaaatgaataaaaataaaattttaacaaaaatttattttaatttaaaatccccggcaagtttcgctgggattcaaaaaattttaattgaggcgaaaaagattgacccggaaatcaagaccgatgacgttaataattttctcgaaaaacagaaaacatacacgattcacaggcccataaggaaaagattcccgagactaaagacgataccgagtggcttccataccgattggcagtgcgatttgtgcatatttgaccagttgaaaaagcataacgacggttacaagtatctgttggtatgcatcgacgtgctgagtcgaatgatcttcagtgcaccggccaagtcaaagaagagtgaggacatgattgaggcttttgatcgggtgttcgacaagtcgaaaattatcccgttgaaaatatatagcgacagcggactcgagtttcaggctggaaaaatgaaaaaatattttgaggaaaaatttattatcaaaaatgtgatgtatagccccgaccttcacgccggagtcgtggaaagggcaaatcggacaataaaagagcgtttgtatagatatttttaaaagaaagaactctacgatgggtccaaggaataaacaaaataataaaaaaatttaacaacag

SEQ ID NO: 33032 - DNA, 878 bp, Heterodera glycines
  misc_feature (837)..(837): n is a, c, g, or t
ttctcccttcccctctcctaaaggcttttcgtcggcgtttcgctttgtttgaccttcatttttctcatcgttcacttctttacgctccaccaaacgcttttgtacttttggccatgggctgagtcagtgagtactgtaggctacagtcagtccaccaaataaccgtaaccgcacggatagtcttacggacataattttacaacagcaaattaagttcaatttaaatgaatgatttttttgaggattttctgttctccgcagtttccgctttcgttttcctcgtctgttcattcattgagtcgttttactccacgggggcgtggtaaagaaaagcaatgaaatcgcttaacattcatcagacaaacgatgactcaccaattgccattggcacaggtccaacaattgcaatgacattggcggcgacggagtgattcacaacggatgccgactgatttgggagtgggcattcgccgcggtgagaacaacgaaaggaacagcgaaaggagcaatttttgaatttttgttattttataacaaagcacttgtatcaatcaccacaaaaaagctgatggaacaaaatattaaaattcactcgttttttggggatttttaccgtattttttaaaattacagtaatatttttcattactcctttcccaccgagattcacccccccccccccccacagtttcttctcttcactctgtgcgttttgttcttcaccagtgctttttttgccaagcgacaaaaaacggaagaacgacgcatttatttgcgcgagagaaatgctggaaattttgatcgctaatttgtgaaaatttaagaattcatgattanattttactcacctcactattcaccagggatggggccaattg

SEQ ID NO: 33033 - DNA, 813 bp, Heterodera glycines
aaaattttgaaatcatgtttcccactcccttctcccaggggtattattttgtagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttttcaaaccccatttttcgcaccgtgaatggtatttttattgaattctgaaccggtttgagtagattagactagaaaaaattgaaaattttgaaatcatgtttcccactcccttctcccaggggtattattttgtaaagtctttttttcccaataaacttgtcaaaccccatttttcgcaccgggaatggtatttttattgaattctgaacccgtttgaggaaattaaactaaaaaaaattgaaaattttgaaatcatgtttcccactcccttctcccccagggtattattttggaaaggctttttttccccaataaacttttcaaaccccttttttcgccccgggaatggtatttttattgaattctgaaccgttttgagaaaattaaactaaaaaaaatgaaaaattttgaaaatatgtttccccctcccttttccccgggggaattattttggaaaggctttttttccccaaaaacttgtcaaaccccctttttcccccccggaaatggtattttaatagatttccgaacccgttttgaagaaaataaaaccaaaaaaaaaagaaaaattttaaaa

SEQ ID NO: 33034 - DNA, 869 bp, Heterodera glycines
acggtcaattgtatacggccttctctcgggcaacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttccattgcattatgcgatgtgtcaactccaattattggaggaaaccaagtgcatgtcggctgacgcaaagaccctaacagactaaacgcgcctaggtagcgaagctcaagaagcgcgcagcgctttcccaagttttaattaatatatacgttatattgacaaggagtttcgtttcaaaaactaatttgagcttaacggctaatgggacgggtctgaaagtagtggaagggtcttacaactttttgaggagaattcgggaaaactatagagaaaaattctgcgcggacgactgagtcccggggaccgatttctcactttttcttgcgtttgacggcccataactttttttctgaaacccgaatcaaaaagtgcccgctgtgagggcactccccacaactgtcctctacatgctggtattttttatttttttattagagccaccccctggcctgcacgcttggctaattgaagtgtgctcaaaatgtacacttc

SEQ ID NO: 33035 - DNA, 816 bp, Heterodera glycines
  misc_feature (34)..(34): n is a, c, g, or t
  misc_feature (49)..(49): n is a, c, g, or t
tcctaatcaatggaagtccctaattttaatcctnttttttaataaattntgggctctaaatccgtttcatggagttttcgagaatgctaacgcatattttggtaaattttttcaaattccgttcgaaatcggtttgcgattatgaattgagctaatccgggtttagattcgtaatcagtacccgaaaatcctaagaaacagatttttagtccaaaaataaagattaaattaaggacacccattcgttaggattgcctaaattagtaaatattgcaaagcaaaagcaaatttgaaaatccaaaaaaatgttttcaattttgacccaatccaaaccgctggttttattggccacaaaacctacataaaaaacgggttttaaaatgcactataaacaacttttttgattcgacctggccttggtagaattaatttataaaaaaaaaatttttttttttttgtatatttcagtttgcctttttttcacccaattgttattttccgaataaaaacctgtgagtggaaataggtgaagctgatgtatgggcttttgtaagtgcgaattgtgcgctcaaattccttctcccaaaggcccgacaaaaaggacacattggacggatagaattggagatggtaaacctggatagaaaatggggaaaaataatgaaaatgggaataaattgtaaagaatggcaccgatgttagcattgctagcaaaaaatttaaaaaaaaattatcaaaaggctatgacagtgccagtttttttttgagaaaaatggcaaaaataaattaaaaaaccgttcggattcactgatttcc

SEQ ID NO: 33036 - DNA, 794 bp, Heterodera glycines
aaaagaataaattttaaatttctaaaaatttaaaaataaaaacttacggcgttcacggataaggggagatgccacatttggtccaccatccaccgagttctcaaaaaagccgttggtgccggccatgacggccaaagtgatcagaaaaagggccaaaagaaagcggaggggagacatttgtaaatgtgagatgaatttgttgatttttgattacaatacgattggaaactgtatgctttccagaaaaattgtgggagcttttataagcaaaatcttcttaactgatcagcagtgatcacgaatttgtacggttcatttcataagactaattatagtaattagtaattattattattatgattatgctaaaggctaatcatctgcttttttaggaaatcatgctcacaaaatgtctcaattagttttaatgaattgccttactaagctttgattagtaataatcatgatcagaattcctgatcattttctaaattgccaatgactttttactaatatgatttttttaattgatcatgcgaggttaaatgggggtcgtcagtcgtcatcctatgatctaaaaactcattaacgaattaaaataggtgcaggcaaataattagtttttggtcctgttcgcccacccactaaacttccttttatgggtgtgtaattttggcaaaaatttcgtcaaagaaattcttcaaattactctttaacaaaaagtattttgttgcgagcgatgagctaaaattgaaggaagtgtttgctttgatccaaaaattaaataattattg

SEQ ID NO: 33037 - DNA, 835 bp, Heterodera glycines
tcgattttttcagtgtccgtttgggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgagtgtccgtttggggtactcaaacaattatggggagcaaaaatccaacgcagaattaaagtacaggctatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttgcggtactcaaacatttatggggagcaaaaatccaacgcagaattaaagtacagactatagggaagctattcccgaaggattcggtctccccatatatctgggcgcatcggttcggggggactgcccccaaaacacaaaaaaaaatttttt

SEQ ID NO: 33038 - DNA, 1187 bp, Heterodera glycines
  misc_feature (207)..(207): n is a, c, g, or t
  misc_feature (911)..(911): n is a, c, g, or t
aaaaaaaaagaaccaaaaaacccttcaatgcgatgaatgcattttccagaagtccttaaaggacttctccaaatgccccctcgccaatttttgaccatttgtcgaaagaactaaaaaaaatgcatattcgaacaaaagttggaaacaaaaaattaccatgtcgagtcttcgaattcgttccacgagaaaacagcggactgaccacanagctcgaggaaagcatccaattctgaataaatatgactattgttagtaatacaaagcaagtcccaaataaagttaaaattttaatttccaaatttcttctatcatttacccgattcccacggatttgtaggcaatgctttgtctaacgacttaaattgaagcttcacaggtgaaagagccgaagtcgagaaagttgttgaagacatcgaagtggagggagttggtgaagccaatgccgaattttcaatcgagtacattgcgtgcctgctttgttcctccaacgctttggctaatgcgcctgtgagcacaccaatttcttgggcactgcctccagcagaacaacgactgttttccacatcagactggtcgacctgtaaattccatttggtactaagaaattgatacaattatgagggcacattttcaaacttacatgtttgaaggtagtcccttgcttaatctgttccatcatgttgtcccgtaaagtcggtgcgtttgttggcacgggcgttcgttcagttgatggtgggcccactttcttcagtttggtgccttgttggatttgttgcagaaggtcggaacgtttattgttagtcggatcgacgaaagacgcctttgattcagtggtggaaggcactgaattgtccggcagagttggctttgattggaatagtggcggtgggggcggaggaggtggtggaggnaggaggagacgccaccgaactcgccgctgttagcaccgactgtctttgctgcggagatgctaccgaactcgccgcggttggcaccggtggaaactgctggggaggcgccggtggactttgctgattatgggaaaattcaaatcggccatccacccaattgtaaaatacttctttttgctgattaatgaccgtcggtggagttggcggcggcggtggcttcccgcgactgttcttgacttgggattggtgcccattgatggcttgaaaggcggttga

SEQ ID NO: 33039 - DNA, 396 bp, Heterodera glycines
aatgttggtgggttgagtcccagtgattgaaatgctgtgggttgagtcccagtgattgaaatgttgttgggttgagtccgattgaaatgttggtgggctgagtcccagtgattaaaatgctgttgggttgagtcccagtgattgaaatcctgttgggttgagtcccagtgattagaatgctgttgggttgagtccgattgaaatgttggtgaattgagttccagtgattggaatgctggtgggttgagtcccagtgattgaaatgctggtgggttgagtgccagtgattggaatgctgtgggttgagtcccagtgattgaaatgctgtgggttgagtcccagtgattgaaatgctggtgggttgagtcccagtgattgaaatgcaggagaattgag

SEQ ID NO: 33040 - DNA, 854 bp, Heterodera glycines
ctaaagctgatccatgggcagctctctagcactgagctaaaacccattttttaaggagcacgaaattaggggtccgaatggaaagaaaatacggaaagaaacggaagaatgaacgaacggagcacagaaaaggaggggagagaagggaacggcacaatttgacaagaaatgccttcattattttttgaataaatgtcttcagagagagggagaaatagagggagagagaatagaagataaaagagtgagagagagagggagtagggagagataagaaaaagagagatgaagggagtcagaatggaaaaaagagcgagtaaattaaaaacataaaatcattcattgaaataaaataaaaatttattatttattcattatcatttaatttattcctgtcattaagagttatggcccatagggaagtttcttatcagcaaaaggtcaaaccatatttcaatttaaataaaatatgaataaatcaactaaaatatttcattttctgcgttgctaaaaaaattgttttaaataagcacaaatatgtacataattatgttgcagataaatcacaaaaaagatttatgtttgctttttaaacaataaaatattattaatatttttacgaaaattatcttaaaaatatgagtaaaaaattggtttctcttttatgaattaagtttaatgtatttattttaaaaatatttgttgaacagaaaataaaattcgcttttgcagctataataaaagcaattgaaacattccaaaattggaagactttattatattttttgtttttaaaaataccggaacaaaaatcaaaaaagtaacaaattcgaaattgaagcaaattctttttt

SEQ ID NO: 33041 - DNA, 534 bp, Heterodera glycines
tagtgatgctcgagaccaaaaatttcccgagactcgagactcgagaccgagaccgagactcgaccccgagaccgaaactcgaccccgagactcgagaccgagacccaaaaccccgagaccgagaccaaaaaaacccgagacccgagacttttttcaaaaattttttcttacacacttaaaaatcgaaaaaaatcaatcttttgagtttttttctcaaaaatttttgttttttccttatttaagctaccatacatttttccttttcatatgattgacttttttacaccattttttgtggtgctctttttcaaaaaaatgtttcgggaacagggtccggcggtgtcgataggcgccgccgggaaaattttttaaaattttactgcaatttgttaacggattttgtccaaaaaatgaccaaattttgcgtctttgagctacttttttaaaataaaagtaagagttttgggtgccggcggtgccgttaggcgccgccggataaaattttgaaatttttagtgcactttgttaatagat

SEQ ID NO: 33042 - DNA, 795 bp, Heterodera glycines
ccaaaagcaaaggcgttggttgaagctgccgattttccaaggctcgaaatttttaaggatggagggtgggggggggtgcgctgctgaggggaggaaacaaatgaaatgatccattctcaaaaagattaattcggtccaccatcagctttaatgtcgcgcgattcattacatttgataaatgaaggctcttgcaggtccattagtgattggttgttgaagcgatgcacaattattggggagacggcggcggttcagcagagaagaaagacgtataaatttggagaataaattagtgcagttaattttttccaaaccatatgtttttttattttattatttttcactaagaacattaaataaacataaattaattttgaaattttttcatggcgacccatcggctccgccagactatcaaatcagtggagaaaaataaatgaagagtaatggaaagagatatttttaaggactcatataacttttcttaatttgattattaaggacaccgattttgcaggagtgccctattcataacaaaggatgaaaaatgaatcaaatttatatctaataataaacattaatcatctttgccattcattcatttttgtcagattgcccggaacgataacgctggtcccggggcagttgtgtatttttattggatggagggtgggggggggggggcgctgctgaggggaggaaacaaatgaaatgatccattctcaaaaagttactcgacattttcgacatgtccaaaaccggatttactgaccataaaatatcggacacaatctt

SEQ ID NO: 33043 - DNA, 413 bp, Heterodera glycines
ataaaaatcatttttaaacattaaagataaagaatgcttcttaatctaaatgaaaaattatggatggaaatttggttttttatttgatttatttgttgtaaaaatattgttatataattttggaattttagcaaataaatataaatccgggtcctgtccattaatgcttataataccaaaaccaaatttgtaagtttgaatatttctaaggtttgcattttgttgagtatttgatgaattttcacgctacctttcaagcaaatttttatatttaattatcctttccgtattttccactaaatattttagcaataaagaacatttataaattaagtataaatctgtcttcaattgaattaaaatactattaagaagccaattcaaaccccaaaaagtgtcaaaattttttataa

SEQ ID NO: 33044 - DNA, 958 bp, Heterodera glycines
aaaaattccagattcgaaaattggtttcctcatacgttggcgagaatgaagaatttgcgcgacaatatttgggtggcgaacttgagctggaattttccccgcagggtaagtccattttaaagccaaattaatgatgaacacaaattccttattatttaattatagatttgcaaagaacgctgctatttagtgcgtcaaataaaaagccgacaaaaatccgaaccggaaaatacttattaaaatttacaaaatcccagagtgaaaatcccttgcccatttaatatttttaaacttttccacgataaaaattaaaaaaaaaacccgtatgttttcgtaaaaaagtgttaagatttaaataatcataaagagggctgagaattaaatattcgaaaaagtgctcagaataaaattaagatttttttttgaatttttgaagattttttgtataaaaatgtggcagaaaaattattattttgggagacatggattatctggacggatttttgtctgcgtgccatcaattttattgtaccattttaattaggcactttggctgaacgtatccgtgccggtggtgctggcattccggcattttacacgccaactggatatgcaacaatggttcaggaaggcggtaccccagccaaatacagtgttgcggaaaatggcaaaattgaaatttcaagcgacccaaaagaagtgaaaaaaatatttttaatgaaaattttgcaatttaaaagttgggcctttagataaagaaaaatcagaaaatgtttatttttttaaagacacttttcttaggatcatatcaagcacatgagataatattcgtttaatttaaaactcgaaaattgacttttaaaaagtcgttaaatttacagaccatatttatggacaaaattagttaaaaactgcaaaaaaaaaagtaaaaaaaacaaatattttttgtagtccaaaa

SEQ ID NO: 33045 - DNA, 71 bp, Heterodera glycines
attaaatcaaattgatttttattaatccctcagaagtagaaagctgtttctgcacggcaccgaggacactt

SEQ ID NO: 33046 - DNA, 913 bp, Heterodera glycines
  misc_feature (860)..(860): n is a, c, g, or t
agcagcacaaccatcaccagattcagcaaaatgggcgaccgatatgtacactctcttcgaaagcccattttataaagataattagggcccataaacatggaaaatattttggatgggagggggctggtaaatcggttacattttaagatattcgatcactttttaaaggattctaaaggaattagtgataatccgtccggtgatgccgacaaacgccaccgtgaaaaattttgaaaaacggcttatataattttatgaaaatatgcattttagattaccgtcgacgacttcggctcccaccgaggcgctggcgcaaatcgaaacagtagccgccgcggctccatggaatcgtcttccggctttgcatcactcgcctctggccaactgggcgcattggtaatcattgcattgtttggtggcttaggttacgctttaccaatgccgtatcgtttggtttataataaaaagatcacatatgcttattgtatttttgttagcagtaagtgcccaaccggttcaatttacggtacccgaaacttttggccaatttgaaagccatttaaatgggggtttcataaaatcctggattttaattttacgatcccatttttacattgtttgactgatggtggaatggtttcagaacgagaacacgtcgccagaatatttgctgactgtgatcaaccatttgcgcatggaactgctgaagaaggaggagcgcatccgcgacatggaggagtacacggacaaactgatcaccaaggtggacatggaattcaaatgggagcctctttcgcatcagtcaccagggggggttttgccagcgaaaaagcggaaactatttgaaaatgataaacttnagtcccaaaaatctttccggtttttgaaatttgacccagaaatacaattttaa

SEQ ID NO: 33047 - DNA, 717 bp, Heterodera glycines
atgaacggaaaaggcgtattggggcccgctaaaaaagcgtccaaaccgagttccaaccaatcactaatgaccattaatcattataaaaaatagttctcgaggtgcgaaacaattaaaaaatgatgtttcaaccggtttaaagcacgaaaaatttcaccaaaaacttttgaaaagatgtatttcaaatattaatggctcattttcgagtgccccctggaaataaacaattttcctgaaagcaaaatgggcataattattaatttttcaccgaaaagctgcacggcaccgccgtgccttaaaagtacgcaaaaacgggagtaaaaatgcactggtaagaattgattttttttggtaaaaataataatttttgattgaaaatctgttaaatatatagccaaaattccaaaaaaattttcctggcggcgcctatcggcaccgccggacccttaaatcatttattatttcaaaaactggctcaaatttgcaaaaattggtcatttttgaataaaaattgaccattcatggcataatttattaacaaattgaacttatttcagggcaaaatgtcgttgaaattaatttaattttccatgaacaaagcatgaaaatgaatatattttaaaatatttttgcaaaataccgaagaaaacaaaaattatacgaaaaccttaatttttttggttaatatctgttaaaaaatagagcttaaatttcaaa

SEQ ID NO: 33048 - DNA, 439 bp, Heterodera glycines
cgggactcaactctccagcatttcaatcactgggactcaacccaccaacattccaatcaaagggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcattcaatcactgggactcaactctccagcattcaatcactgggactcaactctccagcattcaatcactgggactcaacccaccaacattccaatcaacgggactcaactctccagcattcaatcactgggactcaacccaccaacattccaatcaacgggactcaaccctccagcatttcaatcactgggactcaacccaccacattccaa

SEQ ID NO: 33049 - DNA, 927 bp, Heterodera glycines
ctctagagtcgtggtttttagtttttgaatttattcgttaggaaaagcttacgggccaaatagacagtcaatactcattattatttctatccttcatatatttttattaatatttattttaaaagatgtgttcctttttcatgcctcaacattttcggaaaataattttcacaaaatgtttaatttttttataaatcttcccttttatagtgttgccattgtgtgaatgaataaataatattaaacaatttttattttaattaccaaaaagaaaaatgaaataataattgtaataataataataataaacaataggtgggtgggtgatagtgagtgagtggcctattcgttttgaaatgatgcaaacattaaaatattattacatttacaaatttggttgggacttttcgtaaatggccaatgtcattatggcacaaaaggcggaaaagaaggcaaaaacccttttaacggaatggaaaatcccgtccattttcacagaaagcaacggggaaaagcatcggaagatcaaagccaacggccgacagaaggctaaagtaaatatcaatgagagacaactcaatgaatgaatgataaacttaaaaattaaattaaattgtaaattttaatgctaaaatatgcctcttccatggtcaagtgttgatctggcaccaaatcctccaaattatcgaggctggtcgacaaagggtcaccgccgcatgcgaagttggccaacccggagaactctgtggcgctggcgtgccttaattattaaaatttgaatgagggtggttaatgccagttttcattccaaattttcacctcagattgtctccattctgtgcttgttggctttggcattgtgggaccggcgagggcaaattagcaaatcttgcggaaccaattcacgctgaaacataaaatgaaatt

SEQ ID NO: 33050 - DNA, 464 bp, Heterodera glycines
aagattaacgagaatccaaatccccctccttcgtctccgcttgagcctgcaaatcacagaggcaaaagaaaagtccgttccgtgaatttgtcgtccgtgaaaaaaagacacacaaatgcgtaaaaagaatgagctgtttcgcacctgcacattgcattatataggtagttgttcccttctcgttggtaattagttagaaatttttaagaaaaattcattctttgaacacttgaaaagtttataaaaagggtcgaattttggatccatcatcactttgcctaactattccctataattgtcctatggaaataatcaaatccatagcaggcacgctacaggtgtaaaatttttttttcctttgtaaatttttttaaacaaactttttttgttcaggcatgcatggaggcatcagcaacaaaatgcgaagtttaagcggccttcgttttaatcagaaattaatgttt

SEQ ID NO: 33051 - DNA, 239 bp, Heterodera glycines
tgcggactctacatttttgaattgaaaaaattggctttactctttctttttctccatattgaccatcatactcatactccccccacccttttcttcttccgccacccacctccccctcttgatagtttaaactgaaggcgggaaacgacaatctgatccccatcaagctagcttctgcaggtcctgctcgagcggccgcccgggggtcgatccccgatctagtaacatagatgacaccg

SEQ ID NO: 33052 - DNA, 805 bp, Heterodera glycines
  misc_feature (745)..(745): n is a, c, g, or t
  misc_feature (768)..(768): n is a, c, g, or t
cttattttaaccgcggttaagaaattaaccgcaagacgggaataaggcccctggtaattactcactggtttgcacacatcaccaaagatgccaaagcaacagccaaaaaaagtgacgaagaagccgacattttaattttaaaatgatttgaagttgaaaataatattaaaaagagaaaacatttaaagtctaataaatacaaatgacatttttattgtttttgctttttcactttgcgttatgccgtggtaaagctcaatttaccacttctgcaaatccgatttttacaaatattaattgctttacaactaattcaatacatataaaatattataaagtcagttttttaagattgcgcttttccacagattaattagcccgattccattcctgtttttaattgctgcacatttagttttgattcaccggaaaaaaatgacggtaatcaatgcggcaaaaacgatgcagccgatgccaagcggggtgtgcaagccgatcactccgctcacaacgataataacagagggcctgaattttgcgatcaataataaaatctcaaaaagaaaaatattttttcaactaaagactaactttttgggtaggcctaggcctagtttcaatgtttgacctgagaaaacccactgaaaacccaggcctggatccaagcctaggttcaatgttagacctgataaaacccaggcctgtgccaaagcccatgttgatctattctattgacctactttgngagcacacggtcgggcatgtagntgcaaaagtcgtcgcgacagcattgaaattttgtcgc

SEQ ID NO: 33053 - DNA, 807 bp, Heterodera glycines
  misc_feature (695)..(695): n is a, c, g, or t
  misc_feature (704)..(704): n is a, c, g, or t
  misc_feature (715)..(715): n is a, c, g, or t
  misc_feature (738)..(738): n is a, c, g, or t
  misc_feature (784)..(784): n is a, c, g, or t
tagtgagggatgcgcactgtgcccccagaccaactatgcaccgtttatcccggatggagtttgggagggaatggggaaaagccaaggcgcctttgaccaagccccgaacccccaaacgactcattgactgttaaagatgtgtttattcattcgatgttggatttaaacgaagcgagaaatcggaataataattgaagtctgttccatcactactactgactaactgatcactggggaaagagaaatgcgaagagaatgggcgaagaaacattacaatgagaaaaggaaaaacgtgtgaaaaggataaatgtgattgaattgataatggccaatgggaaataattaaatgagggaaatgcgtcgaataatccttacaactcccccctttccttaggatcgtccccgatccttaaataaaaagtgaaatgaataaatgaatgggtccaaactctcggcttcgcccttcgtctctccaatccgaacttccacggccaagctgcgcattacaataatgagcagcggtccaccttcatctcagatggatggcatgggaaatcggagaaaagcaaccaggggtcattccggtttggggaagagatgtaaaagcatgatgagagaagagagcaagaatgggccagagaaagtgtgaggaaaaccgacgcattttaagaattttgaattgggggaaagaaggncattaacangttcgaaatanagacaaatgaatgataatttcanaagaaatggagaagagagagagtgagaaagagagagtcaaaacaanaggaaagtggcaaacgtgagggg

SEQ ID NO: 33054 - DNA, 272 bp, Heterodera glycines
  misc_feature (34)..(34): n is a, c, g, or t
aaaaaagattaagcgaaatcccataaaataatantttgcatttaaaataaaaagagggaaagccaaggaggagagaaatgttttcaattacatttctaaaaggcgaaattggctgaggaggaatgaatgtttatgacagaagggataaatgggcaagggattgacgaatggggaggatttattaaagtggaaggggaggaaatgccattcactcaatcggcaatttgcaaaataacggcacgaaaatatatgctaaaacggcgggagggggg

SEQ ID NO: 33055 - DNA, 1366 bp, Heterodera glycines
  misc_feature (22)..(22): n is a, c, g, or t
  misc_feature (34)..(34): n is a, c, g, or t
tgcaaggaaaagcaagtacacnaggacacgagcntggcgcaaaatagtgagcaaaatttaattaatttattaaatttttattgcattttaggcctttcattttgtgatttaaatccaggaacaatgaaaattactgccgatgcaagctatatgccatgtaaatttgtgccataataatttaaaataaatcaaattttatataaatgtaggtttggctgtactcagcgaggtatttttaaaataccttcaaaatgagaataaagaaacttttgcagattaagacatgcttccaggaaaagattctcagtgatcgaacaaaataattaatattgtaaattttgaagaataaaaatttaaacttccaaaatatgtgtttcctaattaggccaggattttcctttagaagaaagtttggcattacttcagaggcaattaaattttaaatgtgaagttttttgggtaacattaagtttctgaaattttttgtaaataaaaatttataatctagtttagttatttcttcacgtatttaagcaattcttttttttcatttatttgccaagtcttttcttgcattttatgtcatttttcgccattcatgatcaattaacatttttcgcgccatttcccgactatgcccaaaactgacatttgtgccataatttttcacattttggtggccgaaaataaaatttaatctttcatgaaataattttttataaccaaattaggggccatagaatccgaatatggacttaagtatgtcctatcttttcaacctgagcttgtactgctctaactcaatgcatgaagttggagctcagctgtacaggctcagtgagaaagcagagttaaaatctaaggccatattaagaatcaacgtgcctgaattacccaaaattatgaaaattccttgttttctgatcgcattaaaaaccaacaaaaaaaaatgttagcggtggttccataaaatgctattttttggagaccattttcaaactcggctctccaataattcttttattacaaattaaaattgttaaatgaccaattttctttattgactctaactccttgaattttatgcccgcggaattgatctcttgcctgaaaaatggcaatttgttattttattttaagtcatgcttgtgttttgttgaattttaaaaaattaaattttgtaaaaaaactttcaagcgacaaatttagttgactccctgtgatttattgttttaatcattattaaaatttctttttcgttaataaataaaaatcacaattagcataaataacagaaaagcaaataaataattctatttctcactattaattaaatttaaagcaaacaaaatattattttctgata

SEQ ID NO: 33056 - DNA, 921 bp, Heterodera glycines
  misc_feature (847)..(847): n is a, c, g, or t
cttccgttccatcgtccgccaatgctttcgccgctttgtccctttccgtcgcttcgtttgctttttccaccgtcgtcactttgtcagccatttctctgatcacttcgaccgctttttcgatgttcgtttcgcgtgtctttgaactgcaaacgacgaaacggaggaaaaaagtgcagtgagtgaatgaagcgaccaaatgaacgcgtcgatcgtcgttaatggccaaataaagcgactcgttcagttcattgctggtctcaacataagggacaatgaacaaaggtacgataaaaaactgtgggtcctacagtaaccacggcagggttatcactagacatacagtaaactaccacggcactttttgcccgacaatggcattgggaatggcattagcaaattgacataaaacgatcacttagagtgattcctttgtaaagattaccttcatccgaaagcagactaagcccaaacgctgggggacgaacagctcgaaacggtcgtctctgagcaaaagatcggcgaacattttggccaattcgttttgctaattaatgggcaaaatgttgcaaatttgactttcccaatttgacgcaccattctcaaaaattgttgaattcgctgaatgccaatcgcacgaaacacaaaccaaattttcagtgccctgaagcgacggctaagtccgacttggagatgcttaattaattaaggaaagcgaaaagaatatttgggatggaggggaaaatggaggaatcacccgaaaatcgtacgcatcactttggtgttcatgcttaaggtacaccgcgtcgacgttgaaaatgcgattgcttcgtctccgttttaaacctanatgacaaatgcggggctaggtcgatccaaaaaaaaaactcagtgattgataaaataaataaataaatttaatta

SEQ ID NO: 33057 - DNA, 852 bp, Heterodera glycines
gcccaaataacccctaaagacatattttttgaagattttttggtgaaaaaatttttcaactcaaaaatcctatgctcacccctttggtcccgaataccaaaatcggttttatttttgtaacaattcgtaagaaagtgataaaaatgtaaaataagatttatattttaaagaaaaaaattgcggatttttgtagtattttaattttcaaaaatttcttttcagaagggggttatgaatttttttctgaaaaatcgaaaattttcagaaattctggaataactttttttctttttaagatagaaatcccaaataaatcccataaaattctcctgatttttctctatttttacaatataattgcatgaaaattgatccacccttcgatttgttatgaattttcgaaaattaacccaaaatcccgaaggccaaaaaattgacgaattttcaaaaatttttaaaaaattccaaaaaatctgaaacgaaaaacaaagttcatattcgtgctcagcacctcaaaataccccagaaaaaaaattttcacccccattttcgtccgaaaaaaaatttccgaaaatttctagggggcctaggtcgaaaatttttgaaaattttacatcatgtagtacaccgttcgatagagcttacaaagctctacaattttgctctaaggcattttttggctaaaaccgacccctgacgagttatgggcccaggactcaaatgtcccgctgaggcccaaatttttttctatttccgggaaaaaatcgaaattttttcaaaaatatcaccaatcgatagagctcgaaaaactgttgcttggaagtggtctccgtttctctaggaaaattcgtt

SEQ ID NO: 33058 - DNA, 636 bp, Heterodera glycines
  misc_feature (29)..(29): n is a, c, g, or t
ttttttaataggattttgttcaaatcttntggtttcaatttttattttgattttgattgtcatgcaattttagtacaatgccattgcctattcgcttttttgttcttaaaatatgccagcagaatggacggaatggcaaattcgtttcgctgctcactgccgcccttcacagggaattgtcgccgccgcatttccgacgcttttttgcctcgaccacttccgcttcttccgatgatggttttgttgttgaaaaggtggagaatggaaacgcaaaaaattacgaatccattgacggcgcatggaaatgcacaaagtcagcaaagcgtacagcccatttaaaattagtttaatttcttcaattttccagctgtgctcatctgaattggccccagcagcgcatttgcaaacattgcactattggcatacccaccgaagcgcaaatggcgattctgaaacaattgctttgggtgtgtccaaagttggtaaaaaaaagataatccttcggaattgttatcccgacgcgaaaagggataaaaatcctcttgggcaaaaaatcaaactaaaaattatcttttcatatatttaacagctttcattctaaagcttttaatgcgtttacaccattcagaccaatga

SEQ ID NO: 33059 - DNA, 895 bp, Heterodera glycines
  misc_feature (11)..(11): n is a, c, g, or t
  misc_feature (776)..(776): n is a, c, g, or t
  misc_feature (795)..(795): n is a, c, g, or t
  misc_feature (826)..(826): n is a, c, g, or t
  misc_feature (839)..(839): n is a, c, g, or t
taatacccctngggagaagggagtgggaaacatgattaactttttagtgaaagtttgatcactcatattttttctagtctaatctactcaaaacggctcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaagactttacaaaataatacccctgggagaagggagtgggaaacatgatttcaaaattttcaattttttatagtctaatctactcaaaacggctcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatgnggtttgaaaagtttattgnggaaaaaaagactacaaaataatacccctgngagaagggagtgngaaacatgatttcaaaatttttcattttttctagtctaatctactcaaaccggttc

SEQ ID NO: 33060 - DNA, 621 bp, Heterodera glycines
  misc_feature (569)..(569): n is a, c, g, or t
ttaaatgttatttatgttgggaaagggtcataaatctccattgttctccttttctccaacataattatttactaaaaatcagaaaaattcaataattaaacttttataaaaatttaattagccttaaagttttcaatttaattaacagaaagttttgtccagatacaataaaagtattcattaaagcctggagtccaaaaatacaatttttatttgttttcgagtgatgtcaagtttataaaatatattttaatgaaataaaaataattattttgctaaactttggcagacgcagtgattaaataagtgaggctacaggagtattctacactcgataaaataaattcgacccaaataaaagaataaaacatcaattgacgagataatattaattaaaatgaaaatttaagttgactttttatataagatcagaaatctaatttaatacaaaagtataacgagtccgttaatttttcattaatattaaaaattatactaatattttaaaagttttatccaacaaataaattcctaaatataccaaaatattcaccaaaagaggtcttttnaacaaatgaaaaaattaattaattaaaatcataaatcattttattgatcatt

SEQ ID NO: 33061 - DNA, 318 bp, Heterodera glycines
aaatgatcgaatcttattaggaattcagatttgcttttcacatagctttttttcggcgcgcttttccaaaaaacttttagtgaggaaagaagggggtccggcggtgccgataggcgccgccgggggaaatttagaaaatttgagtgtaatttgttaacagattttcaacaaaaaaggcagctttttgggattactactatgctcaatttgtacggatttttctttaaaaaaggataaaatatgtatcaattaaaaaaaaatatatatgtggatcatatgttgtcgataggaaacacatgagtatacaaaaagaaaatt

SEQ ID NO: 33062 - DNA, 51 bp, Heterodera glycines
gctgcgccgaaccggatttctgcgatgactaccgggtgatgttttcgcaga

SEQ ID NO: 33063 - DNA, 374 bp, Heterodera glycines
tgtttgtgcactttaaaccctttgccattattctttgtcattttgccggatttcgaattccactacttttacaattagcccttgaatttagagattatagtaaattctcttaaatgtatataatttttgtatgttttatcatttttgagcaaaaaggaatgacgcatttcccgtccccccccccacccttttcatcatttgtttctctaaattcagaattttttgccttttcagtgctgatgagtgcctcgtcgtctttggacctataaaccgcgaaccggaggaaaaactgcgcccgtggaaatacgaacgaaaggacagcggagtcaggaaattgtgtgttttgtgtcaatttaacgggtgcactcccgcca

SEQ ID NO: 33064 - DNA, 775 bp, Heterodera glycines
ataacctataaacaagtttatgaaaacctgtaaaatttaaataaacataagaaatagacacaaaaaaacaaaaaccggaaattttaatattcacgaaagcaataaccatttaattcttccgaataataattaattaatattaaaaatatcacggaaatgttcaaccagaaaattatgcaccaatcagaacaagatttttatttagaagtttaattttttttttttagaaaatttcattaaaatctcaaagaaattacaccaagctaaatttatttaaaataataacaaacaacactcaaatggaaataaaacaaaataataataaaatagatttttattaaataataatttaatgtaaaaaacaaaaactttaattgtaatataaataagttattcgttatattaagattaagaaaagaatgaaattcatgtcaacaacgaccaatatagacaatactcaaagaatgagaagaagaagaaaataaaagattaattgagaaaaagttaagtaaaaataaagtataaaaaatttttaataaacgatttaaaagtaaaacttttcggaattctataacgaataaaaaaatacttgaaatttttgccttgtcaaaaaaagcatgcatttttgggccaaaaaatgagtgaaaattttaaataatgattttcattatcttaacctagaaattttggaataatttctattggactttatagagaacacaatgaacttcaaaatgagtatacagcgacttcatgtggttatagttgaaaatag

SEQ ID NO: 33065 - DNA, 305 bp, Heterodera glycines
aaatggaagcgggtgataatgagaagacaattaacaaaataattaattaattaattagtggtgaatcacttatcattaggacaatgaaaaggatgagagacggagaaaaacgcaaaaaaggcaaagtttggaagagacaaaagcaaaaggaatcgatcagagaagagtggcattcttagatcagacttaagcaggttcgaaatcccaactattttgcgaagttgatatcccattctccggatggacgatattggattaggtaattagccgactgaattagcaaatgagtcggtgtttcttccccc

SEQ ID NO: 33066 - DNA, 737 bp, Heterodera glycines
  misc_feature (722)..(723): n is a, c, g, or t
tgtgtgatttggtgcttgcgctttgccaatttgtccgagtccgacttcttcattttgggcagaggcgccaacggaagctgtgcctggaaagagacacaaaagcgtaatgtgaaaaaccattgaaaatcgcaagcaatttccaaggacgtccttgcagggaatccctttggcttttcaaggacaaaaaaaaaatcttggatagtggtttttgtaagatagtaaaagggaaaaggtactgggagttcgagtccactccatgatcaattattaaaaaaaaaattttttttgttccaagaaatgaaaaatgacaatttttgaagaaattgctaaataaatttgacattctttggtatcattcaaaagctcttggaatatctaaacaaatgctaaaattttgacgcatcagaaaacaaagttatgcctttgaaaatttatgtttttttttgcttgctaaaagttgggagataaaaaaaacaaaaacaaaaaatttagataccattcgatgtagaaaagttttcaatcgatatgaaatgaagaaaggtttaaaaaattatataaaatttcaaaatatgaccaaccccccaccccccggttatgaaaattaatacaattttctaaaaattacaaattccagccaggattaaggaaattgctacgaagaaatttcaaattgagaaatttcatgaaattttttttttaaatgacccctcccccccccacgnngacacaaattctga

SEQ ID NO: 33067 - DNA, 796 bp, Heterodera glycines
aacatgtaaataaaatttggtgcgtttcaccactcctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgcccccaaaacaaaaaaaaatctattttttcaagtgtccgtttggggtactcaaacaattatggggagcaaaaatccacgcaaaattaa

SEQ ID NO: 33068 - DNA, 1062 bp, Heterodera glycines
  misc_feature (973)..(973): n is a, c, g, or t
tccatcgaaatggggtgtgacgcattggtcctagtgacggaagagagcgccgggccatcgaatggcacaaaagaaaatgccgaaatggacgaaacgagcgacgggaaagagaaagaaccaatggcaagtgcaaattcgaaggtaatgcaacggaatccgaaggtaaaatcaaaaatttaatcattgaaggacttcttcgagttggaggacgaactttcgaaggcggaaaatgtggcagaaaagcaaacgaaggcaacgcaacaaatggacaaaatgcggacaattttggcaatgagtgacgacggaggaaatcaaaaccaagggtttgccgtgaatcgggagaatctcctgcttattgccgtctttttcccagcgctctctccgaactccttccgattgccatcactttgagacgtctcaatcgcctctccaatctccaaattatggccgcgcgtgagaaaatggtcaaaatgcgcgaatgtgtcgagaaacggaccaacgaattgcgaaatgggcatgtcggagttgacttcgtaaagaaatgcgtcgacctttgcctcgactttccaaggcaattttcaagttgaataatttcaatgttttttcctttgattttcagcccttccgactccgacatcgatctcatccacgtggatcagtttttcactgaaaccaattctattgtgcttccggaatcaattcgtaacgatgcgcaccaattgcgagtggcacgactaaaacacgaattttggactcggaaaaggtcgaaaaaaactaaataaatggtggtggtactgataaattggcaaatttgcttcttcagtttggtggacagagtgaacgaagttgaacagaagaaaaaggccgtgttggaagcgattggtgcggcggagaaagcgctgggaaaagtgaatccgcgggtggacacgctgaaaaagacggccaaaccattattggacatagtagggctcanatcggtcgcactgtccgtacacaacagagaaattcccttccgacccgtgccgataggggcggaaggatttcggggaatattcggcgacg

SEQ ID NO: 33069 - DNA, 1274 bp, Heterodera glycines
ttgaatttgaagtgttaaaaaatgacaggagaaaacggacaacagtgaccacgcctgatgcgcaatggcttaaaaaaagttgaaaaaagtaaaaaaaggggtaaagcgggacaggaaaataagaacatgaacacccgcgttaattatgcgatgtataggctggacgaagccagaaagcaacaatatgatcagatatatattcaggcatgtgagagcaccaaatttcaaatgcaattggcaagggcaatcttacagataaatccaaatgagggggttagaaggatttttgatagagatgatttggtcgcgcattgggaaggtgataatttggaagttggattttgcgcaccactaacacctgaaaaaatattttgggataaaaaaattggtaatgagtgttacgaatggacgccagtttttgcagaaaacacaatattttttgttaaacccggcacaagggagttgagcattttggggaaaaagtcggaatgtgtggaaaatggcagtgtaaaggaaatgcataatgagactcaaaggggaataatccaaaaaatgggtgaaaatattgagaaaattcgacccaagtaccgaaatatacaaaaccctttaattttaaaagccggagcgctttttgaatcagacaatgtgcgaattgaggaaacaattcgtgaatatcgctcaaaaatgaataatttgcccacaccaacattacgtttagtcgaaaaaccaaatattacggaaattattaaattggttaaaagcgaggcaaatgaaacgcttggtgtgataattggtagatccggagattggttggaaatagtaaagaaaattccggagaaaaccaaggaagcattaaattatttgaaaggcctatcatatgtactgattgcgataccattattaattcttttggcattgattggatacattggaattaaatacagactgataatatttgccggggttcgtgctgggtcagtattggcaagagtgttaagagcaataatgggaatgaaaaaacgaagtactagagttttggcggtcccaacagctccggagttggatccaatcgatgaagaagcttatgttctggattatctgcctccgagacgggtagcagcaattacgaatgacccgcggagactcccatctattcgggtccgcctaaatgatttgttaacagcagccttggttgattcatgtgctagtgtatcctactgtagagaaagaacagcaagaaagcaggacttaaatttttgagcaaatgacggaaa

SEQ ID NO: 33070 - DNA, 1317 bp, Heterodera glycines
aaaaaaaaaaaataaaaaaatttaaaaaaacttttttccccccccctttttcccccgggggaattttttttttaaaatttttttttttccccaaaaaacttttttcaaccccccttttttccccccgggaatttttttttttattaatttttgacccctgtttgggttagttaaattaaaaaaaaataaaattttgaaaatcctttttcccccccccttctacgaaagactcagattttcgaaaattttttttgagccaataagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaagttttaaaatttaataattttcctgcaccgaaggtactcactcggcctcttcgcggcctcgtggtgggccttcgcccccccccctcccacgcccttcagagcacgacaaatatttcaacaaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaataatgaaaattttaaaacatgtttccccccccccttccccccgggggaattttttttaaaagttttttttcccccaaaaatttttaaaacccccttttttcccccccgggaggtgttttttttttaaatctcgaacccgttttggaaaaaaaaaaaaaaaaaaaaaagaaaaaattttagaaaattggtttccccccccctccttcccccgggggtttttttttttaaaaatttttttttttcccccaaaaattttttttaacccccctttttttccccccccggggaggtttttttttttt

SEQ ID NO: 33071 - DNA, 904 bp, Heterodera glycines
cgaattgagaaatatgaatgtatttctgcgacgccttctatacttaattcggccataatgggccaaaaattcataagttaagaccaaaagagggattttagtttcaaccggaatttctataaaaatgttcctgtgtaacctatctttgtctattctgataaataagaaattgaaatattcatattactttgcctcccttaaagctttataatgaaagcgtcgttgtctatttaggatttgccgtcgcaattctgtaattccactttggaatccaaaggaatttgcttcgcttttacaaaatagacagtgccgaaatttgtagatcggctaaaccttaactgaaacataccatatcagcgagacgccatgctgatttgttgtaatcataataaaaaggcccttattgtttaattcggcctttcctataagcacaatgtgtttgatgggctctacaaaatattgcttgtgcaaagcaattattttcttggaggctgtaattttctgtagtcatatcggcaccgccggacccttccttccccacagtttctcaaattctctttggataaagcgcgccgcaaaaaaagggtgtaactttcccaaaaaaaaaatccaaaataatgtaaaattacttaaaataatttgatctttttaaaaaatatagaaataaactaaaaacagtttgaaattacctttaacatggttaaaaatttagcctattaaatattttttaaaaaatttattatattttttttttgaaaaattccgactttcgacttctgagttccgacttccgacatttttggggtcggaattccgacttccgacttccgaaaatttttggggcatcggaattccaacttccgacttccgaaaatttttagtgcctccggactccatccctgat

SEQ ID NO: 33072 - DNA, 729 bp, Heterodera glycines
acgaaaattttttgaactaatttattccacaattaaaaacctaaaacttttaattgtatcctcaaactaagggaatgaagattctaataggtggaaaagatgatgtggctctagtaaagaatttcatgcgcagattttgcaccagaaaattattattatttattttttttattttgaaggttcttttggcgtccggctgtgcccataggggaggccggaaaaaatttaaattaattaaattcagggcttcaaactgaaaattttcataatgagcatttggccgacaaaaaaccttcataaaaaattattccaatgaataaaaaaaaaatttatttttgtgatttaagccaattttttaagaaaaataaggaaaatttgaatttaatcttatttcttatttttttggtcttgatgttcttattttgaaaaattttcgatcacaccttagaaagttttaggagaattttggggaccggcggtgccgaaaggcgccgccggcaagaattttggaattttcatgaattttgtaaagaaaatgtgaaagtatgcagcactaaaccacaccacttctacgagatcctttgccctccgccgttcgcttctcaaccgaccgaacggcccgaaaagctcggctcggattaagcattgtaattgtattccatctctccttcacatcatcatgaaaaaacgataaataatttgaacacagacatgaaatagagaaaaaaa

SEQ ID NO: 33073 - DNA, 890 bp, Heterodera glycines
  misc_feature (832)..(832): n is a, c, g, or t
  misc_feature (845)..(845): n is a, c, g, or t
  misc_feature (849)..(850): n is a, c, g, or t
  misc_feature (854)..(854): n is a, c, g, or t
tcattaaaccgccaccgttttgtccctcacggtttcattaaaataatgcgttattaaaaattgtttttattattttaatcatttagcatcattattattttccgttcgtaatccgacgacgataaatactcaaatccaaaaaaaccaataggaaatgttttgtacccaagggagatgagacaggacaaaaaagagatgagataaaatctgaaattgaaaaaaatccctcattttttcatagacaatttcccattaggtcgtcgtcgctcgttcatccaactccaatctgttcatgtactttctgattcttattaacaacaaaaaaaataaataaataaatcccttcaatttttatgcgaatttatattcaaatggactaataaattggaattttaatttttaaatttattgggctaaaacaaatatgctatattttaatttatttgtggaaaatttattttagataataattttatagcggctaacatttatttttgtatttaaattgaaaaacccacaaaaattgtttcgccaaaatgggttcgctttaccgctcggaggaaatgcgattttgccagctgattgttgaacgggacgcagccttttcatgtgttgctgagcttggcaagcatccattcgtccaattcaaagacgtaataataaaaaacaaaattaaatttaaatttaaccaatatatttttaaattaatttcataaaaataattacatttttaaatgtagtgaaatggccgaagttaacgtcttccaacgaatgttcacgaagaacatttcggcgttttgatgaaatggaacgcaaattgagtaatttattngtcgaattttatntccnnattnttttaattttattaaatttgaaatccagaaactttc

SEQ ID NO: 33074 - DNA, 144 bp, Heterodera glycines
cgccggctgcagctggtcggccaggaactggtcgtcgtcgccctggtcgataaggaccggcattttttccgcgccgctggccagcagatggcagctgtcgtactgcagccactggctttcgtcgctgcccagataggcggtgaa

SEQ ID NO: 33075 - DNA, 477 bp, Heterodera glycines
atacacctacaaagtgcttgctacggcatccactggggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgatagaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcggggctc

SEQ ID NO: 33076 - DNA, 1107 bp, Heterodera glycines
atggcgaatgaaaatattttaaattattttaaaaatacaataaaattgacaattaaataatttaaagaaatgaattttccttctataacaatgctaaaaagaaaatcttgtctgtattatgatttattttaatataaaaatataattatgaataatatttaagtgcaaatgattgaaagggtaaaatgtgattatggattttattgcactcttaataatttttttggcaatattaaaaaaataaaaatatttagaattatatttatgattaataacacatcaaacatcaattaaaatattaattaatttattaaaatcatttttgagactgaaacgagaactcctagccatttctcacacccatacttttacaacctctgcttttattttaaaaatatttttttcatttcaactaatccgatagatttaaataattttttaataaaataattcaaattatattatgataaataaaaaatctaatctattactttttgttttagcattttttttagtccaaccaattaatgaagttttaaatattttatttttatgcctttcattttttatttaagacttgggcttatattttttgtaaatcttaacgcgaaaattcttcgtttcacctcacgattcttttcaaacctcccggcagcagggacggatgagtcatttcaatttttgggatttctaactaaaatactttgactgccagcatcattttggatttatactttatttccttactgttttgtataatttgaaaatttcttaataaaaatgcatcctttttggattcatttaaaaccttttccgaaacattaaaaatttaaaaaaacacctgcattaattttacgtttattaacgaaatttctttccttctcaaatggtaattatataatttaacaaaatattattcatttctgacttaaacttgcagccaatacttatgtcaattcctttcttcaccacctaaacagttttttacttttgtgtgtcatctgatcacattcatcattaacaaactatttgtttaataatcgtttttgttttaccattaattaacccaccaaaaattgtcagcagatttttgcacataaaattcca

SEQ ID NO: 33077 - DNA, 1069 bp, Heterodera glycines
ttaagcgcaaaaatatttattcgattattaactttttttaaaatgcatatttgtttttccatttcaaaatctttgacagaaagcataaaaaccaaaaaaaagattaattaaattcatttcattgatatttgtaagaactacgacttaattttggtgtaaaatttaactaagagtcaaaaaggggcttatttttgcccttcagtttggaaaagtttatcttcggcatttcgtccataagtcggcttgccaatccgccgtcccaactcggcacttttctcatccctttgcttacaccgtccaattcactactttttccgtgctttgtcgggccctgatggaaagaactgagttggccgcttgattgtcctatcaatgagtcgtaacttgcacttttgccgattggcctttgccgccgaattggcgaaatttgctgttttgactttgagaaatttggcaaagcgtacgaaaatgccgacgatgggaaggcggaaggtgccaactgatgcttagcagctgcaagagaagcagcagtgccgactgtaaaatgccatagtccctttttgaattttaaaaatggcacttttccccactaactttttggcattttgtctccctccaccgtttctccattatttttcgacattttactcagttgcgacttgccaatgttctttttgtgcatattcactggtgccgcttcgctgctgctgaacctcggctttctcaactcgtgccgcctcagtaacattttggtcacttggtgcgctgtcaattctgagctttgttcggccgattactttccgttttgacggtaaaataccgtaaatcattgtgaatgtttcgagcattcggcgcgtttgggaacatcgcccgtccgtttggcgtttgttccgttggcatttttttgtggcccaaaataatggaccggatgagcagagaaaaagggaaagtttaagaaaaaaaaaggggcgagtaaaaagccatttataaatcctaaatttttatgaatcggaaaagaaaaaaattttttttccattattgttaatgacaaaaacctatggtaataaag

SEQ ID NO: 33078 - DNA, 687 bp, Heterodera glycines
tttctcaaccaaattaaacattcttggtattatttgaaagcattcgaaaaatgctattagcctgcaaattttcaaatatttttatttatgcacaaaaaaatcagagcaaaaaaaagttcgaattactgggtttttgagttccttctggccataacttttttgaaacttaaccaaaatttttgagattttgcaaattaataataaacacatagagctatcgaacaacaccaacaattcttaatttgattgacagtgaacaaagttatggttcaaaaagccttccgacgacgtttcggccgacgacgttttggggtgcaccgcccccaaacaccagcagcagtaggcaaagcaaaacagtgaactttgcttgccttttttccccttccttttatgtttctcccattttttttttttttttgctataaatttatcttttagcctaattgaaaaaagagattaattattaaggctggtaattatttaatgcaaaatttttggcaaaaataagtccaataacgggaaatttcaattttttactcaatttcttcaaaattaatttgctttattttgtttattttttctaaaatgttttttcataccatatttagtctattttcgggtattttattgcttaaatttagacaaatttgaaaaaattttgagaaattttaaacctcaatttgggaa

SEQ ID NO: 33079 - DNA, 872 bp, Heterodera glycines
tcctctccagcagcagaagagcaatagggaacaaacatcctttatgtctttgttttacatattcctctttcttcacctcctttttctccttgcctcttttcttcccttttcctttcttttcctcccccttttccactcacttttcttcctcctcctcccctctctttctcctcgctttttcttcctctcctcctcccctctcttttcttcctcctcctcccctctctttctcctcgctttttcttcctctcctcctcccctctcttttcttcctcctcctcccctctctttctcctcgctttttcttcctctcctcctcccctctcttttcttcctcctcctcctcatccgtctccgcacattttgccaccgccggggcgctgctcaaatcgtaaaatttgcacggccataaaagcgcagcagagaataagcattttttaaatgttacaattcatatcacaccaatgtgccaaaggcgccttttcaaaaaaggaacaatgccaatctttttgttttgaaaactagttttaaaaaattaattattttttgccgattttaaaatcgatcacgcagatgtgtgcattgaatatatatgtatgggtgcaacagcacagaactgaacaagtttgccccccccccgcccttccaattttcaattttgtcccctctctttcctttctctccttttccatttgtcccatttttttgtcccaatctttccctcccccctgtttttgctgctgctgatcatcatcttcggcagcagctgaacagcaaagaatgaatgacaagatcatcttttcaatttcatccatttgttcgccttttatctctttctctctgtccctcctctcttttgtctctctctcttc

SEQ ID NO: 33080 - DNA, 634 bp, Heterodera glycines
taaagtttgatgaaaagatgcccattaatgccggattctccgtgttcagcgcataaaattctgtgggggggggcggtaataatggggaaagcacccaacaccaaccctctaaaaattggtcttcttcgcgtgcctgtaaaaattgccgagtttggccccaatgttttcatataatgtcaaaaatattttatttcctcctttggaaaacatcgctaattcggcgtatgttttccgtttttttttgccagtgccaatggcttctcccccatccgcttgtccttcaattagtgtgcattaatgatgcataatcgtcccattagcgcttcttgcccccccccccttccgtttgttcccctttctaatcacgcgatgagaataattctcgcttcattaatccgtgtttttctcttttttttaaaaaaattgggggcttcaaaaaattgaaaataattttgttattttttttatgtccttttttgccaaatattttattgtctttttgaaaaaatgtgggtaaaaattaatttgaaaaataaatgaaatgcaaattttaattttataaattattcaaaacaaatttttctattttccctcgtcgaaacggaaaactaaagcaatgcaaaaaatattaaat

SEQ ID NO: 33081 - DNA, 1026 bp, Heterodera glycines
  misc_feature (946)..(946): n is a, c, g, or t
  misc_feature (952)..(952): n is a, c, g, or t
atttgaatgtatcaagagaatttttttttatcaaaattttaattttgtaggctaccgaagaaaaaagtcgaaaattgaccactcggaaaattggaacttccacaaccactcgggcaactccgccaaaaacaaagctgaaaactgaaacaccacacgttgtaatcttttaaaaattttgaaaatagagttacacgggtctgggtatttcggcaaaaatcggatccgggtattgacgggcccataaaagctgggtccgggctatgtggatattgtaaaaaaaattaagaaattttttgagaattttattaaaataaacattagttatttttgtctaaaaaatttttgagctttctttacgtaatggtaaaatataagattttcaacaaaaatctttaataaaagtgtaaatgagatcaacatgagaaagaattgaaccatagaaagtaaatattaagtaaattaaaaaaattttctttcctccaactttgctcaacaatttaaccaagactcacattattactagtgtatatttttggacccagttggactcggatctaccaagtcgggaagccgggtatccgggtctggacacggtcgggtacccggacgcgggtatcatagttgaaacttcaactgtcgtaattatttcctcaaaatttaaatttaaaatctttttagccgaatctgttcactccacgggattctactgtgaagcatttcggcacaaattgtgtccaaattgattttccagctgaaattgcccagttttcgctgaacatttccgcctcattattcggcattgcttgtaaacaatacctaaaaaaatacgaaattggacaattgccaaaaaattacgatgaaaaaatggaaaaaaaagacaaaatggaagcgtgtggaaaagtgccgacagagacaaattgcaaaaagtgaaagaaatggaaattanaattanaatcaacccctcgtaattgaggtcatacgaactaatttggatgtatgaaagcaaaagtcagcagaaaattgcca

SEQ ID NO: 33082 - DNA, 1032 bp, Heterodera glycines
actcataaagtgcattagagccgaaaaatttacataattttttcaaaatttttggcgagcgagcaaagcttggacagaaaggcgaataactctcaagggttctctctttttttagttgtaaaataccggaaacttgcccgaaaaacgggggaatttcaaattttcccattccaaacccgtcaaaaaatgttggttccatttttttttcaaaattccgagcctagaaggccaaaactacacactcatataggtatgcggaaacatttgcttccatttgtgggagcattaaatatctttttggtcattttgcccacactttgccaccctcaaaaaatcgtaattaaaaaaaaaaatttccataatttttttttgtgttcaatttccaggacctcaggtcgtcccttcgaatttgttatcggagcggcggcgagaaagtgctcgttttgggacaacaatttatgcacaaaagttgggcaaaatcagtgggcaatgccgaaaaagatggcatgttcaatggcctactgatgggcatggaattgctttccgaaggtttacttttcaaataattttccaatttttatatgccttttccatttggtgagaaatagtaccctaaattaaagttgttccaagaatttttaagcgaataaaatttccaatcaaaaaaaaaaaattctttccggaaaaatgcatttttgatgcaaaaatttgatttgtttggtctcaattttcgggggaaaaaactgaattttccaaagattaccgtaaatgctctaggaatcgtgtgaaattttgaaattttagcgaaattcgctaacaaaatttgtgtaaatttttacaaaaatgtgcttttcagatgatgttctgcttgcgttcgaggacagcactgtttgtgtgttcaatttggccacaaaatcagttgtcgacgcggtcagaattcatttgtttaagtaacaattgttacatttttccacaaaattcaaaaataatttctttaaaaaatccgattgtgagcatttttgagtgttaaaa

SEQ ID NO: 33083 - DNA, 762 bp, Heterodera glycines
attatatttaaatttttaattgggagaatttaatattattgtataatatgatatatttttaataactttcattatttctattacaatgaattgcctattttaacgaacaaataaagcaaataaaatataaaataatttacaattttgccacaatgaacattactggaagcataatactgtaagcaaaccatttttgtacagtaccctttccgacctacaataccgtatacagctggagcgtgcaatcaacgcggccaaacttagcatgactaaacatgcttctgctggcaacaatacagacaacaaaaatacaatacccggcgaaacccaaagcatcgcacaaaatgatacggtagagctgcaccgtatcaagcaacgactgttggacatgttagagaaaattcggcaaacaaaggaccaacaaatgttggccaaagcagcacgacgacgtgaaatgatggcacccaaattgggcacaaagccacagcagccccacttcggctccatgatcatttctggcacgctacaacagcgagaaggtgggtgagttcggcatggcacggcaccagcgaaaaagtgccaagaatccccccaaattcccccattcaaaaacctaaaaaaagagaagagcgggaccgggaccaaaacacggaacatttgagtaccgatgtcccggttttgaccgggaccgggaccagtcccggttttttcccctgttttcccagccaaaatttcccggtttttcaacccgaaaaggtcccg

SEQ ID NO: 33084 - DNA, 274 bp, Heterodera glycines
aatataagtcatttatactacattttaaaatatttatttcaattaatattatatttagtactgacgtattataatactataatatgaaaatatttgccaacattaaattatacatttaaaacgattgataaatcaaaatttatctaaaacatatatcctatctttaataaaaaatattttaccaaattctttataaatgaatataaatattttaggccttatttaattcttattttttgaattcagatagaaatttatatttaaagtgataata

SEQ ID NO: 33085 - DNA, 750 bp, Heterodera glycines
  misc_feature (14)..(14): n is a, c, g, or t
ttattttatttttntggggaaatttcgttaataaatgcaaaaaattgggtgcatattgggaccaccgttcggtcaccagcttggttcagttttttcaaataaccaaaatttgaaaaaatttaaaattttggccgaagaacatcggttaagaattctcgctaaagctttcagtgggttgagttttaccatcaaaaggaccttttcatattttaaggtcttcattagaaaaatatatcgcgattagttctgcgcttaatcgaattttggctattaaactaacaatccttcaaatagagtatgaaatttgatcgcgggttcattccgaccgttaagcatttgtacagtcggcatcgcttacatgacgccaaatctttttaattaatttttatctttatcgaacatttaattgtttttaaataattccaaagcttcgcactctccgccatctttgcatttgtattccttcatcatcgaaattgtgcgacgaaaaaatgtttgcaacctgcaatttttaaggcattctaaattcatgtgtttaaattttttccaattaaatgggttaatctcaatttaaattaaaaatgaaattttattaaatagtttaattttttggaattttgtccctttttcattttatcggtccattaaatttaattactttcacaacatttggacccataatagaaatattgacacgggcagttgcacaccgcacattttaagagataaagtgactttttgccagcgtta

SEQ ID NO: 33086 - DNA, 605 bp, Heterodera glycines
gccgaagggattcgctcggagacaatttgcaattggtcaacaatataattaattcttaattatatttcccaccgataaaactcaatgaatttgccaatgctcgctgatgctcgccgaaccaatgctccgccacttttggcgacaaacacagaaaaaaggactgagacattgcggcgacagtttggcctgtcaaaaataaataaaatgcctttaatttcatttgctcgcttcgcccgccctaataaatccttgaaaatcgacccgtataaaagacgggcaatcgccagtgtttgtccaacgacttaagggaggaaattacgcgcagaatagcgccagccaaattcagaagggacgcaaaatggcactgaaatgcaatcattaaaaagaggaggactttcaagggaaaatgccgaaattagaatgccaaaacgatcggtgacgaacattccgatgagaccggtcaaaacgccaaccaactgaaagatttgtgagctccaaaaatcaacatcacaagagtcgacgacgctaaacagaggcaaaaatattaagacacagtattttctattggttttcgatcactcttcgatttatgttccatattaagt

SEQ ID NO: 33087 - DNA, 602 bp, Heterodera glycines
cgagtctcggtgtgcgcgagggggcggggcgtcgttatgtactgcttgaaatggtgcctgaggcgaaattctttcgtcgttcagcttagggatgggtggattgacagactgtgaaatttgaagtcaatcggacaagggctatgcgagttttagctctcagaccccccccccccccagttctgtactttgctaaacgttaaaattttttttatcataatttaaattgcaaaaatgaaaaaaaaaaaacatacgaaaatgataactgattggtcctcccttttcattgctgattctctgcgtattggcgcaaaatttcggcctcgcgttcggcgcgctgaagaagcgcggcttcgattcgacggtgtccaaaaagaaacgaatctgaaaaatgtgatgaaatttaaaaaatgctaaattgaaaaaaacaagcttacaattgtcgggtcttcacgccaccaattcaagagcaaatcctcttgagtctttttcgattttgtcatactgaagagagatttcattgtcagttttctctaattttgcatcattttgttgcgaaaaatattggtggttgtcgagggatatttttcatctcttccattact

SEQ ID NO: 33088 - DNA, 742 bp, Heterodera glycines
aaaagcatttaattttttaataatataaaaatgaacgttaatattgttgaatgatagataattcgttttcatttcttgtcaacaaaaattaaaattttaattattaatgtgtattgtgaaaaatttatgtgtagaattgaaaatttaaaaaaaaaataaaaaatttttatttatgttttggagactataaattattggaaagcattaaatagggcacaaaatgcaacaaaaagagctaataagtttaaataatgttttaggtatttaaaaaaaattaatttaaataatttttttttggaaaatatgtttttagcagagtgccacgggaccgggaccgggccgggaattcccggtcatccgaggtcccggtcccggattttgaaaagctcaggtcccggtcccggtagggcaaccgggaaaaacaagcactggtaagaatgggggtctgagtgaaaaattagtgatgaaaattggagttaaagtgaaaaaattttaaaaatatattaatatattctttaaaagtaacgcttacaattgtgcggtatcagcacggggaaagtgcctttggatggaccttttatatcatcataattctgaacaaatacctcgagaattccccaaaaaatggcaataaatccgacaaatgtaatccatttaatgcaagagtattttcatggtaacgcaccaaatccatcgcaaattacagttgttggagaagcaattgtcagacgattttttgaaa

SEQ ID NO: 33089 - DNA, 797 bp, Heterodera glycines
ccattaatctaaaaagcaattagcgacaataaaaaagaaaaaaaaatttttttaaaatttgaccaaaatataggacccaaacttaactagtaccgccacggtagaccaaaatataggacccaaacttaactagtaccgccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttttcgtgggctggacattttgtgggtaagcgaaaaatttaagagcaggcagatctttgaatccgtgggtcccactaactttgttcgaattcgtttcttaatttgttttttaaagcaaaccaaatttctgcaatttctttttctggtttacaatgtcggattcagcagacgaatcagcagatccgttagatgctttggtttttatggaacaagccgaggagaacggcagtgatttcagcgacacaaaggaaggaaagggaatggcggaggaaaactcatccgacgagtccgaatacaacgaagtcagtccaagagggaagcacttctccaaatttgttgttttctccattcagttgcaaattgctttcaaagaaggactgctgcagaagcatggcttaaacgcacttcaaacgaagaagcgagaaacaatttacaaaaaggcaggacctttttctatttttatttactttaat

SEQ ID NO: 33090 - DNA, 825 bp, Heterodera glycines
cccctttcgctgatcgcttttcgccgcttgcttctcataatctttgtgcaactttgtcccataaaagtggatcatttgctccatcgtttccggcatttccttctccacaaagtgtgccaccctctctttgtgccattcgacttccttctccaaaatgtcttttcctttggcacttttttgtctctgccctttccttattctcgtctctcccgtgtgtgccaagtattgcaagtccgtgatcacttcgaagccttcattggcaatgttttccatctccgacaaattgatcggtttggccacggccttcccattgtccaatttcaaaattatgtcaaacaattcattgtttgctgccaaaaagaggcgtgtctcgtacattttttcctcctcttcctcagtgtttaggtatattaggaaaaaattggtccaatttcgtagcaaatctgctgctctgtcacgcatttcttaatttaatatgaattcaattaattaatgctttttaaattttgtagtttaaaattttaattaattttaaattatataaaaaattccaacgtaaggtatttatttaatcaaattagtctaagagagaagctagaccccttcgcacttgaaaatgttaagtgaaaatggtatttttattgaaaatttagattttcttgttggtacaccctccaagacacgcctcaccaaaatttcccaaaaaatttcgcgaaatttccgaaaatcctcaaaattgtcaatttttttggtgaaaaatctgttcaaaaaaccgaggtaaaaagctaacaaaaaaaaatttccggtggtccctatcggcacccc

SEQ ID NO: 33091 - DNA, 841 bp, Heterodera glycines
tgagtcccattgattgaaatgctggtggattgagtccctttgattggaatgttggtggattgagtcccactgattgaaatgctgttggaatgttggtggattgagtcccagtgattggaatgctgttggaatgttagtggattgagtcccagtgattgaaatgctggtggattgagtcccgttaattggaatgttggtggattgagtcccactgattgaaatgctgttggaatgttggtggattgagtcccattgattggaatgctggtggattgagtcccattgattgaaatgctggtggattgagtcccgttgattggaatgttggtggattgagtcccactgattgaaatgctgttggaatgttggtggattgagtcccattgattggaatgctggtggattgagtcccattgattgaaatgctggtggattgagtcccgttgattggaatgttggtggattgagtcccagtgattggaatgctgttggaatgttagtggattgagtcccattgattggaatgctggtggattgagtcccagtgattggaatgttggtggattgagtcctgttgattggaatgttggtggattgagtcccagtgattgaaatgctgttggaatgttggtggattgagtcccagtgattggaatgttggtggattgagtcccagtgattgaaatgcagaagaattgagtcccagtgatataatgcaggagggttgagtcctgttgattggaatgttggtgaattgagtcccagtgattggaatgctgttggaatgttggtggattgagtcccagtgattgaaatgttggtgattgaatcccagtgattg

SEQ ID NO: 33092 - DNA, 711 bp, Heterodera glycines
tcaaaatcgaaacttatttaatgtttaataaacatgacatataataccgaaaattcacttacttaacctggatccgaacctgacccccccccccccctccccctcagaatgatgccttagaatccccatttatgcatggattatgaggccttagcgaagtcctaaccaaaatcaaaatttaaattcttgatcagcgctctaaaatgggtcggggtcgtttcggcatcagcccaagttttttgactataacttttttttctttcatcgaaatccaacaatctcggtatcatttgaaagcataaaacatgtttagaagttgtttctaagcgatcgcttcccgattcaacaattaccaaaaaaagttataaattgaaaattgcaaaagtcgaaacttgaaattttttctttataacttttttacagactagaaaatctttttgctttttgtaattactaatagagcatgtgaagggcttttgaatgataccaagattgtttgatttcgttgtaatgaaaaaagtggttctagtcggttttacgcgtcccatcacattttacgcgtcccatcacatttttttgtgtccatggcgggatggcattccgaggccctgaggccactaattttcggaaataggagttccgtgccatccctaactaacagaaaaccgattttttggcgagtatttagtacattttcgagtaaaaatttcg

SEQ ID NO: 33093 - DNA, 880 bp, Heterodera glycines
ttataaacattaatttcaatgtctgtaatctgtttagattttcaaggctgagtaagtcattgttattttccttgtacaaaaatgatttttgaaagacatcagccaatataatacatttttgttcattctgaaaaataatttgcccttgttcatcaataagtgttggtattccggtgttatttttaagcctatttctaacaaatttatagagagaatttcttccatttgaaatacatttagcctcattttcacaatataatttatgagtatgttttttatattccctgcataatattttatatttaattttaagctcacaacactcagcttttccttttagcatgctatgtgttcggctttttcccggactaaggttttcatttttttcatcatgtttttgcttaatagttgttttaagcaatttcatggatacatatttatcaaaaagtttttttaattcagtcgtaaatatataatatttctcatttatgtctgaaactgtaatttgaagggattttggcccattaaattagaaaaaggggagccaacttttacatcataaatgagttccttgggctgactaaaaaccaaatctaaaatattattttctcttgttggttcatgcgttcaatttgccgtgagaagtcgcgcacgtacgccccgcacagccgcatcttagagaaatagagaaaaacgaaagagtggattaggctaggcctaaactttcggctaggcataaggtttaggattaggcctaacaaaagcttatttaaattttcatcggcaagattttggggtgctcccgcgaggcgcagggaaaattagcgggaattcctttttaatttttcaatttgtttctgtttttccctttatggctttt

SEQ ID NO: 33094 - DNA, 1591 bp, Heterodera glycines
  misc_feature (1438)..(1438): n is a, c, g, or t
  misc_feature (1542)..(1543): n is a, c, g, or t
  misc_feature (1562)..(1562): n is a, c, g, or t
cttgacaataataatggcaatttccatgttaagcattggctgaaaaaactgaacagaagcatttggaaggaaatggtgaattggacaaaactgacaatgaacagcatcaattggtactttcataagtttggcatttaaattttttcctaaaatttgaaaatgcgactcaattttatttgaaaattatgaaaataatttattaggacttttatttacatattttgaggttctcaacaaattttatatatttacaatatttcgtataaattactgttaaaaaatatatttatttacatactttttcataattgaaaatgttaaggaattttgcgaaaagtttgccaaattggagttggaattgagcgaaaagcaaaatgaaacacgtgggttcttcttatttaaaaagaaacattaaaattgctcaaaatattttcatgacaatttcataatttaatttaagattttaagagaattttattgttaagtttcgctcggcagaatcgctcaattggtaaatgaggagaagaaacatttggacaaaatcactgctgaatttaacaatcgtcatgaagaacaaacggtgaataattggcattggcaaaaacttaaataaaaataatttattttataaaatcaaaaatgatttatttaaattaataaagtaatttgataagaatttttaaataaggtgcaaaatgagttccgccaaaattgttgggatgccctcgcttgtcacaatcggctgtttattaatggcaaaagtttgacgatcaattacagaggatttttaatgtttggtaattaattctaatgaaaatatttttaaaatttgttttttcaaggctattgttccatcttcgctaaatattccattttgttgaacaaagattgctccaacattttttactttgaaatttcagtcacaaaaatgaaaaggtgaggtgatcagaagaaaacaatgcgtttcagaaagtttggcttatcaaaacaaaaatatggcatgaaagatttaattttttaaactttagctttaaaaaattaaatttaaatgatggatttttataaaataattcaatgactcttaaaaggcaaaaaaaatttttagattttctaccctctccactcctccccgttgaattctatttaaaagcataaaacttgttttgttttttgacttcgaaaacagatgttcaaacttttttaaaagttttgccttttaaaaatttagttttattctaaataattgaaaattttttgccttttcgaaaaaatgttcaaaattttggaaaacttaaggcatattcgagcactgccaattgtgtgcttaatgggtcctggaaaaatgctgatgtcaaattttttcctggcgatgttgtcggatgcggcgttaatttggccacccaacaaattttcttcaccaaaaatggccatcgattgngttaggaaataaattaatggaatttttaaaatttattttagattttgcctttttacacaaccatttgttggatgcgtcttctgctgatcaattgtttccatttnngtatttgtggaattctggngatcaaattgaggcaaactttgggccaaa

SEQ ID NO: 33095 - DNA, 810 bp, Heterodera glycines
  misc_feature (794)..(794): n is a, c, g, or t
ttataaatagaagacatcaaaatcagagtcagtttttataggatagtcaaattgtttcgaagttccatgcttaaaaaatttttaatatttgaacatttataggcattcaaaaaatgtatatgtgaaatctgtcaaactataaaagctcagatttgatcagctagtgaaaactgataagatttttttttattaaacaatagaaataaattattatgcaaaagttaaatagtgtaaagccagaataacaaatataaaaatattttttaaacttttggttaaagattttttaaaacttaatattattttaaaattaactgattcttaccttctactaattccttcaattgcttctccggtcaatgcttttttctgcgctttaatggccgcaattcctatgagcattggcgcagtgtcaaacggttataaatgtattaaaataattttaagttttttccgaataagaacaaatttttaaaccaaaaatttttataaagaaaaaaatattaaatttttgggtcaattttttgaaaaattttaattcttttgggtatattttgtgaaattgtaaaattttttttgggtcatttcttagggggtgtttttttcttttttattgcatttttgttaatgatttttttcaaaaacctaaagtaggcacattagcacaaaaaccccgaaataggcaaaaataggcattataaaagtcattgtagactcctcaaaccaagcggaaaacgcgtttttcatgcttatctttgtgtatcaagtgcgcaaaattttaggcatttgcctanaaaatgaagccatatt

SEQ ID NO: 33096 - DNA, 1049 bp, Heterodera glycines
gtttcggttcttttcgtcgtccattccctcccaccgactcataaaccccgacattaaactccataggtcccttcttccctcctaatgctttatccctattaaatgtgtttgcctcccccaatgaatcagaattccctcccccgggcgtatttccccccccccccccaataatcctccccagggattatgccattctctcccatcagtcgtctctccgtgccgtcattttcttcgcgccgcaaatccgtccgtcgtactctttcattcactcttccatctgtttgttctctctccaactctttttcttctccaattcccgtgccattttttaactcatttttcaaaaataacggaaattaaacggtgctaaacattcgaacgattaatttgttcttggaatggcatcattattagccttttgtcctgggaatcccattgtctctctgagggattaatttttaattaattgtttgttaattgggcgaattgaaataacggacaaagtaaaagggcaaaacattggcaaaatgccactgatggcgagggggagagattttctgtcgtttattttgaaaattcaaatttcgatttgctttctcttagggtttatttctccgaatggccgtctctttcctccacttttcctccatcattctgtgctccgttttggcccttcttctgttggcaatgttttgtgaagtccgtgcggcccccgcggtttaccaaatggaccgaaatgcctttcgaatgagtttcggcaagcgatcgcagcccatggaaacggaaagcagcgaattgaatgtgcgttatttggagaggggggggggggagggaatgacaaattgtgccgatcaaaacaagtgtttttaaagggtgccaacatcgccattccgctgctgtacgatatggccgaggccgaaacagccgcgcaaaaacagcggcacagagtcagcgcaccgtgggccacccggtggaaggtcagtctgttcagcaaacggttggaccgaaatttgtacaacatcggtttcggaagacgacgccgctgacag

SEQ ID NO: 33097 - DNA, 402 bp, Heterodera glycines
  misc_feature (5)..(5): n is a, c, g, or t
tatantggaaatccatatattttttcttggactgtggcgttgcctgaaacgcacggaaaacatgtttctagcttggtttgaagcttctaggatggatttatatatccatatttttccatatttcgcaatttatgtccatatttccatgtttgtccatattttggcatttttccaaaaaacctttattagaacggcccccaacatatgaattgacctttttgatcccaaaaaccggaaattttcccaaaaaatctttttttttcgctaaatttcccgagaatattaaaaaattttaaattttcttaaaatcgataaatttatgtttaaaataagcaaaaagctaaaattttgcttttcggattgatttttccaaaaaaataataaattctagctttatcttgt

SEQ ID NO: 33098 - DNA, 1077 bp, Heterodera glycines
caatcggttatttatttacataatgattttgatatcatctacattaaaaatgaattatttaaaatagattcatcaagcgctatgtaaaaaacgaagacataaatttattaaattttggggcttttttggctttttacgactttgtcagattcattcaatgcctagcatttcgaattaatatgtaattataacttttttcttttaatgcttatttttctttacttgcataacaatgtgccgtccttcagttgtgcttggaagttttcgcgcgttccgttcaccgtcattgtggcaccggtgacctgcttgatccagttgagcaacagctcaccctcactctcgttgtatttgctggcttgctaaaattttaattttatttatttttttaaattttccccctttttcttagttcactttgttcatgatcgaagcaccaacaccaccagcgacacttaaaattaaaattcataatttttgttaaatccattttaataattacctgcgagatcccatgttgttggctctgtgtttacgcacaaattttacctaaaatttattttaatttattaattaattttaaaagaaaacaaaaaaattaggtttgaaatttttaagttcctccgattgttaaattgcaaattttgaaacatttttatctgatccatttgacaaagcattcgcttccgacgagaagctctaaacttgaataaatagcctccttcccacgaattttcgagataaatcccatacattttgtgcccttccgtaacagctgttgcctggagagaatgaacaaaaatcacatgcttattcagtatgctgtgttgagccgagattgatcggaagaatggaaagtgatcagaaaaggtaaaaaaagaatgggtcgaaagtgatcagtgtaaaaggagagacgaagatacacagagagaaagagaaaggaaaagagagagagagaggagagattgagaaagataaagaaaaaaaatagaaaatgaaaaaagagacagagaaaaagagaatgagagatagtgagtgaagaaaagagaatcatcgccgcttccaaggtgatcatctgaa

SEQ ID NO: 33099 - DNA, 615 bp, Heterodera glycines
gcatgcgtggcacccgtgaacagttggaatgggtatgcgtggcacccgtgagcagtcggaaagcgagggcttggcgaatgggcatgcgtggcacccgtgctcagttggaatgggcatgcgtgcacccgtgaacagttggaacccgagggcttggcgaatgggcatgcgtggcacccgtgagcagttggaacccgaggcttggcgaatgggcatgcgtggcacccgtgctcagttggaatgggcatgcgtggcacccgtgctcagttggaacccgagggcttggcgaatgggcatgcatggcgcccgtgagcagttggaacccaagggcttggcgaatgggcatgcgtggcacccgtgagcagttggaatgggcatgcgtggcacccgtgagcagttggaatgggcatgcgtggcacccgtgctcagttggaatgggcatgcgtgcacccgtgaacagttggaacccgagggcttggcgaatgggcatgcgtggcacccgtgaacagttggaacccgaggcttggcgaatgggcatgcgtggcacccgtgagcagttggaatgggcatgcgtgcacccgtgaacagttggaacccgaggggttggcgaatggggat

SEQ ID NO: 33100 - DNA, 1372 bp, Heterodera glycines
tacgttctactcgtgccaagtagaattcaacgacatgccaaaattttttgtcctttctcattgataaagcaactttttggactcgtatcctgtattgttcaactacctcttgtgagccacggatcagctcctccaagttccagcacaacaaccgcttttgcacatcgggtggcaacatgacgaagatcacctgcagttcatgctccaacagcacaccccaaagggccaacacttcgcacgccgtgcacaccaatgagcgcagtttgttcaacgactgtcgttcctgctccaacactgtgaagaagagggagaatttcggcataaatcaagaaaaaatatttttctttgagtgactaaaaactggttgaaaagggggtggtgataaaagtagaaaatatggaatttacgctaaaattagatacattttggatgtcagatagaaattttgcaaataaaaaaacactcacaatttgagtcacccgcgccagcaccttgtcgcttttgttgtgccggggcaagatggaagaacggtgcggcaccaccatgttgaggcgatttgccaccaccgcccgtggtcagctgatgttcgtccatggcacggcgcagtgcggccaactgattgccggcacggctcacttctgctgggccaagtgccgaatacacctaaacaacacagagtccgacgtttttaaaagggccctaggaaacagcattttttcgagaaaaaaagaaattccatcaaccatataaaaaatgaatcacggggtgacaaactgcaaaggtgaaacaaaaatggctattccatctgctaactaatgcattgggttaaatcccaggcattttgtgacgaaaatcttttggcattttccctcaaatccatttaaaatgaaacattggcccccttttttgctcacattgttgctcgactgtgccgtacacagattccgtcgccacacatccttcacaatccgcgcgaacagtgtgtgcaatgactcgtgccgtggcgatggcatcaactgtttttgtatagggaaaaacatgggaacattttttttgtattttattgtaatttggacattgatcgactcaaaagccccgatttttttacacaaaaactaaacatttaggtacgcacattttatggtaactctcgagtttagaaagagtcgagtcaagcgccgtaaaaatgttttcgatttcgatcatttaaaagccactgactgttttctaaaacccaattttacctgtgctccggccacgatggactggtccccgtcaaacgcgccgcccggtgtcaaatattgctgctggtgatgcagcggcgtgtgtccgttcatgtgcactgctccacctcctccgctgctccatgccg

SEQ ID NO: 33101 - DNA, 1196 bp, Heterodera glycines
  misc_feature (1192)..(1192): n is a, c, g, or t
aattcaattttcctcggaattttaataaaatttcatttcccctggaacaaagcaaacactgaaaagccccaatccataggatgtggtcaacctcaaccagcctttgcatatctttaaaaatccaacatcaatacttacctgatgtttctgttattctttatgattttggtttcataatagacaatggccaaatgcgggaagagcacgaatttggcatacaaattttgattggctgaatttaaatttatttaaaaaagttaattttaatctttattgttgctaccattctttcttgcgcgatacacagctttcaaatgattgggttttattaggaagaaatcactgtttacgctccatcggttttttggctaaattacaatttatttcctttaaatttcactcttaaccggattgggcttcttttgtgttaaatttgacccgagcacgggctgctggtgttcctcgtgttgaccaaagtttagatgaaaatccttgaattattatatcattttaatttaaattataaaatccttgtcattttttagctaatagttttcccaaatgtccgaccgtatgcaaatgtttttgcaattcatcactaagaagattcagggaaaagccactgtgccgaaaaaaatcaacaattggttggagcagatttaaagcagccgtttgaagaattatcgcttgtttaagttgtcgctgaaaaatattctattgttttaataatccattttaagctacaataaattaccaattcattttcgattttgtttaatttggcgtccgattcgttctaaatggtgaataaaattatttttgtttgttcaaatattagcgcattgattttacacaaaaataatttaaacattcatatttaatccttacattgtgcttttgcagttgggcaattttttgttcaatttcttcgtatttgacttggaaataatcaatgcccgctgaatggaaattaaatcaatgacagattaattacgttttaatttcagaaatattttctcaccactttcatttttgccattcacaaatgtgcctaaacgataagtgcagaataagaaaataatataaacgtatgctaatagccatataaaataccaagatcagagagatttgatgcaaatatttgaacaaataaggagggcttaatactgacaaattctgtttcattttccgnttat

SEQ ID NO: 33102 - DNA, 926 bp, Heterodera glycines
atttacatgttagtttaggcactctgatgctttttccatcaaaaagggagatgaataaattttaaaaaatttttaattcctttttaaacaggccaaaaagtttaggcttgtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaataatgctggtgtgctaagtgtgaagaactgtgttcttccaggcaaaaaattctaagaaaatttataagcatttgtagggttctcagcagtttccctgcaaaatttggtgagcttccgatcagtctagaatgttgggtgatcaaatgaaaaaaataattttcgaaaaataatacttgtgtggtattaattcataaatatttttttcagaaaatgctctgaaacgcaccaaattttatttacatgttagtttaggcactctgatgctttttatatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaaaatttttttttggcttctcgggccgtcccccctaccgatgcgctcagatttatggggagaccgaatccttcgggaatagcttccctatagcctgtactttaattctgcgttggatttttgctccccataattgtttgagtaccccaaacggacacttgaaaaatcgatttttttgttttcggggcagtccccc

SEQ ID NO: 33103 - DNA, 90 bp, Heterodera glycines
  misc_feature (8)..(10): n is a, c, g, or t
gcatgccnnngcaggtcgttgaaatcgggtgacagaaggcgttgcatcagaatgcctccgcgtcgcggtcgtccagcaggcgttcggcag

SEQ ID NO: 33104 - DNA, 736 bp, Heterodera glycines
accaaaaatgcgaaactagaaaaattagagttttgactttttgttcaaatttgggttcgaattgggtcgaaatggatataggaatcggattcgccgaccgtgaaaaccctaaaatgactttactttgtctaaaaaattgaaattttttttcaaaaagggcggggggggggtaccttttaagtttttcacgtaaaacacgttgtagctaaaattaaacgtcaggttcgtgatcagcattaaacaaatttcacgggggtgacaaaacccggaagtacccaattaattgcccgttttgacaatttccttttgcttcagaggcatttccttcaaaagcatcaagcatcttttatggcgaagtgtattctgtcctacattcaatgagtgtggcgaattccgaaggatttgaatgatcactcttatttgttagctcactcattcttttgttgtacttttattattgtataatatgtaaaatatttgtccaatttatttttcggtacaaatttaggtacttaaacaataaaaaacaaacatttttaaattaacgttatttaaatattcccattttttctaggtcagtcctcggttcccaacaaatttgcgctgtctttggcatgccatcccaaaactttctttacgccccccctccccccaggggttataagctttcggctgtccttccttttttccaatttcttctgttcccgtacgcctttatttccccctccttttaaca

SEQ ID NO: 33105 - DNA, 983 bp, Heterodera glycines
tccagtaaaaaaagttagctctggcgtcccccagggctctgtccttcgacctttattatttttgatttatattaacgatcttcctgatgcgttgccatcaggagtaagaattaaattatatgctgatgatgttaaattgtatatttgttataaagcaagagccgacccagaaattatgcataaagcattgcataatttatccgaatgagcaaataaatggcaaatcagaatcttaattaaaaaaacttttgtacttcatttggggaataaaaaccccaaagaaatatataaaattgatggaaatataataaatgttgtggatacaattagggatttgggcataaatattgataataatttgcaatcttccaatcatgtcacacaaataataaagaatgcatatttgcgtatgcgttctttatttcggattattaagtcaaagtcttctaggatttggattattttgtacaaaacttatgttagacctttattggaatatgctcctgaagtttggaatccatctattcaaaaaaatatttaaaaaattgaaaaatgacaaaaatatttcaccaaaagagttcttttcaaatgcagccttccacccattccataccaacaaagattagaatacctgcaactgccgacaattgaaagcaggcgaaagctgtctgatctgatcatggctcataaaataatttatggccgaacagatctgaatccctttgaaatattcaaaccttctgaacgctttaacattcccttttatagacttaattcgaaatataaactaggcaaaaaatttataccttttgcagggcgggtaactaaaatttggaaccaactcgataaaaggctcattgaaataaactattaaatcaatttaaaaataaaatttaaactatctctattcctgcaaaatagaccggaaaaaaattaaagtcagaatttttagttcattaaaactaaaagtgatttggtcaata

SEQ ID NO: 33106 - DNA, 565 bp, Heterodera glycines
ttatgtcaaaataggggggggggggggcggcgcaaatccctgcggcgcaagtgtcattttggttgggcggcgcaagtgtctgcggcgcaagtgtcggcggcgcaaatgtcaatcacccatccctggtatgtacggtatatatcggtgaagcctttgcatacaatttgtaaaataaacgcaccaccacagcaactggcaactgcttgtgaccatcaacagcagcggaattgcactcaacggcctgtattccggaaaatccaggcatggaaaaaataccctaattggagagattgtaattatatcagggctcggattcgtacttggaagccaagtacgtaaaacactaacaataaacagaaaatagagcaacaaatcagttcccgtaaatgatttattttctctgctatttgatccctgctcgatatcgattttttgcataattatattaattattaactgggaaaataacgtcatagcaccgatggccaatggtgccgccaaccgactgcgctgatggtggaccgtttacgccgttcggagcacgctcttcaaaatatatttgtta

SEQ ID NO: 33107 - DNA, 866 bp, Heterodera glycines
  misc_feature (770)..(770): n is a, c, g, or t
  misc_feature (819)..(819): n is a, c, g, or t
  misc_feature (845)..(846): n is a, c, g, or t
  misc_feature (856)..(856): n is a, c, g, or t
aaacattaagaataaataaaactgtaatgagcttcgttcattaggtttgaatttctgcaaattccaaagttttaaatctaaaatattcattttattaaaataaaatatgctttaattacaatttgctgaggttttttgtcgctgaaaaaaatgatcgcataaaaaattttttggaagaattttggccataaattgggaccaaatcagcgacacgatgaaagttttgagcatttaagcgaagaccaacaagccaataacagcaaaaagcagatttgctaaaaacttttgcgttaatagtaattaaaaggggaatgaatttttgatcacttctacaattaaaagataaattggcatttttttaataaattcatcggcgcctaatagctaggcatctgcgaaccataattttaaaaggtttttctcatttctttcttaaaatttgagattttttgagattaaccacgacaaaaagcacaaaactaatataaatttacaaaatttaaaaattaagaaattttacactaattatgtatttcccaaagattaaaattacctaaatattttgcagcgtactttttcctccaattcggcatttaattggtaatggtccaatttgtcggcaacattttccctttttgcccattcaaataatttatttcgaattttactccgttgaaatgcacaattttcagtgaaattgtcgaactgagaagtcagacccacaatgaccgcgaagtttttatacttttcttcaattttaacctcattanaaagtgtttgccagtttttctgatgttcggacagaattttattacctanaatctttaatttttaaaattagtaannaaatgtctanaccaagtgcc

SEQ ID NO: 33108 - DNA, 82 bp, Heterodera glycines
tgatccggtgcgcaaggcggccgaactggtggcgaaccggtgcaagacgatcaccggcgccaagcggctccctgcggaggca

SEQ ID NO: 33109 - DNA, 1060 bp, Heterodera glycines
  misc_feature (26)..(26): n is a, c, g, or t
  misc_feature (36)..(36): n is a, c, g, or t
  misc_feature (107)..(107): n is a, c, g, or t
aatgttggctgagcaactcagaaacntgatctcttnttctccagaagggctttgtgctctttgctcaacatttgaatgtccatggccaatttggaaatctccagccntaatccgttccacttctttaagactatctgacacactcaacgacaacaaatccgcttgttcctattaaacgaaatggtattttatgaaaacagttccccccaaaccgaatgttttttttcaaattaagaaattaaaagacaatcatgaattttttaaataaaatttcatgataaattttttaaaaatttccaacgattttttgacttttatttctccttgaaacttacttattattagtaaaaattttcttaagattttttaacctcttattggtgatgggaaatgttttcccccatatatcgtaaagtgtcttattacgaaatatgttccatgcaatattaaacatattttgcatttacctccaaatttatcctttcccgttcaaaattgcgcaatttctttgccaagtcaatctttgaacgttttctgtcaatgtatccgcccgtcattggtccacgacgactcacttgatcacctatgtttcaatttaccaaattaaatatgattcaaaaaagtcatgaatatcaccgtcaagagtaacacagtcaaatcgttcttgtttcgcaacccgagaacctgccgcaagatcacggacgaacacacaattaccaaagattgagcgaaaaacgggctcaaagttcgggtcgtattgaagatggtccaggatgggacttgcatcctaagagagacaattcatttttcagtggaattaatacattttttaccgcgtcagaaaccgggcggcgatctttcacaagcacacgattaagcggataaaagttcacttccccggggagccctcgttggttgatacgctccaataatttcatcgccacgcggtcgtcgctgaccacgtggtaaaagaggcgcgactcggcagtcacttcaaccgctttgatgtgctgactttcgtattctgaacaagtcaatcacacagccttgaaagaggaaa

SEQ ID NO: 33110 - DNA, 839 bp, Heterodera glycines
ttttatttacatattttagtacatagttaggaggctttagtacatatttcatacatattttagcatttttttatacatattttatttacatatttcgcgatttttcttacataaaaaaagaaaccctgctgatcagcactgaactgttattaacttttgatttccctccaaaatcgtattaattaatcgcccctggcaaaggtcggccccttcaattaccgcgtcgtgaacaaccgcgacttggtgccgcatatgccgcccctttggttcgaagggtaccgccaccatatgactgaagtgggacattcggcaaaatgactttaaaaacaaatgctaaggttttctataacaacgcaaagaacaaaaccgaggaatttgtcatctgcgcggatgaagccgaatcggaggaatgtgcgggaaaatattggtaagcaaagaaaggcacaattggaaaacaatttcaaaaaatgtgccaaaactgttgttcaggttctacaatgttcgggaccatttgaattattttgggaaatcggtgtccgaatggggagagaagggatgtgccaactgacagaaaaggacaaaaaagaatgaatgaattgtgcaattaataattcactaattgtagtaacaaaataataatccaaaatatttttttattttttattattattatccgaagaatgaaacttaaaaaatatattaaattttaagggctctttttgatttgagtgggccattctcagctgaacatctgccaaatgatcccaaaaaatgatcatccaatgctttatcccctgcttctcccccccccttttgtcctctgttttttcgatttgttt

SEQ ID NO: 33111 - DNA, 917 bp, Heterodera glycines
aatgtaaactccatttttaattacgataactaaaacagagttgagaagcatttttattcactgttcataaatacaaaaaaaaaaaaattgaatcacaacgaaaaaagcaaaaatatgagggaaagagagacttttttttgttttgtacaatcaaaataatgggcaaagagtgaccaaattgtgattattattaccagtgttatttggaaaactcataaatggaaagaaagtaaaaaacaaatgaattaaattggacggaaaaacatcagttcgaattggaaaatttaaaagagaaagagagagccttttatttaggtattagaaatttatttctgagaaatatttaaaaactaaaaaagccgatgtgagaaaaatcatcaaaggaagtgcgacttttcgcctttagtctgacaataaaaatttcgctaaattcactaaaaatcccagcaatttttggcgaaaatctgtgcaaatttcaattttttcacggcaccgccggacggaccctcgtttccccaaattaaaaagcgcgccacgactaaatggcgttaaaagcaacaaaaaaaaagagttggtcgtacacgggggcggtacccgctccaagccgaaaccctgggaccgctcccctggggtacgtaccccccccccccctctcccgaccctaaatttaccactaacaaaagaaaaaagtgggagaaaaaatgtttttctttagtataaatttcacagggaatcgggagaaaaagcacagcgaatgaaggatgaaaatgtcacgactggtcaatgctgagggcggtcagaatttgttgacgtccgaattttgagacactgaaaaaaacgaagtaagcaaatgaataaaaaatgccataagtggcgaccatactcgagtacagaaaggatgaattcgctggcgtcaa

SEQ ID NO: 33112 - DNA, 855 bp, Heterodera glycines
cttaaaaagtctacaattttgccctaaggagttttttcgttaaaaccaacccctaacgagttatggacccgggactcaaatgtcccgcacaggccaaaaattttttctatttccgggaaaaaatcgaaatttttccgaaaaaaataccagtcgatagagctcgaaaaactatgttttggaagtggtctcagtttctctgggaaaaatcgttaaaaaatcctaaaattcaaaaacccgaaaaccgttttttaggcttagctcgaaaaattttcaaaattttcgaaattttaaaacttggttggatagcctttcaaatactacacatttttgctcagaaacaatttttcggtcaaagcaacccctggcgagttattcgcctggtactgaagtgtacattttgagcacacttcaattagccaagcgtgcaggccagggggtggctctaataaaaaaataaaaaataccagcatgtagaggacagtggtggggagtgccctcacagcgggcactttttgattcgggtttcagaaaaaaagttatgggccgtcaaacgcaagaaaaagtgagaaatcggtccccgggactcagtcgtccgcgcagaatttttctctatagttttcccgaattctcctcaaaaagttgtaagacccttccactactttcagacccgtcccattagccgttaagctcaaattagtttttgaaacgaaactccttgtcaatataacgtatatataactagggtggacagttggctatggtgtgcatacgtggcttggtaatatatggccctcatttgttattttaaaacatacaaaacattaattccattagtgtgatgttttaaagcgctat

SEQ ID NO: 33113 - DNA, 995 bp, Heterodera glycines
ttaacagtcttatataatatatatgagtttagtattcaataatttattgattgcttttccattggatttctttactccccgtgaaattacgatgaattgacagtgcataaatgaagccctaaaaaattgaccaagggaaaattaattttacaagtgggcgaggtgtgaacgttcctgttgaccagcaggacagtggagaagtagaataagtgttaattaacaattgatggtgatcatttttaagggaggagcttgttgttgatcgatttgggcggaatgacgaggagagtgaaaaccaatgcagaaaatgggagaacggcagaactttcggattttctttgggtggataaattttatctttttctttccgtagattagcttttttttccttcgctttttccctatcgataaatttattttgaaatcatttcgttgttttaattatttactaattttttctgaaaataattttctcggaaaaatccttaaaaatcttcgtgttttattcagggtccgcattcggtgcccaagtttaaagtgtctaatattcggcttccatttcgcgggtgcccaatttaccctggagccagtagtggcacgatgggtcattcttttttgaggtttttggccataacttttttatgtctcaacttaattctagcagactaatattgactgtcaagcgctttaaaatcttatcaagcttatttaatttggatcagaaatttttttattaacgcttgttaggtagcaaaacacacaaacttaatcaaaaaacttaatcttgtttaaatcaaaaatttaattatgtttatattttaatttaatgaaattattaattattttaaactttttcggataagaacaattttatagcaaaatttatcgagaaaaaaaattctattttcataaatcaatttttgtgaaaatttttcaattcttaggtgggtattttttgaaattgtttcatcattttcttacgggtttttactttt

SEQ ID NO: 33114 - DNA, 989 bp, Heterodera glycines
  misc_feature (883)..(883): n is a, c, g, or t
  misc_feature (924)..(924): n is a, c, g, or t
agcaactaaaaaccaccgctggggatatacgatcttttttcctaaatttttcagtactttcctgttatgcgactacaagccaaaattttaaaaaaacaacaaaagggggcgcaaaaggcggtgaccaccaataaataaaatgggtgatacaatccaggggaagtcttgaagtcaatacacagggttttatatgcattacatgcgcgaattttggtttgtagtcgcataacaggaaactaccaatttttcaaaatttattatatgtacaattgatttattatatacgcacaggtcgttcgccattaattgttgcgtgtttggttggacatttgcaaattggtaatttaatgaaataattattggagcaggattttgtgctttttgaaaagggccgatatgaatttttattttaatttttaattaaaattcaattatttctttttttttaattctggtttttccaaaatttctcattcttaaatttataaacaaacaacaaaacaactttatgaatgccgtcaaattcccaaaactttaaccttaattaaaaatattaattgttttttaagccaaatttcttgtggaaaacggcgcggacatcgaagttgtcgcttctgatgggcttactgcggtgagggccgcaataataaaggacagtgttgaaattctcaaatatttgctcgtcaacggcgcgcgcattgaccgctgacgagtttttaagaacaagaactttattgatgagtttctaaactttgggataaaactgagaatttgtcattttacccatgctcataacttgaaaaattagctggaaaccccgccgaaaggtgtttttacacttcgccttaaattttattccagtttattttatcgaattggtcgnaataataggatgaaaataatttttagccccatttactaatngattttttgccaaaaaatgactacccttttctttttatttatttattttattcaaaaaataaaaa

SEQ ID NO: 33115 - DNA, 644 bp, Heterodera glycines
aggattaccaattgacttttcaccccaagaaaataacagaaaatttccaattaattagcaagtgcttaagccgcttagctgcgttttgaatccctacagaaaatgaattcgaattttatttttgaaattgcttcgaaaggattaaacactcactaccgtacccaatcacttcaaaatgtttggtgggtttcctttttccgccaaatcccttcgttgcatttgttctttttttgaatttatccgtgccaaagtcgcccaaatgccgtcgtcgtcccctcgcgcgccctttgccttttgctttttggcattcgctgtcctttccccattgcccctcctccttttgcccatgcttttcgctccgtctctccaccaatccgtcggtggcatcgctccgtccaatggcaccgctctctccgccacttttcctcctccgatcggtccgtcgatcagttccaatgcttcctctcttgcgtcggttggccttgttcagctgaaaatcggccttctctttgtcaatggcagccaacggttgcgaatgcttttcggctttggccaatccgcgcccgccgtttctttggcactcgaaagggcacggcaggaacacctcatcgacaacatcaacttcacgttggtcgggcaataga

SEQ ID NO: 33116 - DNA, 1081 bp, Heterodera glycines
ggtacatcgatcacttcgttatcgcttttcttcgttccaatcaccaaattttcgacaaaagaggcaccaatttacagttgtttattcctccttcatcggtaatggatggccagccaatttgggatgttttggcccgtgaaatttggccaatttttgcatcaaacattcgccatttgcgctttaacggtgatgatcatttggacaatttgcgtcgtcgcacttcgccgacaattctcaccgatctgaatcagttggattcaatcgattcatttgatctgttgcccgctgcgtttggtgatgattttgatgggccaaattcaacaatttctgctggccaaattctgtccaaatggttgcactctccgagaaaagatggccaacccaagcgattgagttgttataattacaacgaacaagggaacaccaattgggtcaacaatttcaaggaggtgtggcccaacattttcaacaatcactgatttttaattgccttaatttttgttttcaatcaaattgtttttagcattttcttcgtgccaatgccatttcttccgtcagttaccaaattcatttttctgttcatcggtcaattccaatgatgccatttgaattggtgaacgaatcgacaaaggaaaagctgacattggccaaagcaaaggaattgggcaacaattggataatgaaacaatgcaaaattattggggagaaagaggagaagcagcagaaaaatgaaaatttggacaacagttgtaacaatgtggtcttttggctttatatttgcaataattgcattgggtgagcaattaaaaaaggcatttaattttgtttaaataattcaaattgcgcctaattaaggccattgtctccgccaccagcagaagaagccggacaaaacatcaaaaaagtggcgttttctgctgacaatgaatgagtggtgggcccagcaaaacagtggttaacagaagaagaaataattatttaagaatgatcgatcgatttcaaatcagtgatcaaatgcaattttatgaaaaaaaccctctcaatttggtaaataaatccgaacgtataaaatggccaaaaa

SEQ ID NO: 33117 - DNA, 1457 bp, Heterodera glycines
ttatttcgaattattgttattttctcagcgagaaatcttttttacaccctaccgtaggggacagtccaaaattaataactcttatgaaatatattatacacactataattcacatcgacaattaaatgaaatattttatattccatttaggagggattaaatttaaaaaatcttaattcgttaaaaaactctaaataaagtaaatttgaaatttagtagcacaaatggttgtaaattacgtgctaatacttattattttaaatatatcattattcaagttcaaattaaaaaattaaagtaaaataataactgcaaaaataatgtgttccgaacacaacaatctttcaaatattcaatctaattaaactatttaaacaattatttcgaattattgttattttctcttttcttataagattttataaattcaatttttttatatttattatattctttaatttttaattatttttcattacttttgattctgtccttaaatttcaatttttttaaattaaatatttccaatcaatttccatgtggatcgattaaagggaccatctccaaaaagacgatggcagcgcaccacctccccactatccgcgcggattttacattttttatcatattatatcttccattccccacaacttttttttaaaaattatctgtagtcatcaaggttttaaaattaaataatttgatttcccgctctaaaaactaaaaaatccgacatttttcatataaattttgtttagcatttttttcgcgcactctcaccatttttttatgttccacttttaaaatatatgaaattatcttttctaatttaaataataatttttctgttaaattcccaataaagtttttttatctgtacagttcccaaatggtttattatttagagggagaggcaaaaatactagccttttaattgtttattcatcacatggaaaaacggatatgagagaaaaaattttattacagaactaaaaaaatatcccaataaaattatttataatatttcgtgtttaaaaattatttgcgaaaaaaaattattaatacaaaattattattttgcgcattttcatagtcatttatttcccgcactaaaaattatgttggacaaaacaaccgagggggtttattccaaatcatttttcttgaaaaaaaattttattttttcgattattgttgcatttacaatcgataatttccgttgatatctattaactggggacacaaaagcaaaaaaaaaaaacggctgaacactcgcgcagtggcgcaaaacatacccgagaatatcattaggctgggggttttttgtattacaactaatggccggggatccctttacaatttaatcatttttccttcttttagaaattactctttttctctgtttctctcctctctcctatagtgaatgcgcatctctcttcccagggggggccaag

SEQ ID NO: 33118 - DNA, 525 bp, Heterodera glycines
ctgtgaattgacggaaatgtaaaatttgaattcatcgtcgtcaataatactggattcaatgtgtccgttaatgaagttaaggactgtgcctacagtacaccacttccgttatggacaatacaatacatttcggtatgtattttttaacgatagaatatataaaagttatatttctggaatatttattaaaatatattttgtaaataaatttaatttatatgttaaaaaactttttggtaattaaggttggttatgataatgcatcctttcatccgcctattatcacctgtcacccgtcaaaacgatgttttaagccaacatccaataattccaatatgtttatggaatttcccgagaagaaaggaaacaattgaataattgtgtaaaaaactactattataattattttattttactttatttataaaatttttactattttagaaaaataaaatatttatttattattcaatttgataacgaaggagaagtgtaggatggctaggccgtatcgtatacttcgcc

SEQ ID NO: 33119 - DNA, 58 bp, Heterodera glycines
ccttacgaagtgtcaagcggcgccagcggtgcgaccgccatcgagttcaaagaggcgg

SEQ ID NO: 33120 - DNA, 1015 bp, Heterodera glycines
cctaaacatttcgggcctaactttctttaaacgcaacagattttactgaaattttacagacgaatagaggactttttggggtaccgaatgataccaggaatgtttgattttgatgcttctagaaaatcactttgctttattcccccgaaacattggtcccccgtcgtgttcatccgcagcagttaaatttggcgccgttgttgttgctttggccaaatgaaaggcgtaggtggaggaaatgtgtgggtttggcctccttttgccatgctcacactcttccatggtcatttcgtggtcaccaccagccgatgactcacaatcagacgacggcaattgggcggaacggaaaactgcagcaaattctgagaaaaaacactttgcaaataaccatttacatattttaaatttaatacttacggaggtcgaccccctcccccctccactttgcccacaaagtgcctcaaaacggataccccccaatttttcattaaaaatttttcaaaattgcaaaatgcagtcattttttggacaaaatcattaacaaatcgcaataaaaattacaaaaatttttcccggctgcggcgccgcatctccctgttgcgcaaaagttttcggaaaaagtgcgcccccaaaaaaggcagttttcaaaagcaaaaaataaaaaaggttgtagatttaaatggccggaccctttgcaaaattggccgctgaccttcccccctttttactgtatgatctaattagtagtaatttgtaaatttaatctgcccccttaacctttttgtccatctccgccaaattcggctacctcaaagcaccggtcgttgaaagtgctgtggaaatgactcttcgggatcagttgcaacacggtcggactgcgccataattttgcaccaaattcgggagggaattgacgacaaattggcaatgatttgatcaagcagctcttgtggagcattttgccggtccacaaaacgcgtgcacgccaattcgacggttgacacgggcgcaaaaa

SEQ ID NO: 33121 - DNA, 646 bp, Heterodera glycines
ttttaagtttatgaaattcgctaaaaagctaaaaaaggaaaaagtgagtgtcgattttgtcctatttggcgaggccaccgccgagaacaacaaaataattgccgattttgtggacattcttaacggcactgaagagggaggagcctcgcatttgttggtcgtgccggttggagacaccaaactgtacgatgcattgcttcgttcgcccatttgtgcgggtgcgggcgctgcggtaggcgcagtcggagaatttggcatcaacgacgaggacgacccggaattggccatggcattgcgcatttcgctggaggagcagcgtctgcgtcaacagcagcagcaaggcggcgaagggaggggtgaggggcggggacggtcccaggatttcggcttgggggggtacctcctccctggcgacgatctttttttttcactccactttatttttgcgggcggtttttccaaaagacttttggggaacaaggggtccggcggtgccgataggcgccgccgggaaaattttttaatacgatttgttaacgaattttgtccaaaaaagagacgaattttgcgcgtttgagccatttttaggaaattttaatcaaaaaaatgccgatttttttgaacatttagtgaaattttttggaaa

SEQ ID NO: 33122 - DNA, 353 bp, Heterodera glycines
atttgatatgaaactaataattgtttcgccgttttttagccgtttgaatttcggcacttttcacaatgattgcggcattttgttcgacaaggacggcgggcagtcgaattgtgaagggcattgtttgctcctccgatttctcctcccattcgctgtgcggtccgccgctgatccgttcgccctttgacaatccgttgcgccgttttgaaccgcttacacccaacaaaagcgccgacggcacggccgacggtgttgcgtcattgtcagccgagcaaagtggcacggtgtgttgttgtttgttcatagtttttggcgccaggacatggccatagaaccaaccccatgggttcggg

SEQ ID NO: 33123 - DNA, 169 bp, Heterodera glycines
cagtttcactcttccaggctggagtgcagtgatcatagttcactgcagcctcaaattccagggttctagtgatcctcccgcctcagcctctcaagtagctaagaccataggcatgcaccacaacacctggctaattttttaataaattatttttttatttttgagacaa

SEQ ID NO: 33124 - DNA, 988 bp, Heterodera glycines
gggaatttcgcgtgaaaaggcacagttttttatggaggtaaatgttagaacagaaaacgaatttaaataaaaacagagtataaatttaccaactattacggtaactctcgtttttatatcgtaagacccgacggatgctctgaaggcaatacggcgccaagatgcgcgaattattgtcggactattttatgtgaccgaagtacgtcctgacatttgctcatatgtttttttcgtcaaaatgatgctcgagagtctcgataagagagttcaaaagtgttaatttctggttttgaatgtgaatttgggcctgattctctgtcaaatttctcaatcaagcctcaaaaattctcaatgcgggcacaatttaattagcctcaacccattcattttcattaccattttaaatttaggcacgccgtgttctctgccaagttcaatttatttaaaaaaacagtgttttcaagcgaattttaggcatatttacatggtctttatggacgaagatatggtcagtgcaattaaatgcttcttaatctatctgtaattttggtcattccgctccaagtttggtttatgatcggatggtattccgacgcgtggttcattccgcccgaggaggaggcgttgaactgctcgcgcgcacaaatggaacgggccgcgcagtttcacttcaccacggagagtgtgatgctgtcgcgcgacttgcagccggcgatctctggcatgacgggcgagcaatttcagacgcgacttcgccgccggatcagcaccgacccgcacgaaactggcggatggcccgaggcgccgctggcatacgacgctgtgtggtcagtgtgcttttcattccgtaattttaattaactaattaattgaccaagggcattggcactgacgctgaactgcacgatggggtcgttgccattcggcgtcaactctttggagcagttcacgtacaatagcactggaattgcgaggaaaatgttcaaat

SEQ ID NO: 33125 - DNA, 946 bp, Heterodera glycines
tgaggtgtatgcggagaagctgcagaaggacaaccacgcatttgtcggcacataccgggtcagtgtcatccaaaattccagggaaaattttgaaaaaattttaagcgattttttttggaaaatttttaaaaaattagggtaggagacgttacgggtggggggagacgaacaaatgtttgttgcaattaatccttcttttctttgtatgattcttttttttttatttcttgcccattttcgttttgttttttgttcccaatttcaaaaaattttttagcagattaatgcggatgattgttcccatgacgggtctctatctgtggagaatgtgctgtgtgttgtcggccaacacagtgttggcaagcggtacagccattggactggtggtgtacaccgggcgggagacgaggtgagagccaaccgacaccaatttttctatacaatttttttgccaacgtttttggttgatgccgcctctatcatttacaaataaattcagatcggtgatgacgacattgcctgacagtaaagttggcctgctcgatcgagaggtgagcaaaatttgggggaaaatgttttaaatgttgaataaggggctacaaacaaaaggttacccgtcaagatttccagtaaaaggcccggtattttgaaaaaaaaacccaggctatttaagacctggttttccgagtcgaacccggaaaatttgcttgttaccccaccaaaattatcattcatttcgttaaatgagtccccccccctgaacaggcgaacaactttaccaagattttcttcctgttcgtgctcactttgtccactgtgatggtgctgatgaaggggcagtggacatgcaaagaggcagagacgcgggacgaaacaccgccggcggcatgcggcacgatcgcgatgtgtccgcgtcgtttgatgatgacgcgaaatacttgtacat

SEQ ID NO: 33126 - DNA, 988 bp, Heterodera glycines
catccctttccatccctttaccccccccccctaccttaccccttattatttgttcttctccgcttgtccacccttctccattttgtgcccatatgttttggccatttgcatttggctgctgtgatccaaaacatttgccaatttgtctttttaatttatgaaaaatggcgctaaaggcaaaggccaataaaatcaacaaaacggcgctgaaaacaatgtcggcaaatcgctttccccttcgttttttcttcatctttttattgtcaacttaaaaacatattttatctttttacatttttggcaaatttaggctttctcaaaagctcttaacaatacaaaaaaatcaccagctaagaattttcaaaaatgaatctttagtgattttttcaaaaaacaaaaaagttctaccgattttaaaaccaccagttttttaaaacttatattttacgaaaataattgtttttgatggataagacagaaaaataattttctacctttctaaaatttaaattacagaaaaaatgtctctcgataaacataaatttatttgttttcacttacattccaatgccaagttgccatttgtgccgttttcgtcctccaccaccttaagaaaaagttgcaagaatcgctgccacttggatttgctccattgctggtcacttttctgttttttatctcgcttttcatcgatgtaaatttttataatggttgccaatgcgcgctttccactcattttgtcatttgttaacaatttttcttcgggaatttgctggcgttttgcccaaaattttacaataaattttaaatattttttcagcgatccttgcaaaatttttcctgaattgttcagcacttaaccgaaaaaattgccgaattttatcgccatgtgagatgaaaactttacctgacattgaatgtaaacttttcgatcacttggctcagtgccggatcgttcgctttatgcctataaaacgttcatattttt

SEQ ID NO: 33127 - DNA, 932 bp, Heterodera glycines
ggcaactcatccacgggcaactcatccacgggcaactgatccacgggcaactgatccacgggcaactcatccacgggcaactcatccacgggcaactcatctacgggcaactcatccacgggcaactcatccacgggcaactcatccacggacaactcatctacgggcaactcatccacgggcaactcatccacgggaactcatctactggcaactcatccacgggcaactcatccacgggaactcatctaccggctactcatcaacatttttattgaataaatattaaaataaaattgatagcaaaataattgcttaaaaaaatattttcgattcaagttattgttgggcgtttcttaaaaactgccatgtgggcgagaattaaactacaaatataaaacaactatagagaaatatttttaacaaaattttattgatataagtttttatacatccgtatttcttttttaatttcttattctttaaagtgttcgccaaaaacatgaactggcaagcataacgaattctaaaaaataaactagagtgccacgggaccgggaattttgggcaaaccaggatgcggggcacgggttgactgtgctcttaggtatgtataatcaatgtagaagaagactatggaaattgatattttctttcctggagtgtgggcggctgaatagagcgcaaagaacgtgatcctagcttggcttgaatcttctaggatggacttccatatcaatatttgccagatttcccgatttatgtccatatttgtgcgtattatgtcatttttatcgatacatattttatgtgcatatgttgatgttttaccaaataacctctatgagaacggtccccggtagataaattgacctttttgagcgcacccaccggaaaattttccgaaacatcattattgcgacaaattttct

SEQ ID NO: 33128 - DNA, 969 bp, Heterodera glycines
aatatttgcttaaataaaacttaaaaataagataaagaaccaaaagatggatttaaaactaaaaatgcaaattttgtattgtcgtccgttgaaaacacctccaagtttgtcaatttcaaaaaaaatttctcatttaaaaaaaaagaaaaattcgcaaaagaatggtgaaaatatttattaaaattgccaaaatgacgacgaaaacgcaaatttttcgtatttttgggggtgtaattttttaaaatttccaaaaagtcgatctttaggggtgtaatgacgtcgaaaacgcaaattttttgtattttcggggatgtaattttttaaaatttccaaaagtcggtgtatttttcgctttttttgcattttcttgtgaaaatgtgccaaaaaagatcgaaatatggactaaaaaggcaaaatggcgaaatatggatttattccccaaaacccccaaaatatggatttatatggactaaaaaccttcaccaaatcaaaaaattttaacgcagaaatgctatttttgagcccctttcttcatagcataagcgcagaaaaaacatgttaatccatataatttacaaccctatttatgacaatcccgaaccctaacaaaattctttttttttgttcgacatgggatatggttcggaattgttaaatgatcagtgaacccgaaaaccaccagaaattgaattagacaactttattaattgacctaaataattttgctaacttggaccaaaattttcgacaaatacaaatgataggtttacaaatacaggtcatgtgcaaaagtgatgctccaaaatgttttaatcgacaaaaaaaataaattttaagtagagaaaaaaattcagaaaaaaatcctgctaaattttaggctaacctttgatactgatccaaaaatatttttaaaccaagattagtcagatacactcactctccttaaatggtgatcggaatacccaaaaa

SEQ ID NO: 33129 - DNA, 1082 bp, Heterodera glycines
  misc_feature (939)..(939): n is a, c, g, or t
cggcatcgacatcgcaaatgtgcaatgccgtaaacggaagcgacacccgcgcactcctcatgaccgcaacttcaacggccttcaatccagcacaaccgcatctcagcatgactgcggcaattttcatcgatccaggcagccacagatcattcatttcgttaaaggcagcacagctactggatcttccgttggtccacactgaagaatgccacttgaccagtttcggagaacgcgaaccaaaaagatacatcagcgacctggtcaagctcggatttctctgcacgagcggggaaaaactcatcttcaacctcaacgccatgaaattcttggtcaacgacatgccaatgattcaactgtcagagctggacaagacagagttgaggcaacaaaagctcaatcctccgcatgaacaacgacaacctgacatcatgctcggaattgatgtctggcacgaactgcaggttcaaccaatcgaaaagttgccaagcggcttcacactgtgccgatccaaaatcggcaaaatcttcagtggatcaggacgcatcgaaatgcatcaaacgccaaacgtgacatttgtcatgtcagtccacggcactgagcaagaagaagccaatcaatcagtcacgttcgaatcaaccaaagaagagacggaagtcttcacaaccgaagatgatttcaaaaaggacgaacaactcaacaacttcttcggattaaatctgattggcatggacgacacatcaacaccaatcgatcaggattatgtgatgatccatttcaaaaagaacctcacgttcatcaacaactgataccaagtcgctttgccctggaacgaccgagttgatgctcttccaagcaacatccatcaagccaaagccaggctcgtctcattgatcaaaagactgcgcagcctcaacctgattgacaaatatcaggcaattntggacgaacaagttcaaaactcagtcatcgaatacatcggtccacccgagtctccatcaagtgcatggcctgtgcattttctgccacacagagcagtcatcagagcggacaaagcaacaaccaaaatccgaatcgtcatggat

SEQ ID NO: 33130 - DNA, 693 bp, Heterodera glycines
  misc_feature (626)..(626): n is a, c, g, or t
  misc_feature (633)..(633): n is a, c, g, or t
  misc_feature (646)..(646): n is a, c, g, or t
  misc_feature (679)..(679): n is a, c, g, or t
aggatgaggtcatgccgacaacagtcgcggttgttgtgccgtgccacgcacgcccgcgtcaccaacaatgccaatggcatagccggcacccaaaccgcacaggccacaggtcagcccggcagcaagatgcgcaaaaccgttgttcaacgtgtaaccatttgaagcggaggtcactttacccttgagcaccatcgccaccacgaggccgtaaatgccgatgatacctttaaaatggggaataagacagtgtaacaatcttggtaaatgagattgtaaaacactcattttcgaaaattttggccctggattttatagaaaccccacattcggttgaatttttaataatttttcgaatgttatgttaaaaaataccagccatgatgaccgggatcacggatttcatgatcaattcgggacgcatcacgcccatggaacaaatgccgaccgccgactttgcggtgccataagccgcgccgaacacggtgaaaatttgtgccgatgcagcaccaatgtagccaaagaatggcgcataggcagccctttcagcggtctcgaggtcatacgtcattttctgcttgaagagatttacagaatttgaaacaacaatgaaaaagcggcaggctganaaattgngaaatgattttanatggacggatggaaaaaacagggtatacattanatgagatggcattt

SEQ ID NO: 33131 - DNA, 937 bp, Heterodera glycines
  misc_feature (869)..(869): n is a, c, g, or t
  misc_feature (904)..(904): n is a, c, g, or t
aattaaaacgcactcctttcaacttcgaattcgggcggcattttcttgttgaagtcgcggatgaatgctttcattcgctcgtcgaattcgcccggctttttgtcacgggacataacgaattggcgcataaatccgctgaattctttgttgaattcgcgtaggatttgctcggagtcggaagagcggccgaaattggcggatgaagatgaactttggtgtcggtgttcgtccccttcttccttttgcttcgtctcctttccgtcctcatattctgccgattgtcgacgtgtgccgcccccgcgacggaccgtacgaaattctgaacaaaaaaacgttccggattaaagcgatggaatttaggaaattgaacatcccatccgctttttgaatgcgttcaatagaaaactttataaacaagcccctcccgctgatcccattgcaaaacgcacgtgtcaatgccgtcccctccattcggtggaacggagaggagtgccatcgattcaaaaaaatgccaaaattgtttattgtggcaaaacggtgggcggcagtgacgcacatcggatggaccattttgactttttgttttgcttcacttttaaaacaattggttagacaaggttgaattgtttcatataaatagaattctaatgcaaaaaaagcaaataatacgaattaaaaaataatgcttcattctgaatgcatttgcaaatttacaaaataataaaacttatgacagaattaaatagggaggtcggcaatcaaagggccaaaataaaaaaagagaattaaatgccaaatggaaaatgccaattccgtcgtattatccgtgtccattcgttcttcgtcccttttgtccccccgtttttttncattgtttcgtacgccgagcgtcgcttccactcanaaccggccgttgttggaccccttgcataactga

SEQ ID NO: 33132 - DNA, 1033 bp, Heterodera glycines
aatccagaaatatttaaataaatgtttaagaaaaaatgccaaaatatttaagaaaattttgaacaaaattgcgaaattctgagcaaccaaaattgaaaattctcttctaatgcgactttttcaactttttattttaaatattttttaatttagcaatttttaaaattttcccgaaatatttaaaaaaaataaaatcctcaccctaatgatgaggagcattggacatggacatggatgcgatatatacggataaactgttttcttcttggacccatttttaaatactttcgctaattgcatgaaacccaatgcattttaaataaatttcggcacgattgtttttctcgccaatttaataatgaacgacggatttcccttttccggcggcggatgtttcggcttcttcctgttcatcggtggtgatgaacaatttgatgaatttctttgcttcaacgagcgtctctttgcagaacggacaaatgtaatgaaattgtccatgatcgtccgggatttgaatgtctgaccaatatctagaaaatttgtaattccacagaagatggaggataaattgggataaatggcatggatgaaggcattttctaggttttttttttgaaagatttttccggattttcaatgtattttggggtgtccagatcaccatgaaaagtgatcaagttagagttttttgatcagcataaaacgttatgctaaatctgttttttcagattttttgactaatatttggcatcattcgaaagcccacaaaaaatgttagaaaaaatttaaaaaaaaattgtaaattgtttttttttgtttgcctttgaatatacatttttttgaaaattgatttaaatttttgattgtaaaggctcaaaaatggaggcactaatgtgaggcgtgacatcaaccgttggaattgaagaaaaaaaaaacgatcattaccgccggggatggtaataatgaaacggcctatgtccagttttattatcaaagggtttttaattagtattatttaaatgctaaacggtaa

SEQ ID NO: 33133 - DNA, 947 bp, Heterodera glycines
  misc_feature (27)..(27): n is a, c, g, or t
tgcagataattgggaaagcaaaccatncgggcatcaaaacgaagggaaaggaccaattcataaataagttcgggaggaagttttatttgttgggaacaattcattttttagagggatgtatattttttgcaacagtgaatgaatgaatgggtctcatccgttctttggtcagaagggaggggcactgggtttctgttcccatagacgattagtataatatggctatttcccagattattcatgtgattaacaatgattttatctacctgctgctgtcgttcgtcgttgtccatgcattcgtttatttagttaggttgcttaaaagagatgatgcttaagaaacaaatgttttttaatatgcaaaaaattaaaaaggtacaaatgcaaatcacaatgcttaagtgtaaagtccaaatgtaaaaaaagcaaaaaatacattttgttgatcttctttccaaatgatcagtgatgtgatcttgaaatgcatcaattaaagattaattatactattaattattttgagcgattaaacaaattgattccgtacggtgatttcatttgacgccctttcttcatttttgacgcaatgacatggcacacaatgttgtcaatgcagtgcaatgtttcgtcacgacgcttatcccaaaaaaataatgaaatacaaattttttttattgtatgtatattttaaggaaattcagggttcaatggaaaaatattttaaaaaattatttgcattgtgagacacagacaaattcgaaatgttcgaatctacagtgtttatgaagccaacagcgggtgcactatgcttccccccatatcgtttatcccatatggtactgacaaaattggtggtacttcttgttggtgtaggtggccgggccatgccgacgacagggcccattgccggtgaccatgataccgttctgctgctgatgcacatcatc

SEQ ID NO: 33134 - DNA, 148 bp, Heterodera glycines
ccataatgattcgccatttacccggcacagtgcctacttctggatgtcgcaaattttaggcatatccgaagacgtagccaacatttccaaactaaccgaagatcaaattcgaaccgttatgatagaatcgcggcgcatgatgcaaaaa

SEQ ID NO: 33135 - DNA, 920 bp, Heterodera glycines
  misc_feature (884)..(884): n is a, c, g, or t
tttgacaattctgttaacaaatcgcattaaaaattacaatatttttctcggcggctcctaacggcaccgccggaccccgctgttccccaaaccggtttttttacaattactgctcagctctaatagaaaataattaattaataataattaatagttattttttgttttttcggcacttctttgggccgatgaaaaatgccgtgaaaatgggattgaatgttctgcagagaatcgtcgtcaaatgcttggcccggcattgttcaaaattcgctttccgcttttctcaaaagaggaattttctgaaaatattggtaaaaaaaataatatttatttttgggtcaaatctttttctgactatttaaattagtatattcacagcctttctcttatttacagttccatccggcattttaacaacagaagaagtggtcggcattgaacaataccataccaatccgaatttctgtgggatttccggtgacttactgtatccagtgcaatttcctaaacactggcgaatttggacatttggaacattaataatagacattggaaaagtgtccaaatttcacgagaggaagttgagagcagtcgatacagcaaaactttgtacataaatggacttccatggagaatatatgccaaaataaatacaaagatgggaagcactgacaatgagaaatgcttgggcttttaccttttgtgcgatgcttcagaagaaggtgctaattaactgctcattagtgctaatgaacagcgacaattaatggcattaagactcaatttggcgctgctgtgttcgttcggccacttttcgaattgtctcgcaaaagaaagcggcggataattcactgggactttttgtgaccatatttttaacatanaacagctggtgggggttccctattttattacttttg

SEQ ID NO: 33136 - DNA, 929 bp, Heterodera glycines
tttatggatgtcaattttgggacttttcttcgacgtggccatcagcgggttgtttcgtgacaaaaacaaaccagtttgatgttattcgaatgagctagacgcgctctacattgtcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacagtttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaattttttcgccaatttcttttgtctacaaacattatttattgcgtttcatcctgtagtgtgtaaaaaattttcagtaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaacacgctggcctatgaaaa

SEQ ID NO: 33137 - DNA, 1100 bp, Heterodera glycines
  misc_feature (52)..(52): n is a, c, g, or t
  misc_feature (114)..(114): n is a, c, g, or t
ggggggggggaaagggggggaaaaggatgaattgggagggtttaccatgttngggcagtacaaaatcagggaattccgacgagagttccttcgaagagaaagtggaaattcttntagatgaacgaaaaccaaacgaacaccttgaaaatgtttttgagagacggcggaattggctgaccatttggcacagaaaaacagagaccatgtgcctaactggggaattggtcaagaaaaagcaacagaagaaatgtgccgaacctgtcccaagttgtggtaggggtcttgacctgtgagagaagagaaaaactttgggagacgagcgaaaatggcacaaaccgatgaccacaactcggattgtgttaaagggtgtcagattgaacgcgttgaagatgagatgacgaggcggaaaaacggagacaccccaaaacaaaatgagagatttgaattggacgcatatatctactgaaatgcacctgtttggcttgttcctccaaaaagcaacaaatgttcgtcatgtatttcatttggaattccttcctcaacagtttctgccacgtcggttcagcgagcgcatgcgaaggatgccacggagtgggagaagacgacggaggcgaacggactaaaaaaagcattacaaattgagcatttttgggtgactgctaaacgttctcgcccaatgccgtactttcccctgtgccatcgtcgttctgttggtgtctctccgcttccaaaattggccgcatattttccttcgtttggacattctcaacggcgccgtcgcttccgtccgcttctttcagagaagtgcttctttaagtggatgcgttagatataactaaacatatttaatggcttttattttacggttttttcctttgtggtgggcaaatgctttcgtcggctttcatttgtttccgtttgactccgtccgcttgcgaaatgcgttggaacgaaaacagcgaatgggtcagtttgaattgtttgggtgacattctcaagcgaacgaaaagcaatcaaacgcaagtgaaatcaatcgccaaagtataaaaacatcactgctaaaaaagcattcattttccaaaccaaggaaaacttaaaat

SEQ ID NO: 33138 - DNA, 943 bp, Heterodera glycines
ttataactcaagaatttttttgacatttcagctattttctgtctaataatcaagctgaaaatttttttcaagcataccttccctaaaataataagagccacacaaaaaaagcgaaaaaaactgtaaaagaaaaaagtctttatgaaattttttttcgaaaatggtcccaaatttgccttaacaaaattataactcaaaagttattggtttacataataaaattttgttttttgtattaataattttcttttttcgctagatccattattttatttggtacagaacggtatttatttgtaaaaaattttttaattattattttgtatctttcattaaacatattatcgcaaatagcattgaatacaaaaaactataagcattttgttaaaaaaattatcaaaatattttaaatagttaacatttttaaacgaattatattcagttattgttatcaaaatagtacgacactcatttaaaatttgccaaaatcacactaccgtcgcgatttgtgacggttggctttgacggccaaaggctattatgttaattttctttaattcattttcttgttttttggttttatgattatagtctattttatgattaatgaattttgtaagttatctttttatagtataaagtttttattatttttttttcttcttaagaaacaccataataaattatttatttttgtttaccttttaaaaagttataaaaaattaataaatattattatcttggccaagttctttctaattttttttcaatgtaaggtcgcatgcctttatttcaaaataaaaagtttaatattggataaaatagattcctacacatctttattggatacttcaaattcttttattattgatgatttaattgcaaataaaccttaaaaatatgtatttatatatttttgttttttattttcatgaataatttt

SEQ ID NO: 33139 - DNA, 896 bp, Heterodera glycines
cctttcagtatccctgcaaagtttggggcgcttctgataagtttctgaaaaaaaagttaagcctaaactttttggcatgcttaaaaaggaattaaaaatttttaaaatatttattcatctccctttttgataatataagagtcagagtgccttattcaacttgtaaataaattttggtgcgtttcagagcagtttatgaaaaaaaattatgaattaattttgcaaaaataaataaataatgaaccctcctccttaataattttcctgcgcccaaggtactcacactcagaattttgaaaattttttataaaaactgatgacgagctaatgtgataaaacaggttaattcttttcctttcagtatccctgtaaagtttggggcgcttctgataagtttctgaaaaaaaagttaagcctaaacttttttgcctgtttaaaaatgaattaaaaatttttattcttcaccatttttcataatatttcggggggactgcccgaatacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccgaaaacaaaaaaatcgattttttcaagtatccgtttggggtactcaaacaattatggggagcaaaaatccaacgcagaattaaagtacaggctatagggaagctattcccgaaggattcggtctccccataaatctgggcgcatcggttcggggggactgcccgaatacaaaaaaaatcgattttttcaagtgtccgtttggggtactcaaacaattatggggagctaaaatccac

SEQ ID NO: 33140 - DNA, 119 bp, Heterodera glycines
cggcatgccggatttccccttcggcctgaccatgggcatgatgctgtccggccccatgctgctcctgggcctcggcctgatcctctgggcgttgctgcgctttgtcgcgccaggccccg

SEQ ID NO: 33141 - DNA, 420 bp, Heterodera glycines
tctagagtcaaaaaaaatttcagtgaagaataaattgggggaccgtttcgttgtgaaagtcgcgcaacgaatcgcagtcaaaagtgtgacttttcctgcacaaaatttagggaggagaggttcaacttttgccaaattgctaagtgtttacctgtcaaagaccggcacaatttgtccatttcgattcggcacaatttctttgccgaccataaaccaaaatggcattccctcggtgttcagcgagaattcagtgagttcgatggttttcgtgtccaaaacctataagacaaatgacaaagtgttccttcatccctcatggttttctggccaaaaatcacccgaattggccccgactgaatccgtttgccaatcgatgcgtttggcacaggcagtggccgaagttggacggacgaaggcgat

SEQ ID NO: 33142 - DNA, 590 bp, Heterodera glycines
ttggtgtattaattggcacaaaaaagcggggtgattcatagtcaaaaattgacatcatcagagttttgcacagatattgacgggaaaaagcttaaacggaaatgctaatgcttaaacggactctctcaaattatatttcgacaatttattggaaaatttaataaggtgaatatatttttttaaattaacactcaaagaaatttttaccaaataaaatatgcttttattttcccaatgttaattgacaaataatttaatattattccgttccttttttccatcatttgtttctttccatccattccctttttcgtccttctttaatccgatcagaacccgttgaccaatgctggtggaaaatgaaattcaaatatttttaatttcttttgattaattttatttttcattttcgacaatacggacagatttaagatagtcatgttccttttcaaatgtattttttgccgaaaaagcattggaaaagctgaattaaccaattctgtacatttgtcttttgacaattaagcaccgcctttatacgaactatgcatagtaaaaggatgtgacaacgtctcatttttatgaatact

SEQ ID NO: 33143 - DNA, 768 bp, Heterodera glycines
aattcgaatattcttttgccattttaaaaattttctcaaaatttgtcgctaatcctttgacaaattccgaaaataaagcatctttaatctgaattttttaattatttaattttcattgagttttaagtctcacccaatttaaataatcatcgaatttcgaatacacaattatattatgcttgtcatcatttattgaattggctctccatgcttcattctcttttgccctttcttccgcatttttgaacattttctctaactttttgtcaaatttttctccacaattttctcgaattattccctctaaactttcatttgtttggcattcattcgctgtgtcaattgccaattgcaaaatgaattcattaattggcaatatttgttcattttccaattttattccaaatttcaatctctcctcatttaacaattttggttcgaaataataaatgaaaagtttctttaatttctattcaatatgtttactataatttggtttaaactaaaattgcgaaatttggccagacaaatcaccgcataaattattggcccattaatttcaattttgtttttaaatacaaattttggattcactgtaggaattccaacgtactctctaaacaaatattcgtacaaaatgtctaaaaattggcgatatttttggcattctgcccgttaaaattcgtcaaatacatccacaattttgtcacattgccaattatttttcataaaatacacaatggccaaggtgtggcctcatatttttgc

SEQ ID NO: 33144 - DNA, 930 bp, Heterodera glycines
tttccgggttttgaggtcaaaaaggccaatttgtctgttgggggccgttctattagaggttttttggaaaaatgctaaaatatgcacaaaatgccaaaatatgcacataaatcgcgaaatatgcacaaatatgcatatggaaagtcatcctagaagcttcaaaacaagctaaaaacatgtttttcgtgcgtttcaggcctcccacagtccaggaaaaaaatatgcatgtgcatataattccaagctaaaagggggcgggaggctagcaaaggggaaaagaggaagtgcttaaaaatttggctattttttaacgttaaaaattctgaaaatttttcctcggcggcgcatattgtcaccgcccgctccaaaaacttttttaaatattagctccaaatcttagtcatttttggacaaaatcttttaacaaattgtataataattttcaaatttttcccggcggcgcttttcggcgccgcctgacccccacccatgttccacatttttttggaaaaagcacgccgcgaaaaaatctgttttaaaaataaaaaaggtcggtaatttacatagccgggaacccttcacaaatgattcccaaaatgaaccctaaaaattcaaaaagaaaggatttttacatcacaaattataattcgttttccttccggaaccgccaaaccagtaaatttttttgttttaaaagggtttctacaaggttattgaaattaatttaaaaattttcgaccatagctctgaatctgccatttttgctatttttctcccgcggcccatattttgggatttttcgcctcaaaaaacatgcaaagcttttattcattttttaaataaaatttgaaaatttaaaaaaaaaattttctttgaaaattacggattacgggaaattgcggggttttttgacccccgcaattgcggatt

SEQ ID NO: 33145 - DNA, 845 bp, Heterodera glycines
tcatcaattgttagctcccgttgacaaacctctttgagattggggcaatggatgttgggctaccgtatcagctattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactcctttcagagaagagataaaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgttt

SEQ ID NO: 33146 - DNA, 1024 bp, Heterodera glycines
cttatttattaggaatatctaaaagtgtctctagtaactctttagatttagcatgcaaaatttgtgtttatattatctcccatcacaaagtaattttttgtaatttttataattgacaaaattttgctaatttccttccataaaactcaaatttttcgaatttttgggcggtatttttttttaaatttccaaaaagtcagtccttaaaagtagtatctttttgctgttgcagcatttttttaaaaaatggccaaataagctctaaaacccccccccccaaaaatagcgaattatgcctttattcgctaaaatcccaaaaatatgcatttatatgcactaaaaacttcacaaaaaaaaaaattaatgcacagaaattttgtttttgagccacctttcttcatattttaggaaaaatatgcaaaatcaatcaattgcaaagcccaatacagtaatgaccaaaggttttagagggttttaatattcaataatttttatttttttacaacgattacaaaccaaatttactaacaataagcacatgaccgttagttactgtatcgtttgtttgtttttcacccactaatttcgcaatggaattttgcctttcaatttctgtttagataacttatcagattatgtatttatatctcataattagggatttgatttttaggtatttcctatttttttcctaagctcccagtggcctaaaacgcacaaattgttaagctacttttcgagttattagtgcctattttctaggcttttatttttagagcctaaaagcctaaaaaaattttgaaagaacctatttttgcctattttggtattttgcccaaaattattaacaaaaagcaataaaaacgaaaaatacaccccaaagaatcgacctaaattttttttttaatttttttcataacaagaattttttgatttaaaaaattatttatctcaatacagatttggcctaaatttttaaattttttttgatacattttgtcatgtcattttccaccaataaaaa

SEQ ID NO: 33147 - DNA, 1479 bp, Heterodera glycines
  misc_feature (1414)..(1414): n is a, c, g, or t
aatggccaagttcagtcagttcaaattggaaaatgaggcgctgcaattggattttaagagcggaaaaagtgccaaacaaaaaaataaaaggctgaaaacagatggaaaggcaaatggaatagaatttgagcaaaaaatggaaaaaatgttcaggaagataataatagagaatgctaaattggcaaatggaagctcatcatcggcattttcatcgtcgacatttccatcatctgcgtttccgttaccgatttccatgtgcaccgtacctatttatgatgccgctttgcgcgtgccaatatatgacatgagcgatgctgtaagtttctcgaaaaaacaaatattcgggttagggctgccattcgacaaaattactcggaaaggcttccggaaaaaatgcgtcagcaatattaatttccataccaattcaggattagttttcaaattataaaactactgtatctctttttaaattcactgactcattttccggtcaagcttggaaaaataaagaattacagaagtagccaaaccagattgaatttttgaaattcctgccggaaatgccaaaagatttaaatggttgttttttcgtgccatttttgataaaaaatctcaacacttgcagattgaagaagaattatttcctaaatttgtgaacggaagtgccgatttttccacacattttgctgctgtaccatcaaataaaattaaaaagtacgaaactcatcttggcctactgtatgcgatgaaaacaaattggcgttgtgccaatgccaaaaataaaattgacaacagctgcaccaaatatcgccgatacattgacattttgtatgaatatttgttcatgatgcgctatgggattaagtctgtgaaagccgatgtcgagactcttgtagggccacggtaatattatgtgtaaagaagcaggaagttcatgggttacacgaattacggttacgttccctttatagtcattcgtcgtaaagtagtagttagatgaaagtgttctggatattaacccttaactattcccctattttcaggaggggttttccttgctctctcatcttattcatgtccggaatcacccatgtaaagtctcaactccctccccgattaaccctaaaatactatcattcatctcaccatagcgctaaagaattttcttaggcggtggttcaattagattcttatgatgttttaaaaaccgtaatagccaacgggtcttaccactcccggtagcccctgagagaattagagtgaacggaccgcgaaacatttttaatgcctcttatttatttgatctatttatattttcatagggaaaaaatttcgcgcatttggggcatatccagaaattatcaaaaaatgatgttccgaaatgcaagggtctgtgctaaaacgcctgctccgngtctcgtaatgtcaggggcagtatagaaaacacttaattttatgtgggcagttcatttttcaatt

SEQ ID NO: 33148 - DNA, 945 bp, Heterodera glycines
  misc_feature (913)..(913): n is a, c, g, or t
  misc_feature (917)..(917): n is a, c, g, or t
atgaactgacaaataaaaattatgataaaaagtgcaaagattagcaaactttaattatttttataaattgaatacgatcaatataatcgtttactaatcagcaaatttttgtgaatattgaaatcctaatgtatagtgaatataaaaaacaatttacgttatgcgctttggcttttgaaaaatgaaaaaataaaagtaaatcttctaatatcattttaaaaaccaaaaagagattaagcaaaaaataaatgaactagctagataaaattattttataaaattagtaaaaaaatcctttatggtcaaaatcatacttatatgcatattaaattcaatatattaatataaataaaaaggaatactgactcatgaataaagaatgattgatcaaaatgctgaaaggaatttaaaagaagaaaaaaacaatttcacatattaacttggtgcaaaatattaattaaaacagactcgataaataataaatttggttcttcccgatcaaaaagaaaaaaaaaatgaaattattagcaaaaaacaacagttactgaagaattcaacaattgataataaaatataactttataaaataaaaaatcgaagacacaaatgaaaggtaattagagcgagtctcgtaaatcaacatcgcttattaaactcaggtcatcttacagtggaatggtaacaaatcatgaaaaaaataacgtagatccaatgaaaaatgattagtcgattttgtaatttaaatttttaaagtttgtaatttgctttttgttccaagaagcttttcaacccactgatatcatgtcgtttaatttcgaacaaaaatatacttatataaacattaaattcaatgtaattattaattaatataaataaagacaaatactgactaatgtataaaagaataatttgnttanaaattcatcaaataagcgtaaatcaact

SEQ ID NO: 33149 - DNA, 930 bp, Heterodera glycines
aaaaaagtcgaaatttttgaagttttttctttatattttttagatgcttgtaaatcttcgctttttgtaaggctaatagagcatgtgaagcgctcttgaatgataccaagattgtttgatttggttgaaaaattaaaaaatttatattccaaaaacttgggcgctggcgccgaaacgacccattccctgaactgcttgattctgccggtacggtgttggctggtggtgagttgaccctcccttttttatattttcttcttttttacgctttatgtacaatttattttctgtatgttttgctttactttttttgattggacatttgttttcattatttttttttactttctatgggtaaaaagcattattcattaatcgtctcaaaaattaaaaattatccaccgccacctatcggcaccgtcggactctcagtttgttatgtttatcaattgttgaacgcctaaaactagagctcagtatattaaaaaagcctggacctagagaactgaattctatgtttgatctgggcatggatttcctggacaaaagtccatgaaaatccaggcttgataaccaaaaaagtcccaaaaatcattttatagtcatttttaaatttatttaatcatttttaataaattggaataaaattgatcactttaaaaaatcagatatatatccaagaaatccatggtctttttttcatgtcaaatctgtcctagattttcttcatatttgacttattcctggcttttctggaattaatccaggaaaatccaggtccatgctgagctccaattaaaatctaaatttgtttatctttttttaaataaattttgatatgctaaaattattatgaaaaaattaattatttaatcttccaattttaaaaatccaaatcccgcgcccgatcatgtttcaaagctagttttt

SEQ ID NO: 33150 - DNA, 796 bp, Heterodera glycines
  misc_feature (50)..(50): n is a, c, g, or t
  misc_feature (55)..(55): n is a, c, g, or t
ttcgccgttttgtcctccgaattcgcccttttaagatccgaattcgccgntttgncatccgaattcgccgttttgtcctccgaattcgccgttttgtcatccgaattcgccgttttgtcatccgaattcgccgttttgtcatccgaattcgccgttttgtcatccgaattcgccgttttgtcctccgaattcgccgttttgtcatccgaattcgccgttttgtcctccgaattcgccgttttgtcatccgaattcgccgttttgtcatccgaattcgccgttttgtcatccgaattcgccgttttgtcatccgaattcgccgttttgtcatccgaattcgccgttttgtcatccgaattcgccgttttgtcctccgaattcgccgttttgtcatccgaattcgccgttttgtcctccgaattcgccgttttgttctctgtttttggcgttttgtcctcgttgcctcccattttcggctcctctctttcctcctccttgcctgttttgttgccctctttgtcttccgttttcccttcctttttcgccttcctcgcagctttgtcgtcgtccttgtcttccgtgtccgcccgcttttcagcactgttccatttgtcctgtttaaacggtcattgatgattggtttgcgataaactttgagcttttatgcttacgtttttgtccgattgtatgtccacattcttctgctgctcgtcctttggtcgctcatttggtgggagacaccaacagatggcaacgcaggtaaaaatgaacaaaatgaaaaaacgcatttctttct

SEQ ID NO: 33151 - DNA, 539 bp, Heterodera glycines
atttcaacgcatccaccgaaactcgccccaccatttcgcattacgacaccattatgatcataggagactgccatgataagaccgggacccatacaccggaagcgtttttgtactccccgaaggtgagcaaacacaaatattgacttgctcaagacacaaaatcgactatctgaacaaacccgaaacagaaacgcagccgcacgattcagagctatacgacgaagacagatctctatccgtcgtcttattgatagccacgttatttcacgtgatagagcaatatgaaaagctgccctcgaagactcaccacactatctttaactatccatttatttacactcatttcttttttaacaaacaaaactgtttttaattttcctgtgtatgcacaacacacgcctattgttatcccttttatacattttttttgtggtcctcagataaactccaggtgcacatgtaagctggtcaattacttgactctttccctttgtcatcacggaacttgggtatttattcttcttattattaacgcttga

SEQ ID NO: 33152 - DNA, 931 bp, Heterodera glycines
  misc_feature (862)..(862): n is a, c, g, or t
  misc_feature (902)..(902): n is a, c, g, or t
cccgattgatgtaagctaacatgaaaatggtataatttcttgaataataaatggtgattaaaggaatttagtaaatataaaaaactaatttaatcttagcatatatttaaattttataaatattaagtacataaaatgaaacataatttataaataaattctaaaatctgataaaaacaaaataaaacatataaaacaaaaaagaacttgaaggaaaaacaactttaaagcatgccgtgttaaagaatgactaacattttgaggaaaaaaaagcaattaaaagaaataatttttgaaaaataatataaagtgaaagaatataatttaatgaaactaatcattatgcttattttatatcggtatcaacaagactacgaataattattttaatgaagccttgtaaattaatataaataaaacttctcacggaactcaacaacatgatggagaaataatcatgaaaaataattacaaattcattgtaacaaaagataaatccaaaataattaacaacagtgaaactgcgttttgattctggtgtcaagtgaagggaatagaaattaaaaccatttaattagttaaattattcataagaaatgtgtacaaaaagtttttgttaattgtttaaaattgatttatatatatatatatatatagatagaactttctcaagtataactaaatttttatttttttgaaaatcatttggattgatagctttaagtgttttctattacccgtcagaatttaaaacttttttttgtttttcaaaaaggtaaagttattgccaaaagaaatcaaaatcgaattttatgtatgttcattaaattattaatttgcataataaagcggaaagaattanatggattaaaatattatggcgcatatgtaatcctgctgtnaactcactcccatttgtcttatctaatca

SEQ ID NO: 33153 - DNA, 1348 bp, Heterodera glycines
aggtaattagaatatttgcccatggtaaatggcaccgatccccctaatattaatgcgtcttggtcataaaacttaacaaattctttttgacaattaatacatttcagccaaacaattttcttgcttaaaagtgttctctccaaggatgactcattgcgaattggccacttcttcggccacaacaatcgacgaattgcaaaacggcgatcgccttcagtgtgccactcgaatgcaaaagttttccggcgaattgcttttggtagaccgtcgcgagggaatttttgtgttgcgcgaaaggaaaggcaatgagcgacagtttaacattcattttatccgttttgctgagcttcaatcggtgcgtttgttaatttttttgcgcagcacttttgggcgacgcaaaaaaagggaaaaaataaaattgggaaaaacaatttaaatgagataagtcaaaatgggtcctttttcggttgcttttcctattttttgtccatttctcccgtttagctgaagaaactttcatcccctccgtccaattttgatggcatttgccatgtcccaacggattctccggcgaccgctcgcgatcggttggtcaaagcggagcagcgactgagccaactttgggtggacaaaacgccgagcgaagcggcgaaacgcacttttatcgaactgaagagaatgtgagagagagagcaaagcaaatggacttcgcttaggttttgacattaatttacaaaatacaaatcagattcgacgacgtcgtttgggacggggaaagtatcaaaggtaagcgaacggacggaaggaatgacgattgttcactttgttgacttattgcgacttttcagtgctcaaatgtgtcgtggtcaccgcaccgttcgatgaaaatggcgtcgaatgtatcgactcgcgcgcttcctccgtcggcacattggcgcgagtgaagaaaattgtcagtgaattaagcaaatgaggttttgaaagcaaagcccaaaaacaattttgcattccaatcattgttttcttatggcatttctgttttgggacaaaaaagcaaatggttagaggcaatgccatgccgtgtctttcgcttcccttttgtacgtttttgggcttcccttttctaagtccccgtcgtcctcaccacttttttcttcctcttcataatgactatttttgttcctttctttcccttaccttctgctccttttttccctttctcctttctccctatctctccgtttctctctctctctctcgctattctccccccccccttttctccttattccctttttgattttctttcaaacatcttccccccttcctttctctctctctacttctt

SEQ ID NO: 33154 - DNA, 916 bp, Heterodera glycines
agtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaatattttcctgcaccgaggaactcactcggccg

SEQ ID NO: 33155 - DNA, 1053 bp, Heterodera glycines
atgggttttggtctgatcgaaaaatgtccgctgggagcgtactccgcacaagtgtcctctacaaaattggtgttgatcattttttgctacgactaaccgtattccgtgtacaagtgagcaaaaattgccaactcgaaaaccggaatttcgtttttcgggaataactctgcgggatttgcttatatccagtgcacatagaaatgattatgtgtaattttttgagctctatccaaccgtgtttttggatttttaaaattttcagaaattttcgagctaggcctaaaaaacggttttttggttttttaattttctgattttttaacgaattttccaggaaaaacggagaccacttccaaaacatagtttttcgagctctatcgattggtgacattttcagaaaaattttggtttttttccggaaatagaaaaattttttgctctgaccgggacatttcagtcccgggcctataactcgtcgggagttgattttagccaaaaatcttgcaagagcatttttgtagagaattttaagctctatccaatgtgttttatcccatatttttaacatgagtataaaaaaagttataaaataaaaacggatttttaaatgcaaaaccaaaggggggaccccatggtttcgaaattaatggaaaatttttttgcttctaaaattgccaaaaaatacttttctggggtaatttgaggtgcagggcacgaatatacactttatattgagtttcggatattttggagagtggtaaaaaattttgaaaaaacatcaaaaattgggccacgaaaaaatccaggaatttttgaaaattcataactctcctcaaaagggtcaattcgtctcaatttaagcgtaaaaaattgagaaaaatatgctgaattttatattttttattaggtttataaatgccgaaaattcaaaaagttaggcttggatttctggaaatatttatttttttattaaaaagttcataactcattccaaaaaaaatgctaaggaatatttaaatattcataaaatccgcaatatttttctctacaaaa

SEQ ID NO: 33156 - DNA, 1261 bp, Heterodera glycines
atatgggataaaaatgcaaaaatatgggaaatataggacatacatcgcaaaatatggaaaaatatggaaaatatggatatagaaatccatcctagaagctccaaaccaagctaaaaacatgtttttcgtgcgattcaggcctcccacagtccaggaaaaaaatttggatttccatataatttgcatccctaaccattacaaacccaatttcttaccagtgtatttttattcaagggctttaagaaataaatataatacaggttaccgtgccacaaaattttctttttttaagaattttacttgtaaagatttttaaaaaagccatgcttttggccaccaatttctcattccgccgctgtttcctccaatttaaactcggctttccgtcccttttttgtctccgtttcacttcgctctttttgcttgccattgtctccattttgtaccttcttcaaaactccaatgataccaaaagcatttcaaaagcgagcaaatggacagtgttttcgcttgaaaatggccatcaaaatgacagcaacaaatggacagtgccgagcacagaatgccaaagagtgttcggcggtgacaaagcgttggtccagcgattggtgcggcacagacgcaaaattagggacccaccgccgaacgaattggcgatgagttgtgatgcgatttgggcacggcatggagacgaagaattgttggcacaacagcgatgggacaacgacaaacagcaacagcagaacgagaggaggaggacgacgaacaacaatggcacatccattgaaacgacagaattggaacggcaaatgccaatggcattcgcgcgggttgtttacacagtgagttgcaccggcaccggggagcagttcgtttcccaccccctcgccccgaaaaatttttttgttttgttaaattttcttagtttttttttctaggaaaaactaaaaaaaatttgaaagaatttctccaagaatctttttagactttttagaaataatttttttacataaaaatcaaaaagtttcccttttggttttttctggaggcgctatgtttagaatgccggttttttctagtttgatgactttttaaagaatgggcggcacttggaatttcaaaatgcctgttctttgctctgttcgaagcttttatttttttcgggaacgaaacgcacgcaaatttttctacaaattttcacagtttccgatgggcccattaattgtgtaaatctccatttgtcttccctcccccccccccc

SEQ ID NO: 33157 - DNA, 849 bp, Heterodera glycines
caatcgccattttatttcacagagggatttttatatttagaggtcatcgcagaaaaacggctatctctttttttgataaattttatacacatacaaatgctctcgagcacgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatac

SEQ ID NO: 33158 - DNA, 469 bp, Heterodera glycines
cctgacgggtttagcagcggagaatattaaaaattccggcgaatttttgagaggtgcggcgaatggcaaatgccaaattcgtacatttgttttactaatgaaaagggttgtcacttttcttgcataaagcgtttcggaatgagttcgactttttcaaatgtcagcttttcctttgcttctccaccgttgccatcgaatttcgctcggtttgccttctcctttaattgtgctaattgctttccaccgtccgtcgatggcacaacacattttgtccttatgtatttggtaatggcctttcctcccctccccattttcattttattacaccgatggatgggcccaattaaggcttcttctccccattctgaagaaggggagaaagaaagaaagaaaagtcggatgagccaaagaagggagggaattggagggggagaaaaagtgaatgataggccggggagaggggggggca

SEQ ID NO: 33159 - DNA, 796 bp, Heterodera glycines
aattcaagggacctcgtggagcagggcaggcagcaatcctctgaggagctcaactccattttcccgggcattgacttgcgctccaaacagggccaactcagccacgaggagttggacgcgttcattgtccacggcacgtttttttccattacgactcatggcacaaaattaatttatttcttccctcattaccgctagaattagaaaaattttcaagaaattttttcatattgtttagcaatttggctaaatatgacaaaaatgggaattttcagcgaaaacggataaaatttctactctttgaaaaaaaaattatgggagagaattttgcgcgctgttaattgaaggtcgctaattatagctaattggtcccttcattttcagcgaatatccgagttgaccagctcaagaggcaattggcggaacaccaagtcagtgttttgcgaatcaacacacacacacaaatttattcctttttaggccttggaggagcaacgagttttggaggcggtcgaagaacagcgaaagttggacgaaaggtctgacatcagtcaaggacgattcctggcttccagtttggattgacgggagcagcacgcccccccccccccgcgccccgaaaattttttataagagccaagagaaaaattttcagcgatcttatggaaaatttcaaagctaattgaaaaaaaaatcatcataaaatcaaaaatcgattgaaatatttttacttttaatgggttgtcgtttttgggtttgtttgtatcccttgtccatttctcttcatttaacttta

SEQ ID NO: 33160 - DNA, 639 bp, Heterodera glycines
tcgcttcaatctgttaaaatatttatatgaatagaatttctccctaagtaaataaaatttactgggcgtttaaagagaaaatttactgggttttttataattttcttcgtttttgttgtaaatctggcacgaaatcctgatgacttatccgatgattgacttgttgttgatttctaaaaaaagattaatttaaagtttttaaatttttcggaagaatgacaaaactttttaattcaaaaacccatagaagagtttgacacttcaaaaaaacctggacctagacatgaacctcaactcaatgttggacctggtcgggggtcggggtggggaggagctcaattgtcgggggtcggggaccccgatcggggaatgattaaattttattttaacacaaaaaataaatttttctttttcaatgctcgtaaatcttcccttttttcactttaatcatctgatttcgttagcgccaataagagagagttcaagctggcgcctttaaaccagggcttccatttgttcttatttataagaatgttctgaatttgggctagcgacgaaattattccgatttcttaaaaaaactcataattttgaaattttatggcattggatttaattaaaaaaattggcctttttggt

SEQ ID NO: 33161 - DNA, 1176 bp, Heterodera glycines
  misc_feature (578)..(578): n is a, c, g, or t
cgacgaggaaccaaagatatcagctggagggaagaaatcttttgagcagaaaggaagagtaatggaagaagcagcgacagctgcaaaaaggagtcaacgaagggaaaaaggagtggattagcagcagcagcagcagcagcagaagaagcagcaattcatcattcaccatggagggtgacgaaggggcaattggattagagggagcaaaaggcgtggggggagggggggggggggagaagcagcgccatagggacgggggaggaaaaagcatggaaaagtcgcagattcccaaggaagaagcaaatgtgaatgggtgccacacatcaacgccatccattcatatgtggacacatccatgctgaaaggttattacgagcaaagggacggcgcaccccaaaaatggggggagaaaatgggcaaaaagggggggagtaaacagttaattgtggtcgtcccacttcccctaccccccggggggactcggacaaaatgggggacggacggcaaaagtggggtaattgccctcatcttcgggggcagtgggcggaaggggcaaatgttggcaatgggtggtcgcnccgcccccctcttccggcacccacacattgcccctcccctcctttctttgctgccaaaactatggtgtggccactgagcgaaaattttttgccggaaatgggtctcaattggacccatccgccggggccgcgcaactgctgaccaaacgaacacaacaatgggggagagaaagacatttcgaggcacaaatgccggaaggggtgggcactgtttcggcacccgcccattgcgacaagcggcggtggcgaggcgtaacaaattggaatttgagaggcggcatgggtcacacattcccaacagcggaaattcaaatggatttacaaaaatggaatatttattttgtataagaaaaatggatgaaatgacaacaattgcacacacttaagctgagcccgtacttttttttgattgaatagattatttcttcttaaatccaaaaagaataagaccaagttcaagtgaatacaaacaaatgaaatcacaagaaaaataatttgttgggctttgagacacatggccaaaacaaatggacattttaaaacacaatacgagaaaatggcatttgaaaagacaacgaaaacgaaaaaaaaacaattt

SEQ ID NO: 33162 - DNA, 1008 bp, Heterodera glycines
ttgagtcccagtgattgaaatgttggtgggttgagtcccagtgattgaaatgctggtgagttgagtgccagtgattgaaatgttggtgggttgagtcccagtgattgaaatgctggtgggttgagtgccagtgattgaaatgttggtgggttgagtgccagtgattgaaatgttggtgggttgagtgccagtgattgaaatgttggtgggttgagtgccagtgattggaatgctggtgggttgagtcccagtgattggaatgctggtgggttgagtcccagtgattgaaatgttggtgggttgagtgccagtgattgtaatgctcttgggttgagtaccagtgattgaaatgttggtgggttgagtgccagtgattgaaatgttggtgggttgagtgccagtgattgaaatgttggtgggttgagtcccagtgattgaaatgttggtgggttgagtcccagtgattgtaatgctcttgggttgagtaccagtgattgaaatgttggtgggttgagtgccagtgattgtaatgctcttgggttgagtaccagtgattgaaatgttggtgggttgagtcccagtgattgaaatgttggtgggttgagtcccagtgattgaaatgttggtgggttgagtgccagtgattgaaatgttggtgggttgagtgccagtgattgtaatgctgttgggttgagtcccagtgattgaaatgttggtgggttgagtgccagtgattgaaatgttggtgtgttgagtgacatagtttgaaatgtatcttgactatgtttacaatactctatatggaatagttacttaattctttctcttcaatggtgcttttctgatgtaatgaaaatgaaacgctgcttcggatgcatggacaccataacggtgcattttcatacatttcttggtacttttctgttttgtgtacacatcctaaattttattgacaaatacctttttgtgccatccaaaaactccgtgcatcttttgtacattattttt

SEQ ID NO: 33163 - DNA, 641 bp, Heterodera glycines
tgcttcaattcggagtaaacaataaatgtcaacatttcctattcgtcgcattaatttgtcattcagtgaaagtggcaggggcaattgcctgcgcgaccccgcagaatcaatcgcttcgcacgaccatttgaaggacggccgacttccgggccaacggtactttcattttgatttatccataatcaaattgctttttcctctgtattaaatcccactgtgtttcctttttcggtttaccgctgatcagcagtgttcgtacttctggggaagagactttcaagtggaaattcccaacggccgctcttttgaggtctttgccctgatcaaaggccaatcagtcggtctctgattgtcttgattgtttgttaggatatttgtcgcattctttggtgcgggaacagtggctccaccatttccaccgctcaccccgccttggagggcagttggtgcggaccccaacgggtgatcaaagagaaatcggtccgggattgtttggctaatccttgtcaaacagtggtgccaccgtgggcaatgtgaagaatggcaccctcaaatgggcgacttcccaactgaagtggacggaatatgttccgattgaacttccgctgagaagcaatgtccgatcactcagcggcaaatca

SEQ ID NO: 33164 - DNA, 1056 bp, Heterodera glycines
  misc_feature (1022)..(1022): n is a, c, g, or t
attaaaaagttgtagaaaaaatttcgcttttcgcatttcttattttcgcatattttggcttttcgcatttcgcttttttttcatttcgcatttttcagtttcgcaaatttcgcttttcgcatttcgctttttatttttcaatttggcccatccctgctgtcggcacagccaaccctaagcacatcgaatttaattttaattccacatttttcaaaaaatatttaatttatttagatgatatttgaaaatgaaagggcatgggatgtggtcgatcgttggctaaatgcccattatttttctttggaatacggcaacacaagaggtgaacttgaaaaaattgaacaaatgctgctcattgcgaaaggggcgattgtggaagacgcatatttcgacattcataaaattttaagtgtgccccaattttttgacgcaccccaaagggtggaaagcgatgaagatattttaaaaagtaaatatttattaaattctttcaaccccttcaaaaggggggtttattcgagggagggttctattcgaggatggggctctattccaggaagtgcggtatgtgagtcttacaattagcccatccccactcgcaacagaaaacagaaaatgaaatgctctagctttttaattgtataaaaacaatgcttttttaaagaaaattaattaatgatgcaaacattttattataataaatttcatgtttttgagcatttttttcatttttatgaaactttgaaaaacgtaaaaaatgggataatccctaattttcctaattagaggcgaaaagtcaaaatatggatttctgcggagtaatatctcatcgaaatagaaccgcagaagaaattaatactaatacttaaaaattcattcccgaatataattagccaaaggaaatcagttaaatcaataaaataaattaattcacttaagaattattggcacaagataatgttgttacttatgaagaaaaactgacaaacggaacacatcgtaattattttgtgagacgtcanaaaattttatgaaacaattgaaaaaaatgaacaa

SEQ ID NO: 33165 - DNA, 941 bp, Heterodera glycines
  misc_feature (861)..(861): n is a, c, g, or t
caccagcagatgaattcgggacatttttatcaacaatcttcctaaaattaaacgaattttggggtttacaatttatgcagatggcacatccatgaatttctgaacccggcaaaaatttatgaaaagcgaaatctcggaggcgcataaaattactaattatgaaaaaaaaatttaaacgcgaaatttctgagtgaaattcagaattatgaagtagatctatttccgtaaattgcaaaattcggataggtagatagaggcattcatataaatttacatttacaaacaatgaattaaaataataatgataataacttccgaccaaatttgttagctgtgttgcatgcatttctctaataaaaatgctgaaattttttgtcttaaatctaaaaaatctatggccctatatataaactacactttcaattttttttttcagttatactgagccgaaaatttcattgtctaaaatttaaaattttctatggccctataaactacaactttttcggcgtcttctacttaatacatatgtatgtatgtggtgcatcagcagcagtaggaacaacatcaatcacacaatgtttgctcacagttgatacacacacaccaattggcggtggtggcaattggtaggaggcgggtgaattttttgatggaaaaaaggtcggcggggccttcgtttttctacttggccaaaacaatggagcgcgcgaagataagtggatttttgattagcgtcaaggggggggggaggcggagaaaaagtggggtcaattgggggcggcggatgtttgattagtcatttgggaagaggacaaaagcagcgcggaacagggtttaaaaaaaattatgtaatagtanaataataaaaataggtaatttttaaggaataaaacaaatagatgagtaggcgtgattttgattatgaaagaaccaaataa

SEQ ID NO: 33166 - DNA, 360 bp, Heterodera glycines
tttttttttttttgggtggggggcggggggggggggcggggggggagaaaaaaaaaaaaaaaaaaaaaaaaaaaaaaaaatttcttttcttttttctttttgttttttataaaaaagaaaaaaacaccacccacccttctttttttttttttcctttctccaggaaggggggggggggggggggggggggggggggccccccccccccccccccccccccccccttttttttgtttcttctctttcttaaaaaaaaaaaaaagaaaaagaaaaaaccccccccccccccccccccccccccccccccccccccccggggggggggggggggggggggggggggggggggggggggggggg

SEQ ID NO: 33167 - DNA, 810 bp, Heterodera glycines
cttttggcgccaaaataggtaacaatttgtttgatggcccttagaggataaatattccatggttctttttaacttttctttttgatatttgagcctaaataaatttaaaaaccccgtttttcaggttaccgaggttttcgcagaaattgaaaaatggttctgaaacttcacggagacctgttctggccaccaagtgatagctcttacttgaagaaatatatttagttttcttttttcatcgtcttgaaaaatatccaaaattccaattacggatcaaaatactgaaaaatcgcaaaatccgtaacccctaattacggggtccaacaactccctaattccgtaattcgtaattgcgtgcagccctgatccatatcaaactaatcatatacccaatacacaaggtttggatgattttggaaatggatgaattgggtttgaatgcgttggggcatcattcctggcaatcgcttagttgtgaaacttttttgtccaaaaaatggcaattttgtcagtgatcaactacctaatttctctcttcttcattttttcatagcaatgaataatattgttgccaattttttggccacgctttgctccattgttattttcatcgtccattttcctaaatgtgctcaagctgtgacaacgacagtgaccttcggaaagggtgacacatcaacagtccatgtattgcataaaggtcaatggttgttcagctttgaaacagagcaagacggcaacgggatactgtataagaatattaacacaagacaatggacgggcttgaaagataatgattcaatcgatttc

SEQ ID NO: 33168 - DNA, 795 bp, Heterodera glycines
ttagggcaaattcaccaaatttaccattcagtcaaaagtcaaagtattccttaatttgaattaacgccttatgattttcatgagtgttaaattgcattttggtaaaaaaaaacattcgggtacagtaataacggaaaagaggaagacaaattgacaaagggttactgtagattcatcgaaagggaataaaatgtttttgttgaaaggaattgtgaaatgaacttatatgtacatatgtgtatgtacaaatacatacaatatttgtttttgttcttattatcgtataaatttggctttgcctttcgtttgactgtccgccttttttttattggttggcaaagtgtcactgataaataaatgatgataatcgagtcgatttggtgatgaaatacacaagtaaaaccaaccattaaaaccaaacaatttgaaaaaatggaaaattgggatttcaaagagaaaggcaactcgactaattagtggttattagtaattactaatcagttacaataatcagtgaacgtttcactcgctaacactttgaaatttaaagtgttgtccctcgttcatttgggtcaattgactgttttcgagtataaattgtctttcccccctccccccgggcgttgtctggtcccatttaatgagtcgtccgtccgtctgtcggtgatttggatcatcatcatgatcattagatcattcagtgattaccactcacattttagttaattacatagcaccgcaactgtgttattatcgcaactgcgacggactggcggagaaacatcgccgagccga

SEQ ID NO: 33169 - DNA, 1043 bp, Heterodera glycines
  misc_feature (956)..(956): n is a, c, g, or t
  misc_feature (1005)..(1005): n is a, c, g, or t
cacagccctcctcatggccaacaactcttaagggggtttatttatttattttatttttttcggacaaaaatttgtacccaatgggtagtatttgcaatggcccttgttgtggtactcaacaatgcacttgagctgagggtacagtaggcggatccggtgcttcatgtagaaatactgttggactttgacatctgaacgcatggtgttggaccgaaacagaatttttggaaacttgccaagaaatccctcaaaggcgtaggtttccgcagcggctttcaccgaaaatgtgccgaacttgacctctttggtcttggaatcacgaccctggtaggttgttttgagttttttgccggccaggtaagcgttcgctttgttcaccgcctcggggttgttcaaatattctgctaaattttcgggtttacagtttagcagtttggatagggcagcagtcagagggagtaccataatctgtaaaaaatcaataaattggcttgggtttcactgtgtgtttaaattggcgcccttttgtatctttctctaaccactactctctcgtctatgtgtttgtggatgggcgtggcctatcgattaaaagggacagcccgtctggaggtcgctgcgcgctaacacccctctcactatcaatcaataattacgtgttttttcgcaggttcattttatgcttttaacaattataatcataaactatttcttaatcgtaatggccccgagaaaaatcaatgatcaattgttgtttgagaacaaaattaatcattttttgagttttttataataattttaaatttaaagaaatggatgagtcgaaacgggaaaatttttcccctcaaaatgatgatgacgtcatcacaattggagacaacaacactcaaacactgcttgacctgcaaccggggccctcaaaaaggggaagcaagcctcgcttggacaaatccatngagaaatgcttcccaatgaaaaagcaaaagcatggaagctgaagggttngcttttctgcaaattctttgaatagccaatttttagta

SEQ ID NO: 33170 - DNA, 911 bp, Heterodera glycines
gcgcttgataacgctcgctagcagctatccgtttgatcctggctgaactgatgagtacatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataaagtttcgactccggagaaggggcctgagaaatggccactacgtctaaggatgaaagcaggcgcgcaaattacccactctcaacgagaggaggtagcgaccagaaataacgagaccgatctcttatgaggacggtcatcgcaatgagtaccatttaaaccctttaacgagtatctatgagaggccaagactggtgtcagtagtcgagttgattccagctctcaaagtgcatataattattgctgcgcttaaaaaactcgaagctggaactgtggtagtctactcgttgcacactttgtgcgttacgggaccacttgggaaattgtgcaaaccgatattacaaatattacaggtgaatatcctgacttcatttctacatattatatattcctgagattcaagagtatttccccgctcttattaattgtgggtaacatagtgaacccggacaaaaccctcgcaaaatataaaatttcaacgaccaaaatccaaattcgacgtacaaatgatctct

SEQ ID NO: 33171 - DNA, 759 bp, Heterodera glycines
  misc_feature (614)..(614): n is a, c, g, or t
  misc_feature (617)..(617): n is a, c, g, or t
agagaaaaatgggaggagaatggattgaatgtaaatacacatttgaaaataggattgaaaaatcgaaagaaaagagagggacatagaaaagcgacggagagcgaacggaacttatgttcagtctcaactcattcacctaacgacatgctatgctaactctcggcatgtcctcaccacacaaggacgtgcgtacgcaaagacagagaaagagatagactgggagcaaatgagggaaaaagggagcgaatatttcttttctggggattgcgattggaatggggtgagaaatgaacttaacaaatgaagagcaaagaaaatttcataaaaagtgcaacgaaagtggggagggaaagttcagttataaatcatttgttgaaaaggaacatgaatggacagggagaagcggctcatccgaaaaactggaaggaatttgctttacaattttaggtagattcacaaaagtgattgagtgaagaaaaaatttggatttataaactacaaaaaaagaacactgtgggtacactgcactgagaaaagaaaaatccagaacttttctttttggcattatgttcatgaatttaaagtggattctgcggggcactgtgtgcgtttcnggngttccagtttcggggccagcatgtttttggctataacttttttctttgtaaaccaaatccaacattgttggtgtcgttcgaaagcttaatctatttagaagctttttctaagatatcgctttgcgactagacaattatcaaa

SEQ ID NO: 33172 - DNA, 922 bp, Heterodera glycines
tgctttcgtaaacgccggacgattcagtacccgtcgaatatggacatttcagcacccattttatttatacataaaatggcaaatacgcccctaactcgcatttttctcatcattttaggaagtcattcaaaaacaattgttgcaataatttaagctaaattaattaaattacatacaatgatgcagcggaatgagccaaagcaacaaaattggttttgtttttacgtgggtacgtacagtcagcacaactgttattataatgacggtaacaatccatttcgtccatctcgcttataaaatcagtgaatgctttctcgtcaataacaataaattggtcaaagatattttcagccatagtgaaaatttggatttgattaaatctaaattttataaaggaataacaaatataattataaaaaaccgatttttttttatacaacaaaaagaggcaaaataaaatgcaaatctaaaatctaagaaaaccaatttttaagaatggaaacttaatgccaataacaagctgtggataatgaacataatggtattgaattgtacaaaaagtaattaaaatttaattttataatttatttattattaatataattgataaataaatacaaagagaacattcttaaaatatacactcaatttgcatttcttttctcttattttgaaactaataagcaataatatgtaaacaaacaatgaatgtgtaacaaacaattttttatttacttcttacataagatcaaaggactggggagttttcttaaaaattttcaaaaaaagtacagtaaatggagcaaaaaaaaaatggaaatttaattttaaaatctaaataaaggcaacaattttttgcaaaaacataacagtccaccagtgagtgaacccattaaaaaattccatgtgagatatgcttatt

SEQ ID NO: 33173 - DNA, 819 bp, Heterodera glycines
cataattggtttgagtaccccaaacggacacttgaaaaaatcgatttatttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctggactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttaatatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaaataaattctctccctcggggattttttccattatgtcgtccgttagcgttcgattgctctagtcatttttaaaaatttttgttgaaatatttgtcgtgctctgaagggcgggggggggggg

SEQ ID NO: 33174 - DNA, 825 bp, Heterodera glycines
  misc_feature (760)..(760): n is a, c, g, or t
aaaacggacagacattttaatgacaaaagcattgaattatttgacaaataaatcccattaaggaaaagcatgacgaaaacaaaagttaaatcaaaaatcgaatcctgttaacgattaccagttcattttctattaaatttgttaactttgctgatgagtcagcatcgtcccttaatttaagtaatgtttgtcaattaagtaattattccactttttgtaaatgcgaaaacaaaaaattaaagaattaatttgtaattttaaagctaaagaaatttaattttgtaccctcaaatgaaatgctgagataagacaaattaaaaagaaagaaagcatttaatttgtctcttctcactgcgtgactttgcttcatcgattgcggcgacattttataattttctctttcttttcatcagtttcccaaatttttctgattatttttaaaatacttttataattaataatttatttttaattttaaaaagatcaattatgtttttgtgtttattccttttaattgccatttcaattattccaaccacaaatggctacaaaatgctcgtctacagtccgtcagtaagcaattcccatctgatttcaaatgcccgggtggccgatgtgttggccaatgatggccatgacgtggtaagaaattggcattttgattataatggcattttctgcgcacaaataattcaaaaaaataaataataaatttgcggtattttcaaatcgtaaattattttaatttcaattttcttanaaatgactatccttttcagactctgctcgaaagtcgaatgatggctccgctggtgaaaacttttc

SEQ ID NO: 33175 - DNA, 589 bp, Heterodera glycines
gagaaacataggcgggcggagggacggacggcggacggacatacggagaacgacgctggttacccatcaatctgagaaaatggcagaaaatcctggcaccagtcgcggacccccaaccttttcgagctaagcgaagcgatccccgacactttgaagttgccgcctctgctgccgttgcccgcggcggcgtttccctcccgtgccatccctccgcctttgcgcgtgctcagttgccgcttccatcgtttggtcaaatagggcgaatatttgcttggctccaactgcacgaattggtgcgaaagttcgtccgactgatcgcggcaaaagtcaatttccaacttaaatgtgagaattgttggcatttattaatttaattgcttttttgtcctctctacgacctgaatttggtgctgaatgaggtgaatgtaattgtaaagcatcggcaccaccaaaacggcactgactgtggtgagagtggccacggcgatggcaatgaaagcgcagcgccgcagtttgagggccaaagcgaattcgtcaaattggggggagacgcgcacaaatccctcgggggacggcgaatttccctttt

SEQ ID NO: 33176 - DNA, 572 bp, Heterodera glycines
cgtatcgtcggtctgattattagtctggaaccacggtcttactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctcc

SEQ ID NO: 33177 - DNA, 943 bp, Heterodera glycines
caataaaaaaacatttttatattatttaagtcttacacattgtaattactaagtgattatcactaattaatcagtttcaatttttatactttaatgatgacaaatgggtggaacctttaattgaacggtcttttgctattgatttgcaaaaatcacttttaaaactaaaaataggagatgattataaaaattgaacaattgataacaaacatttcttaatttactttcaataatttatttaaatatcatttaaattcgaaattataaacagacaattttttcattttcaactttccaagaataaatgtgtccttttgcttgtgaaaatggcaaaagaaaatgtcgcgcgttaaatgttattaatatataataatagggatgatgggcttgttgatgacacgaagcagcacataagaataaatgttaatttgttaaataaaatagaaaattaattttttaattttgttagtctgctgcactcaaaagtttggactttttccttcaaaaatatgttagcagataagttttgcactacaaaagtattaaatttcagagaaaaataatttggaaaaataatgcgggaaaaaaaagtttgaaatttattagcagttatcaccaaaattaaggaatttgggaaaaattaaaataaatttgattttttactataatcacacgaaaaaataattaaatttgttttttttaatttaattttcaactttaattgagtgaaattttccctattaattaaattcaaaacaaatttttatttactagcaaatccctgaaatcactggcattttttgcaaagaatttttcttttctaaagagcccattatttttttccatgacagctgctcactttgttggtacatcttttgcaccaaatctccattctttcatcgaaactcttctctttttatgtatttttgatcaatttccaaaa

SEQ ID NO: 33178 - DNA, 843 bp, Heterodera glycines
cctgacatggcgggtgcaactgctgctgttgatggcgtcaagtcggggggaggagctcgcgcataagcgccggggtttggagccaaagttggataggcggtgcctgtgattagtggcaagtgatcagaaaagattaggaagcccccagatcatatggcaattgaattcctcctgtgatcagagtcaagattggagaatgaaaggaccgtttcgtgaaaaatcggcgagaaaattccggaaaattttttactttttttttggacggcaaaacaaaatactgtgattgaaacggtaggcaaagtggaaatttttttgtacaaattccatcattaagcctgtcccgtttagtagggtttccgttgtgaattactatacacgagtgtacggtaatggcggattactgtaacggtaacatacgcttggcgactgttatgtgacaattacctggggcaaaagcaacccttgtcaagtcaaatcgcgctcgcaacggcaacggtagtgggcgggacggaaacggcggtgcaaatgcttttggcggcatcaccggcgcggacagtaccggcacgggcacctgctgtgccatgtactgtaactgcctaagctgtgccgtttgcgcatcgctgatcggagacggtggcggcgctccattcgatggtgccgccgccgaagcggagggcggcggccctgcgggggcatccgccgctgctgcaccgccactggcaccgcctcctcgtccggcgggcccttgcgcagcagccattgatgggccaccaccgccttaatgaaagcagaattggataaccatactgtctgtacatctgggtacggtagataaacaaatga

SEQ ID NO: 33179 - DNA, 897 bp, Heterodera glycines
ttgagttcatctataaattatttttaaaccttttctttctacagaattttcgcatatacgactacattatttgcattcatattattgtcaactttaaacaaaagcaattgataaatattttcgttattaagacgagtggttttgggctatttcaaaattttttaataattgcagattaatgccgcgtcggctaccccgtttcttctctagtaattatttttggcgttcaacaagcattatttatgaatatttttaatatgttggacatgaggatttgagttcatctataaattatttttaaaccttttctttcaacagaattttcacatatacgattacattatttgcattcatattattgtcaatattaaacaaaagcaattgataaatattttcgttattaagacgagtggttttgggctatttcaaaattttttaataattgcagattaatgccgcgtcggctaccccgtttcttttctttctacagaattttcgcatatacgattacattatttgcattcatattattgtcaatattaaacaaaagcaattgataaatattttcgttattaagacgagtggttttgggctatttcaaattttttaataattgcagattaatgccgcgtcggctaccccgtttcttctctagtaattatttttggcgttcaacaagcattatttatgaatatttttaatatgttggacatgaggatttgagttcatctataaattatttttaaaccttttctttcaacagaattttcacatatacgattacattatttgcattcatattattgtcaatattaaacaaaagcaattgataaatattttcgttattaagacgagtggttttgggctatttcaaaaatttttaaaaattgcagatta

SEQ ID NO: 33180 - DNA, 98 bp, Heterodera glycines
taccagtaccatgctgttttggttattgttgccctgtagtatagtttgaagttaaataatgtgatgactccagcttacaaatactttatattttttat

SEQ ID NO: 33181 - DNA, 896 bp, Heterodera glycines
  misc_feature (88)..(88): n is a, c, g, or t
  misc_feature (862)..(862): n is a, c, g, or t
  misc_feature (873)..(873): n is a, c, g, or t
tactcttggacacaatgccaatgccatacaatgcacaatttgaaatggatgtaaagccaacgacgcttcgacgcatggaaagcatacncggaggaacattttatggcattagaaacgccaaaagaaatgggcgaaacgtctgctggacaggaagaaaagccatctagcgaactggatgatatgcaaaaataccttgaacaattgccaaggacaattgagcaagtgccagaaacgccaagagaaatggacggtatgccaaaagacccgaaacaaatgccaagagagttgaatgagaaagttgcccaaacgccaagagacgcgtacgatattcaacaataccttgaccagttgccgaggaccattgaagatgtgccagaaacgccaagagaaatggacggtatgccagaaacgctaaaagaaacgggcgaaacgccaaaagacccgaaacaaatgccaatagatttggacaatgctcaacaagagctgaaccaattggcaattgaaaatgcgccagaaacgcgacgagaattggacggaatgacaagagctgaaactatgggaatgcttggcattatgccaaaagaactgccgaaaaagccaaaaaagacaagaaagatgagtttgccagagcagttggccatccctccaaaagatttagaaggaatgcaaagcgaacacgtcgatacgccaagaccagaccaaaaatatataccggacatggaatttatgaaataccgtattccatacggtacagagacaccaaaagtagatgataataagcaggaagagaaggcagaaaaggtggaagagaaggaagaaatggaagaaatggcggaaaagcacaaagagtcagaggaaaggngagaagagttnaaagaggaggaggaaaagcgacg

SEQ ID NO: 33182 - DNA, 856 bp, Heterodera glycines
gacgacattctgttgaacagtcagttgggcttgtccatcacattccaactgtacctgggacgatggagcaacacggtgacaatgtttgcaagggtgagtgacgaaaaaaaataataaaaaaaaaatttttcaatttttttattgctttccagacttaccatgaagagttgaccaaccggtttggaggcgactattcacactcggtgctgctgaacaaaacaggaggtaattatgcaaatgtgaaaatagggctcgcgattttctggaaaaagtgtgcctttttgaagagttggttaattttttaacctatcccgctaaaattttgcaattttttccccggcaacgcataccattggtccttcaaaaacaagtttttttttttttaaatcgggtttgtttttgtgtataatggatgattctttaaaaaaaatttccatttattttttgcagtgtgcagctttgccatccgacttttgcaattccggaagcaaatggacaaactgaaaaccgtacaagcaaaggacttaatcttttcggtgggctatttttttggcaattctaatatattttttctttaattttgaacattttaaacaaattttacattttcccatttagcaaatgccacgtgaaaaatacgcgctcgtccagcacacgttccgtcaactgaaccaggcttacgtcaaacggttgcacagtgcgggcagcagtgccagtgccaatttgtcgtcgacagtggcaaccgccggtgctggtggtggtgctaccgctgagagtggtggcacatcatccagtgatcagcaacggtactcatcatcagcaaccagcacagctgttgcagcaccgttgttgacct

SEQ ID NO: 33183 - DNA, 793 bp, Heterodera glycines
tttcagtttgtccccgcttattctttccccgattgggttcaggtgagtccctttttccatatatgtcctaaatttgttcgtccatttggccactttttcagccctcttgttctctccccttccgtgtgagtttccgccccccccccctttttcacccgtccccctaaattctcgcctccctttttcagtttatctccatgggttcttacgcccggtctcttcaatccctacataatcaggcacgtgtcgtccgtcctctctcgtcaatgcttttccctcgttcagtccctacgtgttctcgccgttcatccttggccctctcatcctccatccgttcattctctccccttatgtccgttctttccaagggcgtaggcagggggaggggggagggggggggaaatgtttgctgacaacagaatgagattattaacaaaaaatcatcgagaatgtattaggtttgcatttgtgaagatatatattgataaaggtagaatatataaggctcatattcattttttgggagacttttcgagtattttttaagttcgtctaacagggagaggaacttaccaatatacaggaatccggacgaacgggaataattgtcccattttgtcaggattccctgacattttacccaaagagaaacctcgcgaaacgcaaagagtaatcaccgaaatttgaaatttccggactctagaaaattttgtacaaaaaacatagcgtttattgcagtgataattatagattgaattattagaaaacttacaaaattttcacaggattcatt

SEQ ID NO: 33184 - DNA, 1300 bp, Heterodera glycines
gaagaattgtcccctccccggaatgaaaaaaaaacaaacaaacaaaattttcaagaggtaaaaaacacaaattttttttttttttataaactactttagggggcagaaaaattccttcccttcctaaaatttaaatttttttgaattggaaaaaactcaatttttgactgtcctcaattcccgccgacagattctgctctaccaactccaatgctcggagaccatcggcaactacaacaagttgaagcagttcggcgactcctttctggtggaggcctccgttctgttgccgggccatgggctcgagcacttgcaacaggcagccaaatcggtgaaggaatttgcggaccaactgcacccgttgtgcaagctgagctacgtggactatggcagggattgaccgggcacggcacggaggacagcgaaaatgccgaaaaatgcaaaattggaatttctcccaattttttttgatttataaaaaaatttcttttttttacttgcttattttgatgcaatttattatgtcattcatgatcatgaacattatatttatcaatcattccgaattatttgtttatttaaaaattaaacggtgaccctttttattttttctggcaaaaaaaaaatcgtttttacaaaattttcggggttttgccttttttggttctaaaattcacaaaaaattatatgtattaaaactgaaacgctcactttgaatggagagaggggccttgcaaattttcaaaatgcaccgcttttaactttacataaaaaaaattataaatttttttttaaatccaaaatttttatgccagaacaatgctcttataccattggcaactacaacaagttgaagcagttcgacgccttcttctgtccgctggttggtgcctccgttcttcttccgttgccgtcggtggtggtcaatgcgttcgaccatttgcaacacgcggcggtggccaaaaacgcgtcagtgatgatgaatggaaaacggagagggagcagtatcagaagtacgagcaacacaaccagcaacagcagcagcagccgagggtgggcaagcagggcggcaacggccaatggcggaaaagcggcggcgccgtccggggcaaaaaaagcaccgtcgtgcgcaacgatttcttccaaatttatgtgcgctcgggcgcgggcggcagaggactggcgaggtgagagaagccatgtttgacagagaatgattagtgaatggtggggggtgggcagggcatgtcgaaatttacggcattagtcgaacgatttaaaaaaaacagttgcgcctgaa

SEQ ID NO: 33185 - DNA, 792 bp, Heterodera glycines
attaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcacggggactgccccgaaaaacccaaaaaaaattttttggataaaaattaattttaatgaactgactaaaaaataatttaaaataaggtattttctcttccttttcaggatcccctggaaaagtttgggtgggcttttgataagttttctgaaaaaaaaaattaaccctaaaattttttgcccagttttaaaaaaaattaaaaaaatttttaaaatttttttttccccccctttttttaaaaaaaaaaaattcaaggggcccaaaaaaaaaatgtaaaaaaaaatttgggggggtttaaaaacccttttttaaaaaaaatttttaaaaaaaattttttttaaaaaaaaaaaaaaaaaaaaaaaaaacccccttttttttaaaaattttttt

SEQ ID NO: 33186 - DNA, 963 bp, Heterodera glycines
  misc_feature (14)..(14): n is a, c, g, or t
  misc_feature (27)..(27): n is a, c, g, or t
aatttatgaatttncggataaattttntggggttttttcttgtttttttgtcaaaattaatctttattttctaatagtttttcaccaaaaatttatgaatttctgtgaaatttaattttattttttatattttgtaaaaaatattttgaaaaatattaattttgtttaaaaaactatattaatcacaaaaaaataaattaaaaagaaaagtcaaccggtatcgaactcataagaaaagaattgttattgttaaagcaataaccactataccacacaatatacaataaacaaaaagaaatttactttatttaataaaatttggcaaaatggttaaaaaaattcaaatttcttataacttttttgccttttcccccacaaaaattccattcttaggggtgtatatttaaccccgaccccgatcggggttaagggtcggggttcggggttggaagcgtcggggttcggggtcggggttttccccgaaaatggccaaaaatgtcggggttcggggtcgggggcggggtcgggggcccaactctactgtaaattacaatacattatactgtagagtaccatttgattgcccaatcctgcacatgaaccgccagtcgggaacacatatttgtcaacttttttggggaaaagcctggaataattttgaaaacgataaaatataattttaaaagacttaaattgagaccgtcacaaaaaatgtcatattcaaataccgttcatattcttcttccgtaggatttggtttgcacaacgaaaaggcgaattgcaaattcggatcggatggctcaagggaatgcgatggttggacaaacttcaaagcataaaattggaccaaatagccaaaatggaaaaatagttgctatttccatatagccataaaaagataaataggtaaatcccaaaaattgtgtccgttttgtctgatttgcctttcttttacccatgctt

SEQ ID NO: 33187 - DNA, 745 bp, Heterodera glycines
ttatatttatttatttattatcctcttattttatagaacactattttagatttcttcactcaactgttcaataattttattttgtatgaattaccaccaataatatacattaaataatctttttttttttaatttttcatgccgaattccaaggtatttttgaacagagaatcaaatcaattcctcatcattaaatttagcgattttattaattattgtatctttttgtaacaattaatgtctttaacgctaggattttgtttaaatttttactttagcatgtaaaaaataaccaaaatacttttgacgctttaaagaattaatattgtttttaaccattaacttcgtgataatatttacttctccagacactcacaatcagatgaaggctggcacactttacacaagattaaaattattttttgatttttaaaatttgattgcattatcatagaattttaaccaaaaaaggaaagcttatttatttaattggaaatatcacaaatttatcctacactcgatttatacaaacattgttggatcctataaatttcgaatgatttttttttattttctgcgtcctatactaaataaattttcaccattttggatcctaaaggtctaaatgtattttctaaggaaaaaattaggttttgggtgcattcacaattcccaaaattgaaaaaaaataaaaacatccagcaagaacattatgcagatgcaagtgttgcctttatattttttt

SEQ ID NO: 33188 - DNA, 975 bp, Heterodera glycines
ttgggtgattcatttaattgatgatgcccgagttggtaaaacgattgttcatttcttccaatttttgcatgggttcaattcccattggcgccgggaggcattttctccctttcctcagtgggcaagagattgtgaatgacgcgatttaattaatcgttggctcgcaaactctaatcagacacagagggcaaagtgatcagtggttcatgttgatctcccattgtacccgcttcaccatcgggcattgggttttgcaatggactaacaatttagtttaatttcattttataaaaaatgctttttatttattttagtgtgtgtgtgggattttaggcgctaatttgacatattatgttgaaaatttattgaatgcaaatacgtttttatgcgaaaaattatttttgaaaaaaaaaacatttctcattccgtcttccagaaataagaatttatttggtacttatccttttttaccccctcttgaaaaaaaatttacttctaaatgggaaaattttattcgctttggtcagatttttgcaaatttgactccaagttaatgcgcattagtcaatctttcgtcatgattttttttttatatatataattttttccgcacactttttaaaggtcaaacaaatttctgtctctgaaattctgccccgcacttccgacctgatcttcctgaacatcaaaacgtacgaaggtatggggtaggcaggcgtaaaaaaagttacaaattttttttttgagaaatttaattttgtttatgttagaccatccttacactttggaattgaccatgaaaggatggcgcgtttgttccacgcacaccgattgtatgaatggtaagttttgcaatttattattggcaaaaaaattttaaattttcaaagttttcaggcgattatcacaacgtggcactgcacacgcgctattttcagaacgcaaaggaattgcttaaggtgaaaacaaaaattt

SEQ ID NO: 33189 - DNA, 1076 bp, Heterodera glycines
ctttccctgtctctagttgtgggtggttctcccatcgcctactttcttctctcatatcttccctcttccccatatatcaataagtgccctttttagggttgttttttcttgtacaaaatttttggccattttttctaaagctgttaaattagtctgctgctcaattgttttttttggctctatattttctgtgggggactgatttgtgttcgtgctcactttttcatttccttttctttggctgtccacagttccgtccatttagtgccattgatcatcgaatctttgatcgattgataaatgtattttaaaatgttgataagtttggcgatccaatctggcgaaatttctttcgcttttttaggttccggcaaattgatccagctcaatctggcatcagggccaaatcctttccgcccgaattcaactgcttgaaacacggcataggtggttgtctggtagtggaaaattcactatagaataggttttgttcctccgctcagggtgtcataaggttaagcctaggctgaagccttaggcttaggcctaagctttagtctaggcctaggctttcgcaagcctaggcttaggcttaagctttattttgtgaaatatgagttgtcttttgcacgagtagccattttccgccccccccctcctccggaattaaaagtttttttaaattttattcaatttcttaacgaattttactataaattttataaaattttccctggtggtgcctagcgacaacgccggaacccaattttcctatatttttccaaaatacccgtttttttacccgaggctccaaaaatttaggaaaaaactggacaaaaaattttcggccagaacagaaaaaacagctgttcgggtgcccctccttatttctggttataggcctgtccccgtttttcggcaagagagaagagtagggaattgggggggggggggtaaagcattttgtccaatggcactctaaacggtcatgcatttgtccatggagggatgccaaaaaaaacatatatttctcccaaaaattgcatatacaaaagattgatgatcgggcttttccc

SEQ ID NO: 33190 - DNA, 665 bp, Heterodera glycines
attctgaacgattcctccaccgaacgctcccaatcggggcggcggtggggcgattgtcgttgtcgttgtggtggtgctgagggcaacgaattggttgtgtccaatcgtttgcatcaaccgactcacattagcgtcatcatcagagggaaaggatgccgcaacggcgggtcactttcagcctttggaacgatttgctgagtggtcgagaagaaatcggcagttgccagagacactgtccgatcagaaacgaagggccaaatcactgaaggagtgctggtcattgtggaccacagataggaagttgttggttgctaaatcacaaaaacatttggcaatgtgccacaattaaaatgggaattgctgttgtccaaaccgatcaccgacttgctttgacgttgttctaatggcttgttcagttgtcatttgatcagttgtccgttgctcagttgtccgttgttctgttgtcttttgttcaattgtcgcttgtactgttgtggccattctttctatcgtccttttcggcgagttcggctcggtcactgtgctccattctgcttctgttagagtcgtgatggtgctgttcctccttggaattgtgttatgacttagacggctcggacactgactccgccgttgtccccgttggcttttctttcgaatttgct

SEQ ID NO: 33191 - DNA, 874 bp, Heterodera glycines
  misc_feature (26)..(26): n is a, c, g, or t
  misc_feature (770)..(770): n is a, c, g, or t
  misc_feature (784)..(784): n is a, c, g, or t
  misc_feature (787)..(787): n is a, c, g, or t
  misc_feature (816)..(817): n is a, c, g, or t
  misc_feature (837)..(837): n is a, c, g, or t
tacaattttgctctaaggcatttttntggctaaaaccgacccctgacgagttatgggcccgggactcaaatgtcccgcttaggccaaaaattttttctatttccggaaaaaaatcgaaattttttcaaaaaaaataccattcgatagagctcgaaaaactatgttttggaagtggtcttcgttttcccgggaaaattcgttaaaaaatcataaaattcaaaaacccgaaaaccgttttttaggcctaacttgaaaaattttgaaaattttcgaaattttaaaacttggttggatagcctttcaaatactacacatttttgctcagaaacaatttttcggtcaaagcaacccctggcgagttattcgcctggtactgaagtgtacacttttgggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgcaagaaaaagtgagaaatcgcttcctgggactcagtcgtccgcgctgaatttttttctatagttttcccggattctcctcaaaaagttgtaagacccttccactactttcagacccgtcccattagccgttaagctgaatattagtttttgaaacgaaactccttgtcaatataacatatatattaactagccggtgtgtgcttacatgtttcttgggtgcttanagcgcttcgcgctntgngagcttcgctacctaggaactgtgactannagaggcacaaaagtgattanaagaggtacaaagtgataaaggggatgggaccatccc

SEQ ID NO: 33192 - DNA, 597 bp, Heterodera glycines
  misc_feature (140)..(140): n is a, c, g, or t
aaaaaaaaaaaaaaaaaaaaaaaaaaaaaaaaaaagaaaaaaaaaaaaaaaagggggggaaaaaaaaaaaatcaaaaaaaaaaaaaaaaaaaaagggaaaaaaaaaaaaggggggggaaaaaaaaaaaaaaagggtgccnaaaaaaaacaaaaaaaaaaaaaaaaaaaaaagagagaggggcaggggaaaaaaaaaaaaaaaagaaaagggggggggggggggtggggggggcaaaaaaaaaaaaaaaaaatattgggggggggtgagagaggaaaaaaagaagaagaaggagagaaaaaaaaaggggggggggggaggggaagaaaaaaaaaaaaaaaaaaaaaaaaaaaaaaaaaaaaaaaaaaaaaaaaaaaaaaaaaaaaaaagcggcggcgcgggggcccccccaaaaaaaaaaaaaaaaaaaaaaaaaaaagaaagagagggggggggggggggggttcatccccccacaaaaaaaaaaaaaaaaaaaaaaaaaaaagaaaaaaaaacacccccccaacacacaatttttattttttattttttttttttttggagaaagaaaaaaaaaaaaaaaaaaaaagagaaaaaaa

SEQ ID NO: 33193 - DNA, 638 bp, Heterodera glycines
tttcttaatttattccattgactgtcattttaaaagctttttggtgcgaaatgcaaaaaattttcgtttcccccccccctgtgtccgcttcggattttctggttacctgtctgtgttgcaccgccagcctgtcgccctcccctcatctgcaggcacaagtcgcgggagcagcagttgcggtgctcatggtggacacggacattgtgctgagaaaaaaaatattttgaaaaaaaaagatgcggtttttttgtgaaaaaattatttttttcgaaatttcgatttgaaaatcgacatacaagtcaaaatatgtacgaatcaacttgaaaagcattcttaggttaaaatgggtcaaaaaatctttgaaattgtttcacccaagccacccctaatcaaaagcataatgataagccatgtaatcccacccaaccgacaacctggacttcccgcgactttgtgacggcccggcccgaaacgtaactgccgttggcaaacggccacatgtcgtggatgacctggcgcccattttgagggcgtgttcagcggagtgaacagagaaatggcgtctaaaaagcgggaaaaatagaaattcggaaatgtattttatggaattcggggcattgaaattttgcgaaaaaaac

SEQ ID NO: 33194 - DNA, 1121 bp, Heterodera glycines
tcttttctcggcgtgttcaaccatttagacaacgcttggccagcagttgcatttgggccgtcatcagcgatcatatcgggcaacaattcaaaggaatcgattgagtccaattgatcaaccagatcagtgagaattgtcggcgaagtcagacgacgcaaatcgtccaaatgatagggataggtaaattgcaaatggcgaatgtttgtcacgaaaatgggccaaatttcgcgggtaaaagcctcccaaattggctcatcatcctcatccaatgaatacagataaaagatgaaactggtgcccattctgtcccaaatccgcttgttggagcggagaaaagtgatgacagagtgatcaaggtagctaaacagggaacaacaatacttaaatatgtacatacagaaaatggcaggtgcacccaaaaaaatttcgccgtcgaagaaaaaactaagatttagaaattttcaagaaaatagaaaattctagcgttttttcgaaattttatgatgagttaattctttcaaaattttcaacaaaatcgcaaaaaaaaatttttttgaaattgtaaaaaattctaaaattttttcggtacttttccgttttggggccaaaggttgaattttttaaatcaaaagcgggtgagtaaaacttgactcgtatttgtgtgaattcctctgacgcgaaaatgtcaaaaccctgtggcgcagacccttcattcgaagaaatcttagctctaattatggcatttatgcctcgcaataattttggcgcgtagctttagcaattctacgcgcccgttttcggcggcgaaattttgtcctgttccgtaaaatggcgatttacttaatccgaaggtccttaaagcggattttgtcgggcatcggacggtccggcaacagaaattccacaaatttgccatcgatcagaacagaaaatttcggttttggtccgatggccttgcgaatgttgatttgtctccaaattgtccattcgcttttgccgtcaaaatgtttgtccaccaacgcattgaaacggggcgaaagcaatgccaatttgagaccaagttgggcatggccaaagcatggaagaatgtccatccaaacatcattacaaatgcagctaaa

SEQ ID NO: 33195 - DNA, 587 bp, Heterodera glycines
tgattcggttgtcgcacctttggcacggggggcgcccccattttacgacggacagtgaaaatggccaaactgcggctgttgcacggcacaatcgtccgccgatgccacggccacttggcccatcgccctgtgcttttccttcctgctccgctggacatcattatgcttcttgtctcacacctttactttctcttgccgtgttttttgggattttgcagcatttggagggggaggggagggagggataaagagggagggggtcatttcttggggggggggaaaggagcagcgataaacggagagaacgaaagagcggcgggggacaaagggaaaagggacgacggagtggacagcagcgagagcagaagccgggccaagacgcgttctcaatttgagagaaaagagaaagaagtggcaaaatgcacttttaggaatttgtccttagctgctttttcatcatttcgttgccaaattctttctgtttttttgtctgtcaagtttctgtattccgattttaccttcaagactcgaaatgttaaagtgtttgcttttgtctttccgcttttccccatggcatcgattgcccc

SEQ ID NO: 33196 - DNA, 623 bp, Heterodera glycines
cccccccccctttcaggtgatcaaccctggggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccacccacccaccgtcccaaaattgtcattttgtcccccatcatgtaaattgttgtatctgtatgtaaatttctgtgatcatcacttcaaatgaatgtatatttaattgttgcctatgtaattgtattgttgttgtgcttaataaatgttcatatgtgcttcaattcaaatgcttttgtaggaaggggggcggggtggtaaaatttggcgtctgtttggtcggagggttagctcgcgtagaactctgtctgctcactccttgtaaattcaggtcaaaat

SEQ ID NO: 33197 - DNA, 881 bp, Heterodera glycines
attcgcctgcatatccgtccagcttgtctccgcagaagcggacgatggactgactgattgatgccttttagcaaccgttgcgaatgatttatatttttgtcacaaaatttaattttttttttcgttgcaaaattttcatcatttgataaagatggcttggccaaaaatccagcgatttgcttttacattgatctggattcgaatggataaaaaagactggagtgatgatagccccgagttggcatgcaagggaccagcagtcagagcagtagagaccggcgagggacgtgatcccgcgcgggattttgcgggatccaagcccgcaatcccgcatttttggaaaatgcaggattaatcccgcggaattccgcccatcaaaaagttcgagtttcaatcccgcagcgggatccgcaaatttggtttttttttggcgtgctaaaacgcacggggaggccgaaatctttttggtctgccaaaacggtgctgttagttttcgacagtggtgatctcgacagtgattgttttcgacagtaaagcttctttaaaaaaaaacttgttctatatggtataagtccaaggttacccttgaaaatttcccgaaataagtacttcgctggtcaaaaataagattttagggtaaaaaaataaggacattttttaaaacacgcttccaaaactaaatcgcatttttattcaacaaaatcaagcattagcaacatatttctcgccgccaacatttttctgagcaattccggcttagaaatgagaaatgatacatttccgaacaatttttaatcaaaattcacttttacttgcaccaggcttttcaatgtttctacttcaagcaaatttctcgtattttttttcgcggttttgagtca

SEQ ID NO: 33198 - DNA, 242 bp, Heterodera glycines
cagacgctgtttccaattttgcaagaatatgtcagggggggggggctctataattcattccgattcggcggcaatgtatgtcaacgttcgacgacagcagagccacattgtcaatatcccgaccattccaatgccaccatatcgtcatgtttgggtcaaccaccgagccaattttattgatcccctcactggtgcttgtacgaatttggttgagggattttggcgcccggaaaatgcgtcag

SEQ ID NO: 33199 - DNA, 101 bp, Heterodera glycines
tggccttcatgttcacgccgatggcgtcgattaccggaatcgacttaccgtcgccgcgccccgtctcgcgcttgaagtcttcggcataggcaccgacgtgg

SEQ ID NO: 33200 - DNA, 780 bp, Heterodera glycines
agaaaaaacagctcatttccaagaataaatgtcaaatttcttggtgtttaaggggcaacagaaatttggacagtaaagcgagggaaaggtgggaaaatagtgctcaggccggccgttgagaaaagcggtccgtccgtaccagggctgcggtgccgataagcgccgcctaggaaaaattttcagaaattttaacgaattttgttaaaaatagccaaattttttaggcatttcatcttttccccttcgctagcctcccgcccccttttatgtatgttaataatactacaaatttccaagaataagtcagatgaaatcgaaatatgggtagcagccttttaataaaaaagaaaaaaaaattcattttataaaaaataatcttacaagaaatcgtctcgaaaaataatccaatagtcaaattacggatcaaaattgcggataaatcccaaaaatccgcaacccgcaatccgcaattacgggggtccaaaaaccccgcaatttccgtaatccgcaatccgcaattgcgtccagccctgtttccaacccaaaccaattgcccatccctctgaagggtaaaagacgtatgaatttagataatggaaaaaggcggacagatttggcacataaagggagagagagagaggtggggatgggaaaaagagagagatagagagagagagtgaaagagagagagagagagtgaaagagagggatggagaggagaagagagactgatagagaatagagagacaagagagagagagggaggaagagagagagagg

SEQ ID NO: 33201 - DNA, 1006 bp, Heterodera glycines
tcaataccagaaatagtttgtgaaaccaaaaaaaaataaataaaggtttggggaaactataaaccaaaaatggaaattgttttgatgtgtccggaaaccagaaaccaaatcaggaattgattttctgataatacaaaccaaaacagaaatagttgtccggaaaaacacaaaccaaatcaggaatttatttgcggaaaaatattttaaaaaacataaaagttttgtgtaaaacacaaacaaaaatattaaaaaaatttttgggtaaatataaatcagtaatgtgaattttgtttttgtttatacaaaaccaaaaaacagcaaaattaaataaataaataattattgtaatgcaaaaatggttgtttataaatcaacttttaattaattacgaattgattgcaaaaatggggttagatgtggaacattgggctcagtgtgaactgctcaaaaaagctgagaaagtttgccgccgtgtgcctaattcaattcatttcagagggcttttgatgaagtaattgtgcaagagtaatagcgaagtgtagatggaattaattacttttaaaaattcgttaaagaacagtaaaaaattaaaatttgtttgtttaactttgtttgtctttttttgttagattgtattttagaaattaaaaatgggtataaatttaattaaaatttataaattatgaatttatttagaaaatatggatttacaaaaaagatttaaaatgcttgggttttaatcaaaccaaattttcccattaatattatcataatttaattgggtaggtaaaaagtaaaatgattttttacagtaaataaattcaatttaattttgttaaagtaaaacattaaaaaaatttcttttgcactgtttttttgacttaaaaatttgtaacttaattaaaaatgcattaaattttcttgaacccggaatcaatattatatggcaaattggaagggggttctcatcgccgctttttccattcgcattttgcttctgcaaaat

SEQ ID NO: 33202 - DNA, 592 bp, Heterodera glycines
taaagtacaggctatagggaagctattctcgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtgcgtttggggtactcaaacaaatatggggagcaaaaatccaacgcagaattaaagcacaggctatagggaagttattcccggaaagattcggtctcccccataaatctgggctcatcggttcgggggggactgccccgaaaacaaaaa

SEQ ID NO: 33203 - DNA, 977 bp, Heterodera glycines
  misc_feature (10)..(11): n is a, c, g, or t
tttattttannattaaaatttttgaaatttgcaaattttccccatgtgtgcatgcgcttacccgacttgtcaccggctctttatctgcaccgtttgcgggcggaattctgtcgcccatcggttcgggcccgtcgtcgcctttgaaagggagatcaatgatttaaattttgactgatcacctaatttaaaaataaaaattgatcagtcaaagtgtctgtggttgccggaaatccaaaaattctgtttaattaccccaaaaaattttctctgatcacccccggaactccattccaaattgatcatttaagaaaaaggcttcttatcgctcggtattccattcaaataaaaaagaagttttaatcccccaatcactcaaaattttatcaatttgttctgtttaattacaccaagaaatgttctatataattgatcatttatgaaaaaggcttccgatcactcggaaacccattctaataaaaaaagttttaattccacaaatcactcaaaattctaacagtttgtctgaaattagattcagatcattcaaatcttttagatcagacttaatcaattttaatcattcgaaagacactctttctttaatcactttagagaatccattatattaatcccaaacaattttccgttaactaatcccgccgaaaactttcagatcactcggaatggaattctaatcatttcaaaaatgccatttctattgcttctccctctcctccccaatttgttcacttgctgctccggtggttgtggcactgagttccaatgcgaatgatccgccgccggcaccgccgcgtgccggcggtgccctcgcttgggcatccggctgatttttggacgacgacgacggcgatggcattgtgacgcgttcgtaccggctggcagaagtggaatgcaaattggctggcgtgttgtgaaggcaaatctgataaacattttgaaaaattattaatttaaac

SEQ ID NO: 33204 - DNA, 877 bp, Heterodera glycines
aaaaaacttagcaaatagtttttttttgaatttctgcggcgagatttcggccggcgagatttcagccggcgagatttcggcggcgagattttgtctcggcgagatttcggccggcgagattccggcggcgagatttcggcggcgagatttcggccggcgagattccggcggcgagatttcggcggcgagatttcgtcccgtcccccataaaagttagcttacaattagcaggaatttttttaaaaatcttgcctataaatatttagttttttgaatttgtaatctttggttttaaatacatgaccacctaaaacgaagttgtgacgtttttcgacaaggctgcttcgaggcaaagcttattcaagttaattaattgaaccgttggaaagcccacaaaaatgcaataaaaaactaaggagatattttacacattcatcagcaaatagaaattttatcactatttaaatcaacaatcattaagtggtgttaaacatatgaccacaatgactatatgttaataattattgttatagcgagagggctttctgagggcactgaacgaaagcggacttttgctggaggagcccgaggccatcccccacactcaccttaacgaccccaatttggtatgggaaacgtttccaattcagcacaaccgagctgacaaattggacgagttggacttgagtctggaaccgggcaaaggcgtttgctgatggcacaaataaaccttttttgtcttgtttccattttgtttctatgtgaaagatgggcaatgaaattttcgaacgatttcggtcatttttttgatttttcattcgttctttctcattttatgggccagagacggatgacagacagccctatgttttttttc

SEQ ID NO: 33205 - DNA, 832 bp, Heterodera glycines
gggatgggttgggaaagtatgaaaatagggaggagagggggaaaaggaggaaaattgggcaaagaaaagaaatacgcaaaaaaataaggaaaagggagcgggaaaaaaagatgagaaaatgaaaaagataagaatagccaattaaaaaggaaagaaatggcaaaagagagaaaaacaaagaaaaacgcaaagggaaaagagaaaaagcgcaacggatgaaaagaaagaggtccccgaaaaagttcaaggagagcaaaacggaagcgcggaatgtaatgcaagtcgatctccaccccctaattaccctcctaattgccgcccccccccccactgaacttccgtctcccactcattgcgatcagtgtttacttttcctctttttacttatctttttaaaatggcagagaaaacattgaaaatggggcggaagtctgaaaaagagacgggaatttttgacgaaatatcacagcagttggcattcaaaagtatggtcttcttgcttattaagggacaaatttatattgttaaaaaattgcctaattttgctgcatttttcgtttttgtcccatcgccgcgtccctcgacaaacaaaaaacgatgcccttaaaaacggaaacgcaaaaaacaaaataaaacaaatggaaatggacgccgcgccgcgttagaatcaaaacagcagcctttgtcccttttcaaattccgactctttttttgtttttcccactgaattaattggccattgttatggcgtggtggccttgtcagtgttttctgttggtgtcgattttggatagagagataatgaaaaaatataaaatgagaagggattgga

SEQ ID NO: 33206 - DNA, 753 bp, Heterodera glycines
  misc_feature (637)..(637): n is a, c, g, or t
  misc_feature (671)..(671): n is a, c, g, or t
ggcagattttcaaatttctcccctccccagcccttccaaaccaatgatgattaatgcgtcacctgtttctccgcaacttcgttgcgcacaattccgtcccggcgttgggccaacacttcgcgcaccttttgctcattgtccaaacaacggcccgcgtaaatcaaacgttggcgcgacgggtcgggctttgtgacgcattcctcggccaaatgagttttcagttggagcacactgaaattggtgtgatcaattagcatcaataattttggcacagtgttttatcttccggggcatttcccaaagactttttttggtcacagattttcattttttgtctgtttttaaagttctgaacagtgaaaaacaggtttattcatgatgaacaaagttgaaaatcctaattttgtggggaaaaaaactcaaaaatttggacatgaatttacttccaatcagccggacattcaagagtgtggtcgggaaatgattgcatggcgcaacgaatggtcaattgaaaagttgcggcggtgccatcaattgtcgacattattttgctcggatagtattaatactgtgtctttatctcttaagattggattaatgaaatccgttaagtcattgaaatgaatgcatttactanaactgacaaaatttgtcagaaataccatcacaantgtcgtatatttcttaaattgagccctcgggggctttattttttcatcctcaaaaaatggaggggaggggggctttattgca

SEQ ID NO: 33207 - DNA, 891 bp, Heterodera glycines
  misc_feature (822)..(822): n is a, c, g, or t
tcatgctgaggtggtgacggttttgtggagttggctcaattttggttggtaaaattgtggtaatgacccccgggggacagataaggaggagagaatagggcgataatggcttaattaattgcattttaatgggggaacgaagtgggcattgattgcatattggcgatataattaatctgttgaattatttgattattcaatgcgcgaattacggcaccaaaataatggcacaaatgccaaagagcaaaaagtacgacaaaaactgcacaaaagttgaaaaggcatcgccaaattacaagtcggcataaattaaataaatttcgtttctaaaggcggcaaattaataaaaagggaattagggagagatttggggccaaagtgacaagaaaagtgacaactttggcggtggatttgccttttcggattatgttcagtcagtggattggacggaacggacggcggacggacaattcgtttttggcattgaatgggccgacaatgccaaggcgggcatagggaggggggaggggaatattgggcagaagaattgctcaattccgacatttccggcggacatatggcaaagaatttgcgaattttgggcaggggagggcaaatgccatcccaaaaggtgtttatttatttatttatttgtcaatggcaaaaggggcaaaggaaaggaaagaaaggcatttgcatttttagtttaacaaatgaaagaaaaaacattttgaaaattggcaacatttgaatgtcctcttttgctctttttctttttattattttgcatttttaactttcctcccaaatccttttcattanatttggcgctttttacgggcgtaaattacagagtgccccccccccccgggtggtcacttcttttctttt

SEQ ID NO: 33208 - DNA, 665 bp, Heterodera glycines
ttattaaccgtccagtcttttaggagggcttgggccctgcttattttctgcgagagcttcttggcggcaacgctaatagaccccagggaagtggggtcgttcggcaatacatcggaaccggccccttgtattgagttggtggaaatggcggtcaaaagagcgcggagtttctatcgaataatgtgcacggaatgattaagagaaacaaaaaaaaggcgaaaaaattaaaaagagttaaaaaggagtgaattgaagatgttacccctcaacattacttagtcccccgttagtttttgcccggtttaagctcgaaaacggtctgaacaagagcatcagacttcttaatcaaacaatggtaaacacaggggaaaaacaaggacaaaaggggtgacaaaggcgaggcggatgattcagtaaggtgctggccaaaggcaacgaaaaaaattgccaaggcggagaccgaaggaatggcgaaagccaaggcaaaatagagaaatcatgggggtcgacccctctgacttcgttcgtatgaggggcccaaaagaggaggggacttcatattggttgggacaaaaatgtgaaaaatgttgggaaaggtcggagacgaaggggtcagagagaggcgactttgtaaaggcaaaaagaattaaaacaatttaacaaaa

SEQ ID NO: 33209 - DNA, 1240 bp, Heterodera glycines
  misc_feature (125)..(125): n is a, c, g, or t
  misc_feature (127)..(127): n is a, c, g, or t
  misc_feature (1173)..(1173): n is a, c, g, or t
aatgtggcccaaattttagccccccagccacagccccttggttctcccagttttagttctggatttgtcaaataaattcaagacttccaattaatatcaaaatttctcttaaaattttttgaacncnaatcaaaaaaggaaaaaaatttgcagtcaaaaaattattcgaatttctccaattttgtttccataatttccgaaagttattcggtatcataatgccaaaacaaaacgaaatcgttctaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccggcataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaattctcttnaaatttttttgaaacccattcaaaaaaggaaaaaaatttgcagtcaaaaattattcgaaattctcca

SEQ ID NO: 33210 - DNA, 954 bp, Heterodera glycines
  misc_feature (8)..(8): n is a, c, g, or t
ccaaaacncggatgccaaagaagtgaccattaacaacctccccaaaattgccaataaacagccgaacaatgcaccaaaatcgattgaaataaaactgccaattttggacgccaaaatcgctgccgaaaaagcagtcattaagcagtgtataaaagtgaccgataaaatgcatgaaaagccaattgtggatgccagagaactgagcattagcaaaattgagaataaacagtcgaacaatgcaccaaaatcgaacacaaaaatttccatcaagaagaaagatgtttctggcaagaactcaaatgaggaaaacagaaaacaacaaaccatgaagaagcgagaaaactgatcaaattttagtgcgatattcgagcttattcaaatcagacacttccggcgatagaatttagggtttttcttatctagtaaattaaaactttagacaccaaaacgaaatttattgagcttgaaattttcaacaaatatagtgtttgttaagctcctaagaatcataccaatttttaaaattggtggacaaaaaatgttaggtcacttgacgccgaaattccctgtccaaatttcttttacgacgtacataccagaaggatgttgggaattttttgttgcgttatattcattttttggaattttttgccttttgggaagtgaatgcaaaagctctctctaaatttccgttcacaatgtgtttttttaatatgctaacatttttttaagtattagtgaaaacaaattttttaggaacatttaatctgaaataatttaaaaatgaattacttttttcggttcccggtgattacgtcagtggaaattaattttaattcataaaaaaacgtacatctagctaaatttttcaaaaattcaaatgtcgagtcataagcagacttgtcgacgagtcacgaatgcaaaatctctgcagcattctcaatgtgctctgct

SEQ ID NO: 33211 - DNA, 1042 bp, Heterodera glycines
gggggtggttaaaaggatggatcaataaaaaatttttgtggtcgaagaaagatgttaagcggtaggagcaaaaaggtagttcaaaaaccaaattaataaagggaatagatggattattttttgaaatatattaaattttatgatatatctagaatttacttgcagggttttattgtttagcaggatatataatttagttagatggttcgagtgcgcatcctaaatttctacataaaaaaaatcggaaaaggcaatattttcagtcttttcaaatccgttagagcactcactgtattttccataataatgtcatttttctttcccctaaataaaataaagtataattcgcatatatatcaatgaaattgcgaagtaaaatctgtcagattgggtagttcaattttcggtttgtggctttagaattaatagaataagtattagtattcacgtaatggctgtaattatgcagtgtataacatgaggtatcgctagataaaaattaggatattccacttctaaaattagagtatgtcaaaatcattaccccttccgtagaaaaagattgacgacttaaatattgtttcatagatcacaaatttgttcagtttagcgaggaatgaagtgagttatgattgatttaatgtcattatttctaataaattttaacaagtcacgatagttcataaaattgagaaaataagatacaaagtaaagtatacagaaccacaaaaattatccataaaaaaatgggtcggggtcgttttcgcgtgggccgttttcgcgtggggcgagtttttgaactataacttttttctttgtcaaccaaatccaataatcttggtatcattcgatagccctaagtgttttctattagccaacaaaatttggaaaaatttcgttaaggttcaaaaaagttatggtcagaagagttcaacaaaccaaattttccaactttttttggctcgaactttttttatattgaacgaaatttttttggattttgcatgctaatagtgcatctgaagggcttcgaatgatacca

SEQ ID NO: 33212 - DNA, 919 bp, Heterodera glycines
tgagatcaccatgcttcacaacacggtgattgaggtcatctaccgagtgtgcaaagagatggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaattgggctcggagaaaccggagagcacttctggattcctcggcagttcctcgttaagagcaaggaagagctgatagactatgtctatcctaacttccaacaactccttggcaatgacaaggagctgctcaatcgtttgattctcgctccgcacattgacacgtgcgacgaagtcaacgacatcatgatggcgaatgtgccaggtcatatgcgggaatacttgtccacggataagccccttgacgaccgcccactggacatcgatgagatcgagtccgaagtggctgcgttgaaccggcgcacagactcgggcatgcccccacacagtctccggcttaaagtcggatgcgtcgtcgtccttcttatcaataaaagtgataaggaaggactgatcaatggcacccgcatagttctggaagaacttggcgatgatcgcctcattggtcgtgttatcaatagcaatgctattggcggccaagtgaagttctttcttgaaagaacacgaaatgtctatgaagacaaatcgcctggcggcataaaatatgagcgtttgcagttcccaataaagcctgcattcgctatgaccattcaaaaaggtcagggccaaacaatccacactgtcggcattgatcttgaa

SEQ ID NO: 33213 - DNA, 802 bp, Heterodera glycines
gattgaaatgctggtgggttgagtcccagtgattggaatgctggtgggttgagtcccagtgattgaaatgctggtgggttgagtcccagtgattgaaatgctggtggtttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctgttgggttgagtcccagtgattgaaatgctggtgggttgagtcccagtgattgaaatgctggtgggttgagtcccagtgattgaaatgctggtggtttgagtcccagtgattgaaatgctggtgggttgagtcccagtgattgaaatgctggtgggttgagtcccagtgattgaaatgctgttgggttgagtcccagtgattgaaatgctggtgggttgagtcccagtgattgaaatgctggtgggttgagtcccagtgattgaaatgctggtggtttgagtcccagtgattgaaatgctggtgggttgagtcccagtgattgaaatgctggtgagttgagttccccagtgattgaaatgctggtgggttgagtccccagtgattgaaatgctggtggattgagtcccagtgattgaaatgctggtgggttgagtcccagtgattgaaatgctggtgggttgagtcccagagattgaaatgctggtgggttgagtccccagtgattgaaatgctggtggg

SEQ ID NO: 33214 - DNA, 1019 bp, Heterodera glycines
tctgggcacagtaccgagaccaacggcacgacttgttttttcctaccatcactcaaacacaagccataacgggtgagagagatcgtagtgagtcggacagatccgtcggcaaacactcggaagtcgctgtttttcgcaaaaaaaaatttagatggcttggtgtgccataataggctatctggacaaattttagaaaatttatagtttctgatgaattcgttagtgtgtaaaccattcattcattcggcaggtggtcccagcggtggctcctcttctgttgccgggtatttgaccgagagaatgtttgagcctccgcccgcacgcattgccccgccgccacaaccggcggaaaaggcatcgacagaaaggaataacaacagcatcgatcctttgaggggtcccttgtaaaaacgtatattatgttcaatcccaagtgcctaaaaagcatctgtgttcatattttgacttgtctattccttctaattgttgattcttatttttaaaattgattctttaatttaaaattgcattgtttaattatgaggacaggccaatagtacgttcccgatttgtgcccaaattcacattgttttgtaaaatttattttaactaaatgttactaaattcttgtcaagttttttaatgtaagtatgcttgagccaaggcccgtatcagaaaaatatttcgagaggggacccgaagagttttttaacattgggtctctccttgaacatactgttgtgtccccgggtttaaggctttaagccatttcaaattaccgtttttagagaggaatttattgaaggaaaagcattaagaaaatatttacgtattcaaaaccgggaatagtttgggtcaacaacaacctcagagcattttgggtgggtcagtgcaattggttatttgggaaaggattaacaaaggcaaggaatggcactgagcagactgacccatcgcagacatctcgcagcccccgagggggaaatgggaggactatatactgacacaaaggggttgga

SEQ ID NO: 33215 - DNA, 938 bp, Heterodera glycines
  misc_feature (23)..(23): n is a, c, g, or t
tcccaggggtattattttgtaanagtctttttttcaaaatatacttttcaaaccccttttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattaaactagaaaaaattgaaaattttgaaatcatgtttcccactcccttctcccaggggtattattttgtaaagtctttttttccccaataaacttttcaaaccccatttttcgcaccgggaatgttatttttatcgaattctgaaccgttttgagtaaattaaactagaaaaaattgaaaattttgaaatcatgtttcccactcccctcctcaaggggttattattttgtaaagttcttttttccaaataaactttttcaaccccaatttttccacccgggaatgttatttttaatgaattctgaacccgtttgagtaaattaaattagaaaaattgaaaattttga

SEQ ID NO: 33216 - DNA, 1231 bp, Heterodera glycines
  misc_feature (1227)..(1227): n is a, c, g, or t
tgaaaatttctcaaaattcatcaccaaatctttttttcttgataattttaaagttttgataagaacgaattgacagtgctaaaagaaaaatgagaattttctgttaactgaaaaaatgttagccaaaaatcaccaaattttgtgctttttcgtttttttgtgcttatttttccattctcatgcttattatttcgtgcttaataacattttgcgttgaaaaattcggtctctgtcatgaccaaccggttgatcagccggaatgtgctgatcattattttgaccatggcgatgatcaggatcagccggaaacggggtcggatcttgctcaaacatttcaacatctttaaagaatagagaaaaatgttggaactttttgcgcaatgctcataaatatcttatttctgtagttttgcgtaatttacaaccgaccgactagacgattttatgttcacatgaactttcatcgctgcaaaccacgtcaaataaagcaatttctttgtttagcaaattcataaacaaagaaaattgtcatataaacaaatattaaaaatggccaagttgaatattctcgagaaaataaaaaaacgatttagaaatttgtcataaaaataatttctttcgaataataaatgaaaaggaatttaaaaaaaacaagttaaaatcataaaaataaatattaaaacggccgagttgaatattcttgagaaaataaaaataatattgaaatttgtcataaaataatttcctttctaataataaatgaaaaacaattttaaaaacaggttaaaccataaaaatcgagaaataaaaaaacgatgtagaaacttaagttttatctatccataaagaatgtaatttgcaacagtatttaatcaataacaatttatcattagctagctaaatatccaatgaaatttcgttcaaaatctgtcactccatcttctaaaaagcccattactttgacgtcgatttgtcggctttaccttaaattaaatgatgctattaaaggacataggcgattagcaactcctcatcgcaattttttcccgtcaaattttgaaataggtttgaaataataaatttttaattaaataattttttattaaagaaaaacagcatgactattaccaacgcaaaatcactttattccgggtgaagcctaatatttggaaaacagtgcgacgggtattagtgtaaaataaaataaaaagttcaaaacaaaagtgnttta

SEQ ID NO: 33217 - DNA, 527 bp, Heterodera glycines
ttctcttcttcgtccttctttgctttctcttccgagtccttcctcgctttttcgtccgcttccttcctcgccttctcttctgcttcctttcgcgcctcttcttccaattccttccttactgcctcttccgcttccttcctcgcctcattttccgcttctttcctcgccttttcttccggtgtggctgccggtcgtcggagtgcccgtttccattcttctttttctgctttggcattttctttggccttctcttccgcttcctttcgcttggcctcggacttcgcttccatttgctctttttcctttctcttccgctcgcgtttgatcttctccgaatatgctcttcgctcctttatttgttcttcttcttcctcttcttggattttggccttcgcatcgattatcaattgaatttggcgatcgatttccgccaatcggtactccttcttgtacatttcaacttggtccgggtgaatcacttggacttgatccactgagaatggcgtgaggatcggtgcataggggcg

SEQ ID NO: 33218 - DNA, 940 bp, Heterodera glycines
gtgcgtttttaacgaatattcatttttttaaaatctcattattcgtaattatctctccaggcaatctccagtctcgtcaaagcggcctatcaggtggccgtcgattcgggcgttgcctcggtggacgagaagggcaccccgcaaacattcattctcagcactgtttacccgaacatggtccaggaactgatcaaaacatcggatcggtatatattttttgttttcggtcactgattacggaccgctaattccgcccacttcaaaataaaataaaattttgtttttacagaactgactcaaacgcaaacaatttgcgcatttctgcctatgaagcgttgatggagttgatcaagaacagtccggccgactgttacccagttgtgcagcaaacgaccatggtcatcctgggcaaattggagtcattgttgagcattgaagacgcactcgtctcctccaacgagcggtcacagttgcgtgatttgcaatcccaactctgtgctacacttcaaagcgtgttgcataaaatcaaggccgaggtaatgcgcatacaccaaataatatagtttttttaatcgcaaacacgctgatgtatgtgagtgggtcgctctaatttttagattttcttacaattaacaaatttccaaaattgaacccggaaaactcttaattccttaaaaattggcttaaaattgtcatttttaaaagtaagtatgtgccaaatttctcgatggattgttaaaatatctcattcctcttgggatgacgaacaaccaccatagtttgggacccttttgcttttcccccccgccgtttccccccccgtgtcgtttcccccccacgtcgtttcccccccgaaaaattttttttaaaaaatttttcggggggggaacgacctgctcccccatagtttagcatttgtgaattggattagagagcctaa

SEQ ID NO: 33219 - DNA, 816 bp, Heterodera glycines
gttttcggggcagtccccctgaaccgatgcgcccagatttatggggagaccgaatccttccggaatagcttccctataacctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccggaccgatgcgcccagatttatggggagaccggatccttcgggaatagcttccctatagcctgtactttattctgcgttggattttgctccccataatgtttgagtaccccaaacgacacttgaaaaaatcgattttttg

SEQ ID NO: 33220 - DNA, 939 bp, Heterodera glycines
ttcgactaaacggcttccgcccaacgcttgtcatttgtgagccaatgagttcagccattcggcgcgaacgacgccgactgaagcgacttcacatggccactccccaggaaccgaaaaaacctggagcagtgtcggaggaagaaggaacagcagttgccggaccatcttcggcggggagtgtcgccaaagcgactgagaaaatggaagaaaattgaggaagagaaatttaattgatttaaattggataattttaaatattgtgattaattttattatttaatttgtgatctttgaaattgtgattttgtccctccattgaacattttgtacatttttagcattagtcactctttttgttgttgatcgctctgtccaaattgctccacctacgctttttctttctatttaaacacgcacatttctcactcctcacatcttatacagacatcttattcattttatattatatttattaaataaacttctttcttatttgggaattattttcccccttattccaccccgccctctctccctcgcgccttcccatttttgcccccatctcgccgtccgagccaacagggtcattctcagggtggtaatactgcagaattgcggtcagccgaaaaattaaaaattatctctctaaaagacccagggagattaaaaataccctggtcaaggatatgatatccatttggaccatttctgaatcctgagccttaattcgaacaaaaagtataaatgaaaatccttcagaatcatttaccatcattatatactttttgcaaagaaaattgaacccaaattccagtggggctgcaattcaaagtattacactgtatttctttctcactttccacaagactttgactcccgagcatccctaacattcgcatcattctctctgctgttgtgcaactacggacaaatgctttt

SEQ ID NO: 33221 - DNA, 1004 bp, Heterodera glycines
ttttgctgcagttgtcacaccaaaatgccgatgatgacgagcagcagcagaaggtcacgctgggcgttgaacgctttgcactgcccgaactgctgattcggcctggcgatgttgaagtgcagcaaatgggcatcccagaagcattgtgtgcggccattgaacggctgccaaagggtgcggcggggggcaggggtttaaccgaaggcttttacttaaaaaaagatgtgataccaccgtgtgtgtgctgtacccaatcccgcattttttgggaattgcgggatttgctggattaatcccgcgggaccccgtctcacgcaatgccgcagccggatctgcaaatttaaaatttcaggctctaatattgactcgccgtagggggcggagcaggtcaccccgcctcgaaattttttaaaaattgttagaattttttttttgaaaaaactgagtttttaaaaatttttagggctgggggaaatgaagtgcacctcgtagcggaggagaagaaggagtacttttgcttattgctttcagaaatgcagctgttgatggcgcggaacattgtgctgaccggcgggaacgccctcttcccgggctatcgcaaaagaatgtaaaaatttggaaaaaaacaaagactcacattttaccaagaaatagtgtaatactgttgtttgtcccccctttttaaataaaaaattttcaataaaaacaaatttcctatggtttccgagggactaggtcgtttcggcgccgccatttcggcgctagcccatgttttttgtgtataacttttttctttgtaagcaaaatcaaacaatcttggtatcattcgaaagtccttcacatgctctactagccttacaaaaaaaaaccaacaaaattctagcctttaaaaaattattaagaaaaaacttcaaaaattttgacttttttgaaattttcatgtataacttttttggtatttgtctaatcgtaaagcaataccttagaaaagcttcaaaacatgt

SEQ ID NO: 33222 - DNA, 993 bp, Heterodera glycines
aattttgataaacagacgaataaatgtaccaaaagagacattatctgttgaattggaccaagatgagaataatccgaccaaaatcactccccgttttgatcaaattatgctgctgtttgatcaatgcaacttaaatgcgtcggttatttgacaaccaaaacgtattgatttatttattcttttcccttttcgccgcagggcacggccataaaattgttcatttaaaaaaaaaacattcttttgagtgtgtttctttcgaaatcccaattgcccccgtcacttttcaattgctttccctcgtggccgagtcctttctcggaaacggtccgtcccccgggggacgtgggtgtgttatgttatgtgcggtgtttgtcatttgtgtcgtccatcgctcgccacaatatttgttgctccattcgtcgtccatccggcgaagaggaaaaaatgatcggaaaaccaaacagacggagaccgatcgggggggggggggaggcgaaatgagtgagtgatcggactgatcagtcagtgggagcagacgacgccgaaaaagcaaaaaagaaaaaaaaacggagagacaaattcacagacactcaaaacaaaactaactcatcatcatcatcagcagcagaaagcagtgatcggtgtgaagaggaggaagtgtttttctgttttctccggttgtgagccgttcggaaacaccggcggaaagtttggcgttttgtttttggaaatggaataaataaatataaatgaattaaatttggaaattctttcttacatactattaaaaaagagctaaaaaagtaaaaggttaagagacattgagaaaagagatcaaaaaagcgtaagaagacggaagcggaaaatggcaaataaaattttattcgtttttacaaaaatgtaaagttgagcgggaacgggaaatttttgggcaaaaccgggaccggaacttgccgggggccgggacctccaatttttttttcgggatcggga

SEQ ID NO: 33223 - DNA, 565 bp, Heterodera glycines
tgcgatcacacgcctgtacatcccgaagagtgcgcgatccgactcgggccagtgccgcattgttgccaccaatgagaagggcacggcggaagcgcgtgtgctcatttcagtggttgatcggcccggcccgccggagggaccgatcacttatccggccacaacaaagtgagaaaaattcaaaaacggatataatatttttttttggtttaaccaatttttttcatgacaaatttcagtacttttttaaaagtaatttttctggcgccgtctcgcttatacgacgtatttttaaaaaatgttattttattttcagtccaacgcaaaaacatttgagaattttttttcaagatttacacctcaattcagaattatagttaaggtgaattgcgtttccatcccagaaaggaaattttaaaaaccgaaaattttttaattttttaaatttcctagaaggttttttcttgtagaagatctaagaaaaaatttcaaacatgcatttttaaaaatttttctttaaataactgtaaaaaaacatttttgagataaattcatttaagaaataata

SEQ ID NO: 33224 - DNA, 921 bp, Heterodera glycines
ataaaagaaacaagtgtttatgaaacatttaaaagttcgttcattatgctttgcatcagctcaacatcgttgttgctggtttgtgccaaatgcagcacagggttggtttgaatttgaactggcagtgattccgatacagcaggtgtttgcaaatgaagctgagaatacatattcggtgccggtggcttaacaataatttggtctaatccaaatttatttaaaaaaacctgtaataattcaattcaagacccaaatccaatggccagcgtgtagttagcaaatagaacacgctgaactgacacccctgtctgcccgctgcccggtggaggaacggatggattaaatggtagcacatagtaaggcaggccagcataatgctttaaaaagggaaaatgtattggctaaattggcctatttacaatttgggggggggggaagatattgctgttaagctgatccttataattctcatcaccagagccgggattgcaactattcaaatatgaatcacgcaaacaattaacaattaatctttgtaatttttttctttttagttaaagtatttttcaaaagttgaaaacaaacgaacccaagctcaaagctgaaaaaaaccaacacaggacaaggctgaacctcgcttcttggggttggattacataaggaatcattgccttggaattcaaatgtgcagttatctcatccgattgagccaaatgcgcgaactgttgttctatttgatgcattgtagtaaagatcgactaaaacagtattaaagtacatgacaaaactttttgtagtgaataaatattttaaaattatgaactgacacccctgtctgcccgctgcccggtggaggaacggatggattaaatggtggcacattgtaaggcaggccagcataatgctttaaaaagggaaaat

SEQ ID NO: 33225 - DNA, 880 bp, Heterodera glycines
ctctctctctttctctccgttcatttgttttcccttcgcttttctcttctcgcccaaactttgttctttcttattactttgtttgagtggtgaatgaatgcatggaagaagaagcgaacgaacgccaatacgattacgaataaacgacgaaaaactttttccctccccccccccccccactcttttgcccacccatttctctcttcttcccttgctgatgctgtttctgttttgtttgctgctgtcggtttcagttaggccatgttttagttgctgatttgtttaatcaatcaatcaattttttgggggcgatggcaattacccaacggccaattgtcacgtgacagaatgattaattgattaaaaaagcctcttttcgtaaaattcgtatccgtcattccccttttttttaatagataaatgaaaattgattttccctcctcttaattgtttgaccttttttaaagtaaattcacattgcctgctgacatttttactcacttccaataatttcgctcatatttctttttctccttatgccctccttcattttttactttgagaaaactgaatgaaatcatcacatccaaactgaattgagttgttcgttttcatactccaaaacatacaaaagttgtagcaaaactaaaacaatgatgagacataacgcacagctgtttatgtattttatttcgttaataactccgttaattaggtaagccaatttgaacggaaactgacaatttgatctttttgaatgccatctttttttagcctctctcattctcaaatttccaattgtttcttaaattaagctgctaactaaattcgttaatcgaagcgacaaaatgaagtggacttacaaagaggagaactcttt

SEQ ID NO: 33226 - DNA, 572 bp, Heterodera glycines
ttcttcatttgcctttctcgggggtatcaatttcattcgacccgtagcaaaacaatgggcaaaaacaatggacagattgaaagaaaattgacattgaaaaagcaaaaacaaaagaagaagtttgattttgaacaaaaagcaaaagcaacggacgggtcggatcaaaaacaatcatttaactttcatttttaatttatttattgctttgactcaccaaatgggagggatcgaacgaagtatgaactccgccccccccccgcacacctcaagaatttctcgagaaaaaaggcctaaacccaaaaaattgccaataattttttcggaattattttacccaccggcagctctgttttgatcattatagtatgaccaacctgacaaaaaaattggtcaagcttgactgaaatcaaaagtgtccaaggcaatgaaaaggaaaggccattaaactttgtaaaacagcagaagtataatggaaatgtatgtgcacaaacaaatcacagcagcacgaccacaaaaataaggcacacaaacgcaaaatgggaggacaaatgggcgaattggggggggggggg

SEQ ID NO: 33227 - DNA, 1244 bp, Heterodera glycines
  misc_feature (1183)..(1183): n is a, c, g, or t
aattatattgttctaaaatttaaattcaaaattttttattaaatttttaaacataaaaatatctcaaacaaaacaaacaataattaattaaaaatttatttaaaataaaaccaaaaataattaattaaaaatttatctcaataaaatgaaaaataataataaaaattttataaaaaaagaaaaaatcttaaacaatcccttaaacattattaaaacaattagaagcaattaaattatttttctaaatagtagaaaaacataattgatgatttatctgcaaaaggtacactatgaaatgaagtggaaaataagggggcagagactcagcggatgagagggggtggcaatgccaatgttgtgctgtgagggcaatgacgccaatggttcgatggatgcgcgtcgttttgtgtggattttctaacaaagaatgcagtgagagagtgataaatgagagtcagagagtctacgacgagcaaatataaagagatgaggagagagggaaagagagagaaacagagagagaagagaggggaagaagagagagagagaacgacggaagagggagagcgtgagatagaaagagaagagagggaaagtgatagataggcagtgagagatttcccgaaacttcagataaattacccgagcgctgaaacacgtagctcgaagctcaaaaacacgacgtttttgatgcagtaagtaaataaaaatttggtataaaagaccaaaaattataatttttgaatttttatttcaataaaaatgcaataacacgaaaattacacccgaaagaaacggtcctaaaaatttcaaaaaatacacccctaatatggacccataaattttcaattacaaccctaacaaatgaaaataaaaaaatcatctccaaaatttattattaattttcttaacaacttgcaatggtacggacgaaattgataaaaaaaaagtcaattttagaatttttataaataaagatacactgaattgttccaatttttaacaccaatttttgcacctattttgggcctttttagtaggaaaaacaatatgattaaaggaaaattggcggaaattttgacttttaaatttttacaaaagcgataaattgacaaatgttgcgcaattttttgcaaattgtgttggtggagaagccaataaaggattggaaaatgttttctcncccactaacccttcccttggaggggagattaaataaatcttttcaaataaaagggtttaaa

SEQ ID NO: 33228 - DNA, 1756 bp, Heterodera glycines
taatcaaatttctactttctttataaatgttagctaatcattcagcgtctatttattttctgtaaaaatttgcctctttatttaaaattaaattatatataatttcatgaaataagacactaaatgtatagagaatgaattaacgtggtcgattggaataaatggacaaaaaagcaaagtcaaagacaaaaccttaaagcaataggcgattggaataaatggacaaaaaagcaaagtcaagaacttatcctacctaatttcatggtggcaacgaggcatttgactcccttaagagagccttccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttcaaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacatccaacgcttggcgaattctgcttcgcaatgataggaagagccgacatcgaaggatcaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctca

SEQ ID NO: 33229 - DNA, 164 bp, Heterodera glycines
atatcggaggctgtggggctaggtcatttcttcttgaattgcttcctgctgagtggggcattgtccctgcctagcctgggccctaaagtctcttcctgcctcgtctagtgagttataagccatgctttttgtagaaccaatgggtgagatgtgagatagctcat

SEQ ID NO: 33230 - DNA, 285 bp, Heterodera glycines
  misc_feature (14)..(14): n is a, c, g, or t
ctctagagtcacanatctttggtatcattagaaagctcttaacaagctctatcgtcttccccaaaaaccacaaagatataccgacatgtaaaaaagttataaattaaaatatgcaaaaattctgactttttggtagtattcatcttgcagcttttttataagttgttcaatcgcttagaaatacttagcaaaagcttataaacatatacggctttcgaatgatgccaaatttataatttgtcccccccccccacccgtagaaatgctattttgagccctctttct

SEQ ID NO: 33231 - DNA, 1244 bp, Heterodera glycines
  misc_feature (33)..(33): n is a, c, g, or t
  misc_feature (41)..(41): n is a, c, g, or t
  misc_feature (63)..(63): n is a, c, g, or t
ttttaatgcgattgtttaacagaatttgtaaanaaagaccnaattgattaatttttgggtttntaggatgcttaaaatgaaagaaaaaaagttggaatatttttttaaattaaaatttcaattaaaataatggtaaagaaaatatgaagaatattctatcccagtggggaattgaacccaagcgagaaataataaaataagaagctttagccacttgaccacttatgcatatgaacaaatgctttaaatgaaaataaataatttaatttttttttctcaaaaaatttctccttcttcaccattccctactcttttctcacccagacccccattcttaccagtacaaatttttaccggcggtaccggtactagacaaaccggtaccggtaccggtaccggtaccaaaaaaaccggtaattaccggtcggtaccggtaccggtaccgctcaactctagttttgtgtgataaattagaatattgaaaaattgctttaatcctgaaaataaaaatttatcactgtaattgcgtcaattattgctcaattaatttgagtttttctttaacttgccaattttttaaaatcctttttgctcggttgattcaataaaaatggcaaaaaaccaatggtaaatgactgttaccgtttgccctgagggttgtcctactgtaattttcagtctttaaagaaatttaatcctttgtcctttgtccaactgatgatgagttgtccagacacggccagaaaagcccatttttaactttcaccttacgatcgttttccagcggttcacaattaaacaaattatttggtgttcagagtcaaaacatttgcatttttttcttttttttaattaattttcttttccttttttttgcacagaatgcaatagaattttcattgacattttgcaccataaaggcgaaattaattggaagaaagtggtggaagaaaatccgcatctgtgggataaacggaagaaaataaatgattgccatttcgaaggccatccaagggaacgcagcatttgttgaccgtcggtttgaagccaatttcaaagggatgaaaaaggcgagcatttcaacgcgtggcgcttatcattattttgagtaattagcaaacatttcacagtaatcattgacgcacttcataacaactttgcaattcaaaattcatttattttttaattactcagagggggagccaaatagtccaagcgccgaagcgcaagcggatcccttcatt

SEQ ID NO: 33232 - DNA, 191 bp, Heterodera glycines
aagggaaaggaagggaaaggaagggaaaggaagggaaaggaagggaagggcgaagcgaagcgaacggcggcggaagaaaaaaagggagagggagggagaagcattctgtgtcgaattcactcacttaaaaagacttttgaattaatatttggtccccttgccttgcccccctccctcccctcctccctttt

SEQ ID NO: 33233 - DNA, 783 bp, Heterodera glycines
ccaaataccgtaacgaacagtaggtcccggttaatacagtaccttcgcaatttggttattctcgcaatgcgcaacaacgacattcgtccggacgaaccctttgactgggagcaacaggaaacgatggcatccgaagaaacagcgacaaattcagaaacaacggcaccaaaagatgaaacgacgagggaaagggacgaacggaggacggaaaatgggccaatgccaaacggcggggggacggaacagaaacaacggaagacgaaccaaacgaacggcagaaacagcacaacacacgagcagaacaatggccaaaaagaagaggggaaaacggacaattttgacaggagataaaagggggagcagaagaaggacaagcaaaagcaatcgaagtgatctgatctgatcaatgaccgtggccaatgatttcaatcgctgcctttgaatggaaaaagggcgggtcaccgccccggtgctatgacgaagctaaaaaagtatgagtatgggcgaagctaaaaaagtatgagtgatgggtgatcggaaggggcgggtcatttcagtacggaataaatgattttattaattaaattaactagaattagcaattaattaataatctaataaataataaaatatatctggctctatttcagtttacacgaccacgaaataagacacgatcatgtaatattttgataaatttaatgcatcataattttttgtagaagcatccaaattaatcattcttggtaccatttggtagcctaaagtatcctctattttttt

SEQ ID NO: 33234 - DNA, 767 bp, Heterodera glycines
tgattaagcggtgcccatccccaccccatggcatcacacctcgttcatgaagttgatcagattgcgttccgcccgcgcaatttcgtcgtcgtcttcacgcatcactttggcgtccggcgcgaaatcgacgcccgccgattgcgcaatagtgaccaaatacctagagaaaaaattggaatttaaaaagcaaacaaaaatggcactgattaaaaaaatatttaagcaataaccgataaattgtcaaaaaagtcacaccccccaaataaatggtgacaaacttttcgacgagcaatttggacggtgcgctgacggacaatttctgcaccaatttgggcgacactcggctcggctccggcaattggttcatacgggcggcctccgcgaattgtttgccgtatttgtgggtcagttcgtcgttgatcacctacatttggacgatgcttttcagtttggtttaattaaattatttagttaagcgtgataatgtttaaggaatttttagggaaaatggaaaaattccattaaattctttaggattggaatcggccaatttataccacacaaaagtaattttggtggcaccaaattttatttcttgggtggacaaaagcttttcacaccacggcattgtttttctgattttgccattgcccaaagtatgccttgaattccgcaatttcgtgtccgatgcgaggcgccacccacaacaaactgctcactgcctcggcgatgccatcgtccaattccctaaaagagcaatgaaactt

SEQ ID NO: 33235 - DNA, 967 bp, Heterodera glycines
gaatagacgagaaagggggagagacgagaaaagggaagagacgagaaaggggaagaaacgagaaagagggagagacgagaattcacatgtgtcattaatctcttcactggtcaaagtttgtttatttggcaatgccggtttcttttgctctcgctctctctctcgtggatgcaaagggaagagaagagaaaggcactaagattacagcaattagttgtattttaagtaaattaaaaatatttatatgtgtgggttgtttaatgatatttattttgaattatcattttgaaatttggataatgaatattttcacgaagctgcaaatatccgaaaatggctcttaagaaatgggccgcaaatttggggtaagcttaaaattaaatgcaaatttacaagcaatgtattatttttccatgctcagatcactagtgatcgggagagataaatcatcccaaaggattccattctcaccattttttttatgcgtttattttatttatttttgcttagttttcaattgaatgaattcataatttataaattcttaagtttagaaaattaattttgagttaccgccattttggcgtggaacaatgccaaatgttttcttttgctgctgctgtttcggtttttccgctttgtctccaaggccaattctgctaatgatgttcattctttaaaatggactaattatgagcactaatctttgtattaaattattattttggccaaattcaatttgcattttttttttaattattttgtccatttctcacatttcggctggcaaaatgattcagttcggtctgaagccgcgcctccgcaaacagccgcaggcattgtgcccggctacacttgcgcacttggactcgtccacgcgaaggattgcgtccgctggcattagtccgggcgcgttgggcagccgagccgctctcgacctgttcaacacgcacacacaaaacgctaa

SEQ ID NO: 33236 - DNA, 919 bp, Heterodera glycines
  misc_feature (877)..(877): n is a, c, g, or t
gtatcactaactactcaaatgttttatcaaattacttttgttgacagtttttgttcacagattcaatttggataactttgataatcaaaaatatcattaaaaatattattagcaataatttaattttcttagcaaagggtaaaaacttatggaaataaatatatttgttaaataatataaattgttgacggaatttgcgaaattttagatgtttaagaattaattcttactaataaatgatgcaaatgagaatttattactttggattgattgcaaaaccaggaaaattaaaaaaaccataataattatcatattttcgtggtgacaaatggcagaaaaatttacattaaaaaattgggtataaatttttttatcctcaggacaaatgcgaaaaatcagtacaaattaaaaaaaagacattttattaaattaaagaaataatataaaaaaaaaatttaatcaaaaaaaggaaaaaaatacttctgcaaaaaaaaacgatttaaaaaattcaaataaaaccaaaatcaaaattatgccatttctccaaaatatttcgtcaaatgatttctgttgttgcaatttttcattagctaattcaatttgctcagttttggtgctcaaacattagataacattcaaaacgaataaaatgaataaattcattttcaattatttttaaggtttcgtaatttattcttttaataatatagaaacaataaaaagcgaaaaatcaaaaagctttaatgaaattcgatttttgcggaaattattttttaaatatattttttcttattgatttatggtttaacaaatttttaaggagcggtgtctttaattgattttaaagtttaaaaaataatgttttttcggcaaattntttctcacttacgaattagtatttttttgaaaaatgagcatc

SEQ ID NO: 33237 - DNA, 235 bp, Heterodera glycines
ttaggcattccgtcgtgcctgcaccaccacttcggcctgctacaatattgaaattttgttggacgcggcctcgtcaatggaccaatttgaattggtgaacgaaacgacccaagaaaagttgacattgcaaaaagaaggcgattgtggaaagaacaaatgtaaagaatgtgagaaaatgaatggttggctgttgaagaagcgatgtttatcgtcgaatgttgttgtttttggggag

SEQ ID NO: 33238 - DNA, 774 bp, Heterodera glycines
gggggaggaggggaggggggcccaatttgtgtgtccagtccaattttacgtaaaataataataattaaacaaaaaaagggggggtccaattttgtaattagaaaaggcattttcaaccggacgggacacagcaaaaaagcattttcatcagcacacattttgcaaattgtgcatgacgtatttccccccccccccaactttaagcattctcacaagaaaaccgcaaaaaaaggcaaaattttctaagtttttatgtctatctttttttttttacagttcgatattatctgtaattatttgtaggctaatagagccggtgaagagcattcgaatgatatcaagatttttgcattcgggcaacaatataaaaagttatgccgctcaaaacttggctgggacggagttggcgggacggagttggcccgttctgattcctccctcccttttggtggtacagtgccaaaagcaacacaaacagagaaaaaaaaaattttttttaatagacattgtttttttatgtaaatgcatattttttcctggattctccatagcctaattagtaggaaaacacttttttttgtgtttgcaaacaaaagttagacttttatttacatatttttcggatttttctacatattacatatgggctcccggacttttcgccaatgaccgtttcgacataaaattaaatatattttttaaataaaattcaaatttctgcaaaattatatggacggtggcggatttgggatcaatataaaaaagttttttttt

SEQ ID NO: 33239 - DNA, 924 bp, Heterodera glycines
attctgatgaggaatttagattatgtagcaaaatttttccttatgagactctggaaatttatttaccttaatcgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttggtcccggtactgagtgttttagctcaacatttattagaaaaaataacatcatgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgagtacctcaaggcgaagagacatgattggctctataaagaaagacgtacggtaaaggggatacttgaaaataggccacagaaggtcgtgattgagaatcatgtacccggtccaaatgttgcaccatatctgggcctcaataaccaatccaaaccacaggagaccgaagaaccacggaaaataattattcctaggaaaagacttaaagagcgaactcctgatcctgaatcaaataatgatacccttgaggagttaactccggaaccccaaacaacatccacacacaaaacacccgttccaatcaaaactattatacacccgacccttttaaacggtctttttaggtacgtgaaggaaaacaaagatttattaaaaattacggcggccggaaaggtacagtcgaacatgaatttgccgattgaaaacagtaattatagggatgttttgttg

SEQ ID NO: 33240 - DNA, 1240 bp, Heterodera glycines
  misc_feature (32)..(32): n is a, c, g, or t
  misc_feature (39)..(39): n is a, c, g, or t
  misc_feature (105)..(105): n is a, c, g, or t
  misc_feature (1134)..(1134): n is a, c, g, or t
  misc_feature (1150)..(1151): n is a, c, g, or t
  misc_feature (1165)..(1165): n is a, c, g, or t
aagttaattgcctcagatctgatgtttgatcngggttcncaatagggattgctgtttccatttcaatgaaatttgggtgaaatgtggccagttattgtttggatntagtgtaatagccgttacataacttggtgtactttgaaaaatcaattgatcgaattccaaatttaaatgttttcgatccaataactcattctgttcacccaaaatgtccggttgtaccaatgcccacaatatgggatgtgatattcacacaaaccctatgactgagctctcaatttgcgatgaaccagctagcgatggtgcggtgtccgctaatattttatcaatttcccattgattagctaatttttcagaatccgtcaattccaaattttcaaacagactcatgaaatcatccgaattttcaacatttggctttgacttaggcgacttcttgcaggcaatgatgacgctactacattcgattctcacttcttcatatccggaccccgcagggttttcattggattcagtcccttcaataacgatttcaaccccaacattagtgtacccctcgaggtttgaagctacttttgagctatcaatgctcaacgcctcgaatgattcataaatggtccccgcaaggctttcaaaacttgctgaactctcatcacttgttaaaacttcgggattggaaagcttagaaggcagatttttggttctcatctgaatgagataaacttattttggaccattttataatattaacacatatataaataatggatgaataatttatgaacacatgactctatgaaagcacatggcatgaataagtgaatgaatgtggcaagcatgagtgaacatgcgtgcttttctacatgtatgaatgaattaatgcgtaattgaatgaatgtttgttgactaatgaatgaatggagaggccatacacgatagactcatgattgacaattggcatgggtacaaggagcatcaaaaaaaaatgtgtgccaattgactaaaaggagaatggcactgatcaaaagagaatgtgtgcctaatgatcaaagaaaaattggggaatggtattgatccaaagatagtatgtgccaattagattggggaatggcactgatcaacaaataatatgtngccattgatcaaaggnngaatggcactgatncatgatatgatgtgagacgtggcactgatcaaaagaatgtgcgcaatttgagcaatgaatcatggtacaaatgat

SEQ ID NO: 33241 - DNA, 985 bp, Heterodera glycines
ttttgtacctcttctaatcactgttcttcctcttttaatcactattgtacctcttttaatcacttttgtacctcttctaatcacttttgtatctgttctaaaatttaaaaaacggccgcgaagcggccgaaaagaacaacaaaaattagaaacgggcgtgaagcgcccgtctgagtcgatcaaaatttaataacggccgcgaagtggccgtcaaagcccaacaaagtttaaaaacgggcgcgaagcgcccgtccaaggccaacaaaatttgaaaaacgggcgcgaagcgcccgtccaaggccaacaaaaattgaaaaacgggcgcgaagcgcctaacaagctaaaaaacgggagctaagcgcccgtgtaagttcaacagatttaaaaaacgggcgcgaagcgcccgtcttgagcctcgatgtggactaaaagcctctaataattttttaaaaattcaaaaaaatctctccaaccaaatcgatcaatttgaatcgcttcacagtctaggtagcgaagctcccaaagcgcgaagcgctttttcccagctaaatagccgacggttcacgcacccgctagttatatatacgttatattgacaaggggtttcgtcttcaaaaacaaaatctcgggaacgggaatagctagggggctgaaattttgcacaggggggtagctcgagacggcgcatctgggaaaactataggtttttttctccgagggccaactgagtaccaggggccgatttcccgattttgctcgcagttcaaggcccgtaactttttttctgaaactctaatcgaaaaatgtccgctggtaagaaactaagttgaagtgttgactaaaaaacaaaaaaaaacccggcctctacccataataggaaggggctgcagaaaaagggagaaattcagtacccacttttttccagttcagccccgggggaataaccccgtcagggttttgaattggatcaggggggggccagcgg

SEQ ID NO: 33242 - DNA, 1270 bp, Heterodera glycines
ccctgggagaagggagtgggaaacatgatttcaaaatttttgttgaaatatttgtcgtgctctgaaggggcgtgggagggggggggcggagggccccaccagggggggcccggagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgttttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaaaacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagactcgaatccttcgggaatagcttcctctatagctctgta

SEQ ID NO: 33243 - DNA, 971 bp, Heterodera glycines
  misc_feature (941)..(941): n is a, c, g, or t
catattctatatgccatggcaataataaaagtctatagccacgaaataaatccactctatgccaattcttacgtattcgcatattctatatgccatggaaataataaaagtcaatagccacgaaataaatcccactctctgccaattcttacgtattcgcatattctatatgccatggaaataataaaagtcaatagccacgaaataaatcccactctctgccaattcttacgtattcgcatattctatatgccatggcaataataaaagtcaatagccacgaaataaatcccactctatgccaattcttacgtattcgcatattctatatgccatggaaataataaaagtcaatagccacgaaataaatcccactctctgccaattcttacgtattcgcatattctatatgccatggcaataataaaagtcaatagccacgaaataaatcccactctctgccaattcttacgtattcgcatattctatatgccatggaaataataaaagtcaatagccacgaaataaatcccactctctgccaattcttacgtattcgcatattctatatgccatggaaataataaaagtcaatagccacgaaataaatcccactctatgccaattcttacgtattcgcatattctatatgccatggaaataataaaagtcaatagccacgaaataaatcccactctctgccaattcttacgtattcgcatattctatatgccatggaaataataaaagtcaatagccacgaaataaatcccactctctgccaattcttacgtattcgcatattctatatgccatggaaataataaaagtcaatagccacgaaataaatcccactctctgccaattcttacgtattcgcatattctatatgccatggcaataataaaagtcaatagccacgaaataaatcccactctatngcgattcttacgtattcgcatattctatat

SEQ ID NO: 33244 - DNA, 949 bp, Heterodera glycines
ttgatattcaatcaaaaatcgcgaaataggggcgaaaaattataatatgtgcttgtttcaaaattaaaatcgatgtaaataactttttaacaattttaatgacaaaatacatacataaatttcatctttttttgaataaaaagcaaaaaatagtctgtttttcttacagaaaacataggagggggggggggggggggtttcgtgttaaaaatgtgtttctcttttctcattgaattaaaagccgcagaaaaaataactaaaaacctaaaaatccccaccctactcatcaatttcaattattttttgagccgcgtggcggtcaaatatccatgagtacgattaattcaaacagcgtcagactgtttagctgtaattcttcttcatttttcatatctctgatcaaacctaataaatgttaagatttttaatgattaaaaataaaaaaattaatgattatctttaagtaacgatctattaaaatttttcacttctatattttcgaccctggattttaataaacttattgatattagtgaaattgaaatgaaaaatattatttttgactgcgcgacgcaaatgtccattttttctaagcgcaacaaatgtcgcggcgcaaatggagcgtcgcaaatatccgatacgcaactgtctgaggcgcaaatggcgagacgcaagtgtctactttgctgaccgctgcaaatgtccatttttgctgtgagggcaaatggagcggcccaaatgtcgcatcacaaaaataataaccatataaatacaaagcaagcattggtttgtttaagtactttaaaataaaaaaaaagaatatacaaaatgtatttcacttgctaaaccaaattaatacttaaaacaataaaaacgaaaattataaaactaatccaatctatacatattaaaattctaataaatccctgaccaaataattgcctaaaaa

SEQ ID NO: 33245 - DNA, 1092 bp, Heterodera glycines
gggaaaaaaagcttttaaaaaatattcccctgggaaaagggaaggggaaacatgattccaaattttcaattttttttatttattctactcaaaacggttcagaattcaattaaaaataccattcccggttcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattgggggaaaaaagactttacaaaataatacccctgggagaagggagtgggaaacatgatttcaaaattttcaattttttctagtctaatctactcaaaacggttcaaaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattgggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaagcggttcaaaattcaataaaaataacattcacggtgcg

SEQ ID NO: 33246 - DNA, 1310 bp, Heterodera glycines
  misc_feature (178)..(178): n is a, c, g, or t
gggggactgccccggaaaacaaaaaaaatcggattttttcaagtgtccgtttggggtactcaaacaattatggggagcaaaaatccaacgcagaattaaagtacaggctatagggaagctattcccgaaggattcggtctccccataaatctgggcgcatcggttcggggggactgcnccgaaaacaaaaataaatcgattttttcaagtgtccgtttggggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaatttgattcatctcccttattgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtacgcttctgctcaattagcaaaaaatatgagtgatcaaactttcactaaaaaagttaagcctacattttttggcatatttaaaaagcaattaaaaagttttaaaatttaataactcttcctgcaccaaaagtactcacacagcctcttcgcggcctcgtggtgggccttcgccccccttcctcccacgcccttcagagcacgacaaatatttcaacaaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccttttttcgcaccgtgaatgttatttttattgaattctgaaccggtttgagtagattagactagaaaaaatgaaaat

SEQ ID NO: 33247 - DNA, 967 bp, Heterodera glycines
  misc_feature (895)..(896): n is a, c, g, or t
ttaggaattatgagctgaaatctgtaattaaatgtacgttaactctaaaagactaaaactctccgacagcgtttgaataccatagcaaattgatcaggtcggaaactttaattgaaatcattgaatcacgtaaactgtctcccttctgatcagatcaggagcagaaggcggcctagaatgtttaaagacattcattggcaagggcacacatcattaaagcaatcaattaaaggggacggggggcatttcgctacttaaattgttttctcacgtgtcacaatctctgaacaacgaaaacaattttcattatatgtgtgtacgtattttctattttctcctacacaaaagatgcttatgatgatgatgactcatgtgaaaattaatacgaatgactaataggaggaaattaaattaaataaattaattatattaattattaattaattttagataaaaaaataaaacagtcggaaaatgtcttctgacaataatgggcttattcatctactaaacagccaatttgcttcagcgacagcatttaatgtgattttataaacaattttattaaaatactgaagtttattaattaaatacaaatattaaaacaaattaaaatagtttatatattataaattaaaatttacaaataaaaataatttatatcaattattactttattgaacttttatttattattttcgaactttaacaaataaaataatataacatttatttatatcttttcaattaaattcagtttagctaaaaataaaatattattgtgtgggaaaattattttttaatttttaaaccaattaaatacaattttatttatagtcttttttccacaacccaattccggccacaaatttgatggcccaaaatggacttccgnntcgtggtgtccctttcgtcgtgccccaatgtgtgccgatgccgaactcttccaactcctcctctgccctgc

SEQ ID NO: 33248 - DNA, 857 bp, Heterodera glycines
ctcttctctctctctcttcctctctcttctcttcctctctctcttctttctctctcttctctctctcttcctctctctcgctctctctctttctctctcttcctctctctcgctctctctctttctctctcttcccctctttctctaaaaacgagagaagaaccaataacacagagagtgcagagtgaaaacaaatctttttttttctcaaatttctctcttctttggcgtaatttactctcgtttctttggttcctttatttctgaattacatcgtagtgcgacatttgcggacctatcaatgcttttatttgggatttttataaaaataattaaagaggaaaaaaattaaatattgatggggaaatgtcaagaaacaataataattttaaaaaaaataataataaaatttaacaatttttatatgttttttgtgtttataattattattttctttttgtttatattcaccacaaaacgaaatcttttgcaaatttatgctcacagaagcagcaagcacacaatttgtttataattttagcagaaacaaaagtcattctgattaaatgtcattaattatttggaaaggggaattttggcagtcaaaatgccacaaattcctaaataacatttattttaaatttaatttatttaaaatgaatttttatttttgcaataagaatgtgattggtttgttatgttctttcatattttgttttattattattttacatttgtttttattatcgatatgaattccacaaattcgactaccgtaacccaatcggaaaacggttacgactacagtgtttggaacaatcagtggaaaaatgtgtgggtgtttaccgccaatgaac

SEQ ID NO: 33249 - DNA, 967 bp, Heterodera glycines
  misc_feature (36)..(36): n is a, c, g, or t
ctgccaaattataaattttaaatcatttcaatattntgctcatacacactaaactacaaaaaatggatttgaaccttataaaatgccaaatttttatcaacttctagcttcagaattgcaaacaaaagacatatcaagattatttagtaataatctcattctttgccagcgaaaatttacgaaagcgaacaaaatacttaaaaaattcccaaattccgaaattcttttaatttaaaaaaaattacataaaattaaatgcatgccaaatatggttgaaatttaatatgaggatttttatgagtataaattttataaaaacttttcaatgaactttttgtttgattccaaaattttgcgggattattttcaaaaataaataatatatatattttatcatttttcaaatctcactttgatttcttcactaccctcatttatgattcaaatttttgtttagacactttccgaatgcagcttgaatttgtcgcacttttggcacgccgattaaacatttcatcggatggcacacatttagcggtgattcaatttgctgaatcggctcaacttgaaatcacgcttaaccaatacgcatgtgaaagtcaagtaaatgttatggactaatttaattattccttaattaattactaattattaattcattacttttagttggaatgggccattcaacgcattcgctatttgggcggtgccacaaacaccggcaaagcactgaattttgcgctggagaatggctaccaaaatgcacgcggcggaattgtgccaaaaggtgaaataaaatttttaaaattattcatttaataaatttatttttaaaatattcatttaaaaatttacttttaaaattattccaattaaaatatttatttaagtggctattgtggtcacggatggacagtcgcaggatgaagtggaagaaactggtcatatttttttatttttcatataa

SEQ ID NO: 33250 - DNA, 985 bp, Heterodera glycines
  misc_feature (23)..(23): n is a, c, g, or t
  misc_feature (818)..(818): n is a, c, g, or t
  misc_feature (868)..(868): n is a, c, g, or t
  misc_feature (897)..(897): n is a, c, g, or t
  misc_feature (961)..(961): n is a, c, g, or t
aaaattcatttttttaaaatttntggtaaaaataaatgaaacattttaatgtgaccatggaaaaagacaaaaattgttggtttaaatttagaaaatcctatccttggattgccaaaaatcgaccctcattcagtttcagcagcggaactcacaaatttccgtggccaatttgcttggcaaaaggtcgcccaattcgttctccgttggcaatgcgtgcgaattgcccacaaaactttgcccctttcgcaaataattctcccaccgatctttgccttcgaagacagcatttttgaaaaggatacgaaatttgcacaataccaactgaaattggactatgaaattgcatatttattttctttctcttacacaaaatgggcactgttctttggcattaatgtgcacgggaaagtcgccacattcgtagccccacaaagtccatttgccaagcgtcaattggggagaaggacactttggcacggaaaggggcggcagaaggcttaaaggaaaacaaatgattgggattggattgcttaaaaacacacaattggtatcagtttcctacaatattcctttttatgttttgctaaaaagctcgacttatttgagttgcagtttattacattttcatttttgaattatatgaaggtattaaattgtttttaattattttttaaataattattttttttttgatttatttcggcacattttcatttatttgctcacccttttctcttctccatttcgttgttctccttttgcgtgtatttgtcaacaatttccttggtactttttgccatgatcaaacggagtcttanatttgtccagagaatgttaaaattgctttttgcttcttccattacctcgntccattgtaatttgctttggtgtattggncaaacgattgctcggaattcatggcactttttggtcaaaggcataaaatgtaatttttaataanttgtcccgggataattaaacctaa

SEQ ID NO: 33251 - DNA, 249 bp, Heterodera glycines
tttttttttttttttttttgttgggtggaaaaaaaaaaaaaaaaaaaaacaaaaaaaaaaaaaaaaaacccccccccccccccccccccccctcccccgcgcggggggggagagaaaaaaaaaaaaaaaaaaaaaaaaaaaaaaaggagtgggtggggtggggggggggggccgcccccccccccccccccccccccccccccccccccccccgcgccggggggaaaaaaaaaaaaaaaaaaaaaaaaa

SEQ ID NO: 33252 - DNA, 864 bp, Heterodera glycines
tacgcaacggaggaataaatgactcgtccctttgttttgccctcttgagccaataataacatttggttcattagcagagaatttaaaaagcaatttgaaattggcactttttgaaattttagcacttttaaaatggcccaattaatttattgaagagccattgattaagtgtgtgtgtggtcatttttggtttaattaatcagtcctttcctcgcctattgaataatgcgtttcagaaatgcctattggcatgaataaatgatgtcgatgggccacattttccattaattatgccaatgccaagaaataggaataatttacgcaaaataggctaaaaataatacaaaaaatggaaacaaatatgtatgggaatataatgagtttttaaatgtgacaaaatttaaatacaaacataagaaaataaaacaaaaaaatgtaaatatacacagacaaaaaggaaggaaggaaagattccaagcctgaacacagcaaaattgggaaaatcttgaaaataaaattaaaattttcgaaaaattccaagaaaaaaatcttattttttcttaaattttatgtttgcttttcgtctggcgcccaagtcaacggagggaccaatcggtccattagctcggccatcgtcgaactgccgggagtgccaaaggggaaggcgaactgccgttgctgctgctggtgttgttgtgccgcgttggcatcggcactgttcgtggccgtcgtcccttgctgttggttttgctgctgtgcctcgacccctcgctgcaacattgtggccaagttctgcttggtcttctccgtctcgcatagcatggccaaatgggcggacaaacactgcttggactgctcgctgag

SEQ ID NO: 33253 - DNA, 1094 bp, Heterodera glycines
  misc_feature (188)..(188): n is a, c, g, or t
tcctcgttcgaatgtcatttaaaaagtaattaaaaaaataaaacatttgatagaaacccagaaaagaaaatttgaaaggcttttttctcttctaaattggattttccctgctgcatacatattattaaataataatggataagtgagaatggcactggcggtgccgggtggtgggacacataattttntaatcagatttattaactacagattttgacaaataattgtctgttttaagggcatttggaacacgcggtgtcgaaatttttaatgagattgttaagaaaaatagaaaactttcatccttttctgctaacaatttgacctgaaccaacgaaaaaaaaactaaaacctagagcacaagacatttgaagcccactaaaaagcaacaactattataaatacattaatttcgaaaagaaattatatttttaaattttagagaaaccaaaactaggaattaaaaaagtttctgtcttcacgataacccgtgaccgggacgaaaaaactaagaattttctcgcgttgtgaccatgacccgtgattaccagctgtaccgacttttgcgccgcagaacttgcgcctcgacacttgtgccgccctacaaaacccatttcaccgttcattcagattttaaataatccaaatatttttaataaaataaatctacatatattaatgtggcttattaatagggctgccaaaaatatgtacaaaaagtggtggtcaaaatatgtacataaatatgtaaaaaaatcccaaaatatgtgcaaaaaccgcaaatatgtaaataaaattaaaaaaaaagttattttttggaaaaaaattcttcgtaagtgctgaaataggcataaaatgccataaaaatgaattaaattggcttagatcatcttttaatatttaaaaattaccttttggtcttttcaggggtatatattcaaaaaaaattttattctataattttcaaaaaatttgaaaaatatgtaaaaaaggaaaaaatgtacaaaaaatttgccgaaattttggatttatttttaggatttccaaaaatttccgtaaaaatcctcaaaatatgtaaaaaatgaaaaaatata

SEQ ID NO: 33254 - DNA, 993 bp, Heterodera glycines
  misc_feature (6)..(7): n is a, c, g, or t
  misc_feature (876)..(876): n is a, c, g, or t
  misc_feature (895)..(895): n is a, c, g, or t
ctgcannggtcttgctcacattggcttttataaacttcccatttcaggttttgggtttaatgttgctggaggaatcgataagccctatatccctggattcacggggatattcatcaccaaaattcgaagttttgacttgaacggtatcaatgaaggggaccaaattctctcggtgagacactaatatttacataatcatttttctgcgtattgttaggtgaatggcgttcagttggcaaacagaacacacgaagaagtcggccataattcaacaaaacaattcactcataattatttaatttaggccttgaaaattttaaacgaggcagcaaataattcaacatttctaattgaaacgaattccgagatgagaatagcatcggtcggcccattattttataatttacaatgaaagtatttctttagcgagcttccgaacccaatggcccttctgcctcattgttcgtgcgggacggcgacgacgacactttcgttgaggggtcccttccatcgagcaatttgtccaatttgagtgggcgcagtggagttcggacgagagaatcgtcgacgtcgacaataaaccaatccgtgttacgtgaagaaaatgcccacataccgcagcactgggcaatcgacgaagatgaaacaacaatcgacaaatcgcgcagcccatcgcccccaaatgaaactgacagtgagggggaacaacaatccgaatcagaaacaaagtaaaaaacaaaagccatttggagtgagaaaatttccctttcagttcttcacttggcaatgaattgctttatgtctcaattggagttgttgcgcttggcactatcttatactttggctaccgtcatttcctgaagaagtgaatagaanattagattaacttttgttnctatgaaatctgtttttatgcatttgctcaggtggtcacaaaaatttaatgaatataaataaaaaaattttgaaatcattaaatgaaagtcccgcatg

SEQ ID NO: 33255 - DNA, 819 bp, Heterodera glycines
tgcaggaaatacatgttttaatttattttttgtttttattttgttcggattccgctaaaagaattcagaattggtcgacatggatgggtcagattcacgatccgatccctctaaaacccccaggctttctgctaatgaatgtaatcaaaaaacaaatgtgattgggaaaggggcaaattgtaatttgttgttgattctcattatttgtaagtgtaccaatatgagaaaagagaagacaaaatgaaaatgaaaccagtttttcttgatcagcaattaacagcaaaattgaagaaaattgaggggagggcgggggggggggggcgaaggttggggacaaagaacaaatgaacgaacgaaatgtgcagcacaggctctcaactcagtacagtccgccgcgccgcgttccagcagaaaataaaaaacagaaatttcttggcaaaatgttgttgtttttttttcaaggttaagggtgtcaggggaggggtggcgacaggtcgattcggtggcccacgcgaaaaaaggattcccttttttgttcagcttttgtacagtttgtacaggagggattcgcgatttttgcctagaaagcatgggatttgccgaatttttgaggggcctgtgacgggtttttgaccgggttttggttttgtgccggatttaaagctcgaatgtctgtctggctgggtttttggcgttttacgcgcatccctgagtttgtatgattataaaaatagcataatttttttttaaaaatatatttaaataaattttggttttgtaaataaaaaacaattttaaaaattatttgccatttttttc

SEQ ID NO: 33256 - DNA, 879 bp, Heterodera glycines
cctctgctcccgtgccattccccttgtcccccatttaaccctcctctgttcccgtgccattccccattggttgtcccccatttaaccctcctctgctcccgtgccattccccattggttgtcccccatttaaccctcctctgttcccctttctgttcctcttccgctttctctttctgttcctcttccatttctcttccactttctgttcccctttctgttcctcttccgctttctctttctgttcctcttccatttctcttccactttctcttccatttctcttccactttctgttcccctttctgttcctcttccgctttctctttctgttcctcttccatttctcttccactttctcttccactttctcttccactttctcttccatttctcttcctctttctgttcctcttcctgttcccctttctgttcctcttccacttcctcttcccctttctgttcctcttccgctttctctttctgttcctcttccatttctcttccactttctgttcccctttctgttcctcttccgctttctctttctgttcctcttccatttctcttccactttctcttccactttctcttccatttctcttccactttctgttcccctttctgttcctcttccgctttctctttctgttcctcttccatttctcttccactttctgttcccctttctgttcctcttccgctttctctttctgttcctcttccatttctcttccactttctcttccactttctggtcctcatccactttctggtcctcttccacttcctcttcccctttctgttccttttccgctttctctttctgttcctcttccactttctcttccactttctgttcccctttctgatcctcttc

SEQ ID NO: 33257 - DNA, 1601 bp, Heterodera glycines
aatttggggcatgaacctcaagcccaattactgcttcccaatttcttgtaaccataaattttatacggcacttccatgtgtgccatcatttttgaaccaaaatccaatctctgggatattgttttggtggcatttcatcaaaaatcccgtctcaattctttctctctctctctctcacattggcacatttattttcttgttatttccccctatgtacgagttccccctaccgcaagtccgtcctctctccccccccccccacccgccaatcataatcacccgtcccagccttgatcagatcagtttcatccgccgatcagttattcattattttattcccttatatccgctcctagcgcagtatcccatccatcgtcattatcatttgaccatattttttgaccaaaatccattataccacattatccttacttattttatacttttgtcttcattttttgttcgttcttctgagtgagtctgatgaggccaaaaaggcatgtgcatcgtcgttgtcatcatttgtttagatttttttttgtggaaaattgctgataaatttgtatcattacttttaaatttaaataaaacgaaaaatatattgaaaaatttttataacaaaattttgaaaaaaaaatttaaatgcgcgaattacacaatgtgaaaagggagagggagcgaaagatggaggaaaaaacggagagcattttcgttagaatttcctagtgatgttcgagactggaaaatttctcgagacactgagacttgatcgagtcgaaactcgagatcgagacgcccgaaaaaatccgagacttttcttggatcgaaaattgccgagactctcgatgcatcactagaatttaaaaaataaaatgcgttgacggatgaaaaaattggcggtgtgaattctcggtaacggaaggagttaaaaatttggaaaaaaattgtgaaaatttcatgaaattttaaccccctccgaccgacgcaggcacagcagcgggacacacaacagacacagaagaagagactagcaaatttgagtggaggagaaatgatgaagaggcaaaaaagaaagaaaaaaagccaattgaaatatatgcaattaatttgaagtggtgggatttattttggtttaattacgcgtcctaaaattttcgaaactaattgggtaattaattaattatttaaaataatatttgttgacggggaaatagggagaaaaatgcacaggcaccttttagcactgatgaggcggaagagttggggacagacggcaccgcattttggcgcaattttttggatttaaatttttccgaaaaaaccaacaaattttccaccccctcgttttccgtgcaaaaatacggtctaaaataatatattgctgatgaatgaattttatgcgttttaatcattctttttttgccattttgatcagtagttggaccacatgggcttgcgaatccatcgcagacggaggccaccttaaatcaattttgaaaatttaaatttgagaaaaaaacttagaatttcaatgaaaaaaatagtgtaaattaaataaattaaaataaatacggatttaatttaactaattaatacgaatt

SEQ ID NO: 33258 - DNA, 1467 bp, Heterodera glycines
  misc_feature (1370)..(1370): n is a, c, g, or t
  misc_feature (1382)..(1382): n is a, c, g, or t
  misc_feature (1420)..(1420): n is a, c, g, or t
aatatattggagctctaatcattaatatgctttttattttgatcatttttgatttgtttttgtcatgtcttctcaaatgcctaaaaaatcaaaaacatttgaaaaatgaaatttatttgctaaaaattttgtaggttctgtcaaaaaaatgtttaaattggttttctgagaaaaaacttcctttagttatggcgcaaattacaaaaaaaaaaactaatatgccgaaatttctaaaaaaaaaattacaattctctaaaaaaacttttttttttcttttttttccagagttataattagaaatagttggaaaattttgagtttaaggaaattttcataaataaataaattggataaaaagggataattcagccaaggaaaatgcctttaatgatcctacataattggtaataaatgcctaatgaatctgcctattggagccatccaactttttcttagaatttttttttaatttttgagtcatttaaatgatttggtagggtgattaggggccaaaaaatatttatttgttcttattcaaaaaattagaaaattttatttatgtaattttttatttaattttttaatttttttatatgttttattctacaagtctataaagaaaatgcaccgaaatgtctttgagtttggcaaatgtgaatttttgtttaatgataatttttgcttgggcccaggccctatttatgcagtccatcattcattgtttgacattaattgacgtggattatgttggcatggcattatgctgacgtgaattaggccttagcaatgaaaaatttatgcatatgcattttaaatgcgtagaagcctatgaatatgttaatgcatgaatatacacatacatatgcatattgctctctatgaaaatactctttttcttttccttctccttatacaatatttctttcttttttttctataatttttttataaatagtttattttcattatagttttcttataacaattggccatctattttacgtttattgattgttttaataaatatatttatattttattttaaaataattaaaatttccgtagccaaaatgttaaaaatatatttttttgctagaaaatagaaaacatacccgaatttattggggtgtttaaactgaattttctacgactggaaactaatgctggattcaaatgatgagtgatgatgtaaacatttttcgggatttcatttatccttttcttatcacatttcttgtgctgcatacatttgttgttgatgggcataaaattgggtaaaaaaagaaattaaaaaaaaaatttcagtgcttaaagataaaaaggggccgctttaatagaggggcggcccattttaatagaggaattcttgnaaaaatgcccanatttgcatataaattgcgaaatatgtacaaatatgcanaatatgcatatggaaagtcgtcttaaaaaaagcttcaaaataagcta

SEQ ID NO: 33259 - DNA, 897 bp, Heterodera glycines
  misc_feature (804)..(804): n is a, c, g, or t
  misc_feature (833)..(833): n is a, c, g, or t
  misc_feature (866)..(866): n is a, c, g, or t
ctggtgctccgccattttgtgctcaacacttgctcacatcaaacgattcaccggccgctgaatgaacaaaaatttaaacaaaaaacgaatttaggccccaataattgccgggatttgaatcactgcaccggaattcaaatcgggattttgtcggaatcccgatccaggccctttttcaaaaaggaccgtgatcggaaacgggaaaatgccggcgggatccccgatccggtcaaggctctgatatttgctacggaatttggccagcgacgagttggatacgtttttcccacatataaagaactaattgaggatattttaaaattttacgcgaagtgatgagtcggaagaacagcaaagaattgggcaacagaacggccaacacattctcctcaaatgttgagggcaaaaaagtgccggccaacagctgaaggacgggcccagccaagtgcaactcggccaaattggcaacctcctcccgcttctctggctccttgccggggtcgagcactgaatgagggcagggattttgttggattgtatggaaattgggcaccaagacattgttggttttgggactcaacactgtgccaatgtgtgtgtgccactttcaaaaatgctttaatcccggcatgtgttggcgattttgggagtttaattctcagcctcgatttattgggttaatatttttaaagaaaagattagctatttttgaaaaattttactcaattttataacaaattcaataaaaatttccaaaattttccagccgcgcctatctcggcactgctaaaactcaagcattgngcaaggcttttaattacccggtgagtgtngccgttgagagtgccaacgatgacctggtcttnaattttgaattgtaaaatcaaatcaaataat

SEQ ID NO: 33260 - DNA, 957 bp, Heterodera glycines
  misc_feature (791)..(791): n is a, c, g, or t
tgatgagaaacctgttaataaattgggtgcaaatttttaaatattcccgtcggcgtctatctgcaccggcgaatccaaaactcctaagcgtgccacaagaaatggcaaaagtcaacagaaaattttgttattttttctatttcataaaaaatgtttcctctggggaagaacaaataatctgattgtaagctaaaaataatcctaaaaaggaattcccgagaagcgaattgcctatccaagccttataaaaacaaaacatacgcttataacggactccatctttcttctgagtgttgaggtggagaaggcatcaaccaaaaagagacatccgccgattggaatttccacgtgctcagtgaaaagaactcttaatttaacaaaaaaaaaatattgaaatgctaatattgtttttgatttttaaaaaacatttcaagacgggaatgaaaactcactctttccaagcagaaagttggctgattgaaacttggaaactcctcgtttctgtaaagcggtgatgaaacttggcgtgttgttcaacatccttcgggtcattcaaactgtacaccatgccgcactgaaacaattcaaaaactcatattcaaatatgattattaatcacttttatgcattgttctagaccaattttcttttgtcctgcatcaattatcatttgtcgagattgtgcacaattgccatttccgatgactttaaatcgaggccgtcttcttggcgttgattttgatcgaactttgttcgctttattggatgtgccgatggatgaagccctcggngttatgaagaagtctttaagaaaagattgcattagcaaattaggatttatcccattttcccaggtcctaaaatttttcatatgttttagggaacattcccagaaaaaaaatggatttccatatgattttaagctctatcgatgaaatttatgtaattccaaaatga

SEQ ID NO: 33261 - DNA, 738 bp, Heterodera glycines
agaatttgtcactaattaattatgctgtacgatttaaggagaccactcccaacgtaatgtgcctggcacgaacagtgtgatttccatgcccggattgaccggctcacacaaacactgaatgatgagttgatgagtgactgaatagaatgaaatgattgtggtgagttcgttttgtagtttgtacagcaattagctgttgtatttctgtatttagaataaaataaataataaattgcaattgcaattgaatttttctaaatgttgaatatgaattttcttttattagagtctttgtactttattccaattttggcacatttttgtcctcgttttctgtcctaaaattcaaccctttcatgacaagcacatcctgacaacaaaagaagccgtcccccccccgttcatgttctttcttcccaatcgcatcatttttattctccacccaattcattcgcaattcattcttctgttatggctccataaagtcgcctgggaaagtgctaaaaacgcgatgaaaattggaagacgaagttgatgtgatgatgatgatgtgatgatcaaattcagcgatcggagcaatgagcggacgaatgaatgaatgacccgcgcgacacgccgaagagagtcaataaaaagggcggcgatggcaaaacaaacgaaggcattctcaggagaagaagcagcggaaaggacaattcaccagcaaagactcatttcagacaatcggacaatatgtat

SEQ ID NO: 33262 - DNA, 706 bp, Heterodera glycines
tttctcggcactctcagaaagcaatctttgatccgtacattgttcttagtgattacctaagttgctcattgcctcgctttttgacttatcccctgtgttttatttattattgtctaaataaattatagagcgaaaaatggaaaagaaaaatgaacaaatggcggataaaaatgacactaaagattcgatcccacgcaagcgttactcaagtgcagtggacacaaatcgtttgctgaagaacgtcaaaaatgtattgaagaatgagaaaaccaacgaaacaatttccattgcaccgatcagagagccgatcattttgggtttttgaaattcaagtaaaaccatcaaattttgcttttttttaaggttcggactcgaggtcttttttctacgggaatccgttcgtggaaaagcataacggagtgctcagattcagcaagtgctcacactttcatttggcattacaaaatgatatccaatttaggaattgcacgccaacgggggactgtgccatgctgtgtatggtggatgttcccgcttttttcacatgcagagaattggttaattttgtacgaccaatggcagcagaaattgcactgatgaaaatcatccgagacgatacgccaaataagtaggcaatgctttttaacttaagaattaacaatttttaaattttcacggtacgaaaccttaaaaaaccatttttcag

SEQ ID NO: 33263 - DNA, 639 bp, Heterodera glycines
cccccccccccgaaatgaaaaatcaaaaatttttcaagcaaaaatgggcaaattttctgaaatttttgcacattttcttatcatattgcattaaattttccaaaaaattttcccggcagcgcctattactaattctgctttttggctccggcgttaaagattttgaaaataacactggtgttaaaaaaatttttgacccgaagagcaaaaaaaaaaaaaaactcttcgggtgcccgccaaaaacataagcaattcagcagacactcatttttgagaaaaaaaagatatgacaaaaaaagaggaaaaggaggagaagaagcttggcacaacgaacggttggggcttaaaaggacaaaaaataaaactccgaaaggaattggtaatattttaaaaaaaaattagggaattccactaattgttggaaaaactgtagtaaaaacgggaacagaaaaaacagaaaattttgtttctgatcaaaaacaaccggaaattgagtttatgttttgtaattcgaaaaaaacgcatcaaaaaagatactcgaaaagctaaaatatggcccacttaacttaagtgctaccgaaaaacaacaaaaatactaagacaaaaaatatgcacgcgcggacggagggcgccgggggg

SEQ ID NO: 33264 - DNA, 925 bp, Heterodera glycines
tacagaatttttttaataatttctttaaattattttcaattgaaattttaattaataaaaaatattcaatttaaaaattattattttttctttttttaaacagcctaaaactgcaaatttaaccaaaactttgatcattttttgacaagttctgttaatatattacactcaaaattttagaatttttccggcggcgcctatcggcggtgccgattcggtaccgccggaccccgcacccaatgttccaaaaaaatttttttttggaaaaacagcgccacaaaaaaagcgacttaaaaacaaaaaatttaaaaaacaagttttggtcattttttgaataaaatctgttaacaaatccgaagacaattttcaaaattttttcggcggcgcctaccggcaccgcccgaccccaactgtccccgaagttttaaaaaacgcaccgcaaaaaaaaggtggaaaaatggaaaaataataaagtttgtttctaaaataaatatatttcatgaaaatattttttaattttcatgaaaaaattttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtctttttggggactctcgcctctcgccaaactatcgctctcgtctttttggggactctcgcctctcgccaaacgactctaga

SEQ ID NO: 33265 - DNA, 1223 bp, Heterodera glycines
  misc_feature (1211)..(1211): n is a, c, g, or t
ccgagcttccagtcccatacaatctcatccctgaagatcaatcagcaatgttttattgaattggaccaaaataagataatccgatccctaatcaaagcacggatccaataggctttgtcaatcctatcactaattaaatggctttgtccaacttcttttttcaaattcctattaaaaatatttgatatttttgaaaaaattagggttaaaaatattgttttttaaataataaaaataattattgcacgtgttgccattgacccatgtgttctgaatcaatttatttgatcatttacatttaccatttccttttaaaacaattcctgatcaataattcttcccacaagaaatttgccaaaatgcaattaattatcgctaattacctgaacccatgccactgaaatgccattgcttttcaagtagtttaatatgccataagtgtgctcgtacacatcagtgttaagttgtgccaatgaatggcttttccatgccgctggaatgttctgttggcccgggtcggcccacgagtcgctgtagtggaaatcgatcattatggccataccctgggccttggcgcgctgggccttgtgcaatgtatcggcaccgtcacaccatccaccggacgggttcacctaaagacgaatttattttatttttcttttcaatttttcaaaatttttttgcttgattttcttataaaaaaaatttctaagaattttttttagtaaaatctaggtttgaagatgcggacgcggggaaggatctgctacggtaggtgcttcggatcggagagctcggattcggggtcctatttttgtttaatctcttctgtcattatgtccttaaaactattaatgctttacatacaatctcgatttaataacccattccaattgggtttacggccattaatgtcattaaaaatacaatgataaatattccttaaagccatcttcaaaaactttcggtttaattcattaggaatatttggtaaactaattactgtcctttaatgtttttaaattatttgcatcaaaaaactttaaaagtgttggtgcttatctcagcccttcagaggatttgtccttgaatgttgcgtggattctgtgacaaacccattaacatatagctcccattaatgtctttaaattgtcgacaacctcaaagcaattttgattttgtcgcttatttccccttacgctttgattgantttttgatcaag

SEQ ID NO: 33266 - DNA, 1016 bp, Heterodera glycines
gttggataacccataaaaaaaacaattaaaatatttaatgggtacttaaatgactcgctgattaattttgtcagcattttactgccaaatgtttggactatgcacaaatgaaaagcaatttaagaactatgcagtacaaaaatttttccaaatacaataaatgaaaaagggaaataaatctggcacatataaatattacggatgataaggtagtgaaattgcaaaagcacagggaaaaacagctaacagattttgggcaggattaagcgatttcgtaagccaaatttacgcggcggggaaacgacgaaaagcatggtaattaatcaaatggaaatgttaattatgccaccggaagaattaaaattgaaggtcatggggtaaaatccttggaaatctcgcccctctcttcaaaatggctaagaatcgaaatcgcttaacccaaatttaatggccgatagttcggctgggataacagatcttttcttctgtgcttttatgccttcgttctcctcaaccaaaacagtgaatcggcggcgccattccctccggcgccatttgcccaaaaggcgtaaaacaacacggcaacggtcgaagcgagaagcaatccgctgagaccgatgaacatggaaaagccaaaaatgctcatgcaaatgccctcctgaagggcggtgaacagaaagtgacggcgacggttggccgacgaaaggcgcgaggacagcgaatcgggaaactgaaaaaggcggaaaatgccaatgtaaaaaggggaaaatgccaatgaaaaggggggaaatgccaatggcaaagggtgggacttatttttagaacctccaacaaccaacattttgcgagatgtccaacgcattcagctctgctctgacgtccaaaatgttttctcccgccgcggcacgtcgccgccgcaacagtcgaagttgggagagggcggcggacggacggcggccgccgggcgatggagcggcaggcggaggcggtcgaccagtggcgggcgcagcagagcc

SEQ ID NO: 33267 - DNA, 965 bp, Heterodera glycines
ttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagtaagcaacgattgctgactagcaaaaaggttcggtgccgtgatgaaacg

SEQ ID NO: 33268 - DNA, 838 bp, Heterodera glycines
acttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaagggcgtagtttgaacgacacttctctagggtttgaggtgttttgagtcaaaagtttcgcttttcaaaaagctcgttgggatcgtcctttttcggcaaaagagcgcaccatagcaaaaatggcggagtttgaacgacacttctctagggtttgaggtgttttgagtcagaagtttcgcttttcaaaaagctcgttaggatcgtacgttttcggcaacagagcgcaccatagcaaaaatggcgtagtttgaacgacacttctctagggtttgaggtgttttgagtcagaagtttcgcttttcaaaaagatagttgggatcgtcctttttcggtaaaatagtgcaccacagcaaaaagggcggaggttgaacgacacttctctagggtttgaggtgttttgagtcagaagtttcgcttttctacaagctcgttgggatcgtcctttttcagaaaaagagtgcaccacagcaaaaatggcgtagtttgaacgacacttctctagggcttgaggtgttctgagtcagaagactcgcttatcacaaagatcattgtgatcgtactatttcggcgaaagagtgcaccatagcaaaaatggcgcagtgtgaacgacacttctctaggg

SEQ ID NO: 33269 - DNA, 409 bp, Heterodera glycines
ccccaagaaaacattaaatggaaaattctcaaaaaaataaacaaacatttaatggaaaaatgcgagattacagattataaatggaaattaaacgatagcttatgcttttcaaattagagaatacagacacaaaacattgtgtgaaatttataggaaaggtcagaggttgtgaaaagagccgtgccggcgccggaggcgaaaatgatttttcaacagtgatcagaacgatggcacccaggaaaagccctgaattttgtcgggattaagctgacggtaatagcgacgagcacggcgaaagctggtcttccagtcaaagggcggcacgaagcggaaaaagctaaaattgaaaaacacttttctcagcgggcagggacggtcccagggggggggggggtacgcggggtacgta

SEQ ID NO: 33270 - DNA, 910 bp, Heterodera glycines
  misc_feature (847)..(847): n is a, c, g, or t
taaaagcctaaatttattctcgctaaacaaaatgtcgatgtctaaatcgtcctacacctacaatcggaagacatttgaggatgcggtgagatggccttaaacatttccgcctcaaaatttatttctaatatttaaggaattccctattttgtgtgagacatgcctcggcccgaacccgtacctacgcatggtataacaatgggaggggtggtcttacatcacacaatttcccgtaaaactgtttttagagcaaagacacacatggaggcgaatgcaaaatttgtgagcgtccattcacaacatttcgttggatgccgggcagaggggcgcgctacaaaaagaccgagatttgtcagacatgtgccaagttgaagaatgtgtgccagacctgtctgttggacttggaatacggttcttatgaattcgccgagcaaaattaacggatataatgaaatttaggccttcccgtccaagtgcgtgacacggcactccaagtcaaggagaccatcccaaaagtgggggccaatcgcgactatttcatccaggttttttggtggcatattttttcctattatttacgaattaaacaaaaatcccgctgggtttcagaatgttgaccgtgctttggaacaaacggatggcacagtgccgtacggcgagttggccaaactgaccgatgcgggcaccaacgaaatgttgcgcaagctggcccgaaatcagccatactacaaccgaaatttgccacacatttgctcattctttgtgaagggcgaatgcacccgtggtgaagagtgtccgtacaggtgagtaattggaatttttggatggaaaattgcgaacaaattgntcatggattttgagaggttgtgggatttgatgaattaaaatgtgcaaatataccaaattctac

SEQ ID NO: 33271 - DNA, 831 bp, Heterodera glycines
  misc_feature (658)..(658): n is a, c, g, or t
  misc_feature (722)..(722): n is a, c, g, or t
  misc_feature (773)..(773): n is a, c, g, or t
  misc_feature (797)..(797): n is a, c, g, or t
  misc_feature (817)..(818): n is a, c, g, or t
gttgactgttaccatcatcacttgtcgagcaactttttgccacaaatcgcataaatgtaaaaaatgtggggtgatatggaacgtgagaaataacaaagggaagggacgagctgggcatgtgtgcgacgagcgcttttgcagaacatgtggtgcctttcataaccgtgaacgtggatgctttattcggcaactcaaaccgcggcgcccgaaaacttatcgattggtagtatacgattgtgagacaacgcagaattgtcatgtaatcggtgcgccagaggctcagcaacggcgggtacacatagtgaactttgtgtccgcattcgttacttgtacaaaatgcattcaaattggcgcaactccctgctgaatgtagtttcctcgtgtgaaatatgtggcccatatcgcaccctaactttctctcatcgacccttcacaggaacagaagtggattgtcaacatgtatgcgacgatcctatgtcggcgttcactgactggttgctcttaggatcgcataacaacagaaacaacaacaccatcaataacaacaatgaaagcaacagtaaaataaaaccacacattaaatatcctattaatgtattcgcacattttggtggtcggttcgacaatgtgattctgttccgacaatttttcaacaggngactgtgtccgaaaatgatcagacggggtaataaactttatgagatgaaggtgctgcgcgctanagacaatccggagattaagtgcgcgacagttggaactaatgcctgttccgntaggagcgcttcccggtgcattcngacacagagtgcaggacaanngatttttccctca

SEQ ID NO: 33272 - DNA, 923 bp, Heterodera glycines
cttcctttttgatcatatcccatcattattgattcgaaatgcccttaccgtcgatgacagtgatgaggtggactcgtcgttgaagtaactgcgcaagaattgcggcgcctgtggcacctgcgcttggtccatccgatgaggccgtggcgacggcgttctgcgcaatctgtcgatgatccgctgcagattttcctcctcatgcggcgtcaactctcgctgcggtgcttctccggcttcttgctcctctaacttttctggctcatgccgttctctttgcttctcggcttccttcggtggcacttcgtcttcaccatcagtgacaatgacccgttgatgctcctccgagaattgttcctcgtccaccaaattcagcgagtccgcctggctgagttggtccggcggaacttccaacgactgaatctccggcgcatacgtcacgtccttgtcgtcaatgtcctcgaaaagcagtgctgcgtccgctggcctgtcaaatgcttcgttagtgccaatttgtcggctcgtcgccattgtagctgagctgccgccaccgccctccgccggctcgggactcttgagcaacactaagtgctgctgctgcacttcctcttttccactggtttcccccgtgaattccacgtgtccctctttgcccgccatttcgtccgccacactttccagcatttcctcctccactataaatgacgatggctgcgccgttccgtccatttttccctcctttcttcgcatttgctgtttctccaattcgtccgaaatgcccttctgttgttctgcttctctcttttgcttttcctcttcttcctttcttcttggcgttgttttctccttgccaaagatcgtttgcttctgttgttgctgctgctcaattttttccgttgactcggcatgttcaactgaatgagtga

SEQ ID NO: 33273 - DNA, 240 bp, Heterodera glycines
agcttaggcctaggcttaggcttcagcttgcttagttgaatcctatttagagatagatgcaaatgtctggacacggatagctcaattattacagaaatctgctttacaacgaacatttataaaacagaagataataacaaaaaaaaacatggaaatcttcttatttgctttatcaagccgtcctcttctgttcattttttctttgccttcttctcttcttcttcgcgaattttttgctct

SEQ ID NO: 33274 - DNA, 824 bp, Heterodera glycines
  misc_feature (749)..(749): n is a, c, g, or t
  misc_feature (772)..(773): n is a, c, g, or t
  misc_feature (787)..(787): n is a, c, g, or t
  misc_feature (797)..(797): n is a, c, g, or t
ttaaaatatttgggtgaactgtagtgaacgccccgtgaaaaaagggtcaaatgatataccaatcgtttcgtctcaaggagctaagcatggaaaaatatgtctcgagttgcttgaaatgccaaaaaaccggtttttgaaccggttcaaaactcgaaaaattgagatttcgcactctaactttttttaaacgatcgaatcccgacaaatttggtaccatttgaaagctcttgaagagcttaatctaaaaatcagggaatgaagtcgaaccgcgccatctaaaaaccgacaagtataaatcggtttttgaaccgattcaaatcttatagtgccaattcagtaccaaacgtaatttataattgttttaattggtaccgtagggaaactggtgcaaataggtcattttgtttattgcgctaaaaaaccgccgcacactcgactacggcggccagtattcctccgccctccgtaaaatttatcaatcataggattgatattttttttgttgggaataaataacataattaatttatttttaacggctaccaatttttcaatcaatcaatttatacgcaaaagcgtgacaccgacataaataacaatataaataaatttggtcaatgaatgagatgaggtggtttcaaaattaaagcatctacatcataggtgtcaagaagtttagcaaagtcaatggaattaagtaacctcgcctctttaggcaaacacctatagaggcgagaggtacgaataanaaacgaatgataccgaacattgnngtgacataaagcgntttataatanatcatttttcagtctgaatatgttttt

SEQ ID NO: 33275 - DNA, 914 bp, Heterodera glycines
  misc_feature (892)..(892): n is a, c, g, or t
gttttcgacggcagccaacaaatgcaatgccatggtggccatctgttgggcatggtaaatgccatgctgccactcgggtacaccggacacgaccatgtaactgtagtagtatacggtttgtgttgggtacggtaccatacaaattagtcaaataaattttgcaaaaattgattaagtccttgattagttttattggaaaaaaagccttacgcatcgccaatagtttccactttgtacacgtcatactgtttgatgatctgttaattaacaatatttttaaacgaattataaattttacaatattatttattttacacagggttcgtattcgtccttgtaagaaagtttattattctatgagcatttgaaatgaaaaacactttacattaaagttggcattgtaaaacttattctatatataaaaaaacacattttaattgtaaaaaagtttattattctatgcatatttgaaatgaaaaacactttacattaaagttggcattgtaaaacttaaatacattttaattgtaaaaaagtttattattctatgagcatttgaaatgaaaaacactttacattaaagttggcattgtaaaacttattctgtatataaaaaaacacattttaattgtaaaaaagtttattattctatgcatatttgaaatgaaaaacactttacattaaagttggcattgtaaaacttattctatatataaaaaaaacacattttaattgtaagaaagtttattattctatgagcatttgaaatgaaaaacactttacattaaagttggcattgtaaaacttattctatatataaaaaaaacacattttaattgtaagaaagtttattattctatgagcatttgaaaatgaaaacactttacattanagttggcattgtaaaacttatt

SEQ ID NO: 33276 - DNA, 910 bp, Heterodera glycines
atttttaatgggctgacagtgccaaaaaaattgagacaccgaaaaaggcccggggtccagatcctgactcttggtaatttttggaaaatacatccaatcaggatctctaaacagaatttattcccataaatcggtccagaccaagttctgaatccataatcctgattcggaatttgtcaaaattacgatccacaaaacaggcgactccggttagacaaaaaaatttttgttacggatttgttaagaaaagaggaagcagctaatttaaaatttctaccattttaaattccaattgggaactgccattattaaacctataattaacaaaaaaaaaaaaaaaaaattttttttcaaaatcatgaaaaatttcatttttttaaaaatttcaaggattttgacaaaaaaaatctggcatgaaataaagtggcaaagacattccccttttttgttgttgttcagcgggccaccggaccacgcccattgagctggtgatgtgcggtcgttgtggcgctggcgatgacgaggcgcgcctgttgctgtgcgagacgtgcgacgcgtccatgcacacgtattgtgccacaccaccgttggcggttgtgccaaagggcgaatggcgttgtgcccaatgcgtggcgagcgcggtgcgcagtgtgtccatggattttggcttcaccgactccaatcagtgcttcacactggacacgttcggcgagtgggccaacctgtgagtcttttttttttgcattggcattttgttgggtcgaattggcacgaaaaaatgccgaattataatggcgagatggaaaatgtgcccaaattttaaacgagagagggtcaagtgatttatttggtcattgatttcatgggcacgggattaatgccaaatttttttgagcgaaaaattttgatc

SEQ ID NO: 33277 - DNA, 1133 bp, Heterodera glycines
  misc_feature (25)..(25): n is a, c, g, or t
cgatggtcacaatggaggccaaatntagtcggattttgcgcaggtgttgtgagtaggtgagccatccgaggaatgccctcgccaaaatttgactttgcatcgctttggtcgcattgctcaacgattcactgaagttaaatggataataccacaatcaaaatttattaaaggcaaaagaaaatccaattaaatgttcggcaaccgtaaagaaatcttcggttgttgtccttcgcattttgccgattcttgcgttgaagaacgcgaaaatgaacgactaaaacattttaaaatggtcgaattttatgaactttccattggcacttgcttttctaacggcattttctggtcaaaactcggagaagcgaaggaaataatgcgaaataccaactcagaaccgggcttttcaacgagaggtcctttttggtgagaacaatcagtcgatttaaacaaagttgaaggtttaatggtcgaatcaacagcaaatgggcataaaagaacaaattgaaaataaaatcgaattcccattagtggacgacctgtggcaccgcattcgattttaatggaatttaatggggggtcgattttgaaaagtgggaaaagtgcgccttccaacgtcttcagaaaggagaaacaatgttgctcaagagagaacgaaaagcaaaactgttgaacaccatcagaatcgataaggacaattgaagatgaaagagtgccctctgaaagggagggacaattaattgacaaacatttttggcatagacacggaccatttttatgcaagtgcaaatgtgaaacggtctcgaatttaatcgacaccggcacacaatgcgatgagtgacttggacttttgacagcatttgttgttgaacccccgggtctaaaaggaagcgaaaatgggttaaagtgaatcattaagcaacaaatcgcttaaatgaatatatcatacttcgaaaggagaagcgaattcggaatccatttgagaataagcatccgattttggtcatgatgaagcgacaaataacctgcaaagcaatcaatgctcgagtttgaatttttctccttaccaggggcttctctgtcgccagaaaatgcgaggacattgtttttgccgaacagaaaggctgtccttacgt

SEQ ID NO: 33278 - DNA, 1004 bp, Heterodera glycines
aaaaaaggccgtcaaattgcatggctagaccccttcgcaaaattggccgctgcccccccccccctttccatgtatgatagagaacgaacagtggtgagtgcctccattaaaatggtcgttttggtccccttttcgtccgttatgtcattggggtcgccgagcaatgcaacaagatcgacatgagagatgttttcgagaagagggcgtacactgatgtccaaggctttgaacagggagtgaagcaagcttctaaaagactaattaatgcataaacgaattaagcgaagtcaaaagagactcacccgggcattatgtctcttctgctgatgtgcaccactttaattgtgccgtgcgtgcttttgtattcaatggtttccgtttgattctcccggtaatccaacacgagtgcggtcattccattctcaacaaaccgcacaatctcagccggtttagcgtattttttgaattgcatagcgtctgaaatcaaattatgtgaacattacagttagttatattgttaaatgatgggcattttatttgcataaaaacactttctaaaaactatttgaaataaaatatagaacaaaaagtttttcatttttttccaaaattttgagcgccgggtgaaaagcatgaatttggagtttttgcaccaaaaaatggtaatttttggcattggggtctaattttcaaaaaataatggtacatgggtccggcggtggcgataggtaacgccgggaattttaatgatatgaaaattgtgtaaatttttcaaaagatttatccatttattctattagatatttttcatttcggagggggggggcacgtgcctcctcccccctgaataaggaactattgcgttgatgcaaggactatattaactataatattagggtgggtggatgaagtgagtatcaaagttgcggacacacgaaaaatggaaacaattgattactggtcggtgaaatcccaccgcctcacattttgaggagactcaactt

SEQ ID NO: 33279 - DNA, 699 bp, Heterodera glycines
ataaattctaaaatcttaaaatatgtaaaaaaataattatgtatgaaaaattgtgataattttttttggacatttaagaaaatttatgtaaaaaacatttaaataaaaatcccatcccaatcttaaaaattgttaattcaaatagttacttggcccattttcaccttataagagtgggatggagaagaccgacgattattacgcggcacatgccgatgataattgtgcgcaaattggtattggtcgcccggttcattgccaatgactgtcggacgatgttgttctgtcatcattggatgtttttaaatttttaaagatcgtcagaattcaaagaatgtaccattattttgtgaaaatgtgaccccaaaatggcaaaattttggcgcaaaaaaccgccagaaatttttttttatttattttttattttaaaattcttctcaaccgtcagaaatttgtttgttcatttttccaaaacccataaaattgttttttgtgtaaatctttataaatgtggccaaaattctcatttttcccctggcggcgtcttagatattcatttcatttttttaataactcaacgcttctgtttacaaaataaataaatttctttttattaaataaaaatatatttttggaatttgtattgaatacaattcatgacgaatcccccccccccccccccacataaacggtgctatg

SEQ ID NO: 33280 - DNA, 915 bp, Heterodera glycines
  misc_feature (867)..(867): n is a, c, g, or t
  misc_feature (907)..(907): n is a, c, g, or t
caaacaatccctcggtcagccaaaaccattgccccggccttttagcggcgttcccccgtgtcggagtcgtggacaacggcagcagtcagtccaacccccgaggagccacggccagtggtggcaattacccgtggggcagtgtgaattacgtatctgttaaagggggagtataaaacaattatctaatgactgtcagagacacctcaacatttgacttttggccaccgatgggtcgccaattagcaaaacgtttatgtcgccccgaagtcgcgtcccattttccaatattttttcacagccgcccaacagaagacagagaatcgcctttttcacttcttcatggccgtaaatggacggggccaatgagcgggcgagaagttcaaaaatgtttttgtgccgactcattttacgcatttctttgatgtcttcgggctcaaaactcggctccatctctttgctcaacaattggatgttattggcaatcagaacggaccttaattagcagttagaaaagcatttatttgcattaatagacaaaataaggaaaaatgtcattagtatagaaaacgcacaaaaaaaggaaaagacggacctgaaattgccagtggacatgccagcttgtttgttgggcaaaacgcggaagagagcaatgactcgaatacgatctccaggcttacaacagtcggccaagtcatcgtcagcttaaagaaaaatttaattgcaccaaaaaggcaaaagataaatgttaaaagtgccaccaatgacatcgatattccgtggcaaatgtccgggaggcgccgcttcgggcaactcctaaaggtggaaaatgctcaaagcgacacttagatggtaaatgcttcgacctgnatggagaacacttggtggtctttgtacacgcatttgccanattccgtc

SEQ ID NO: 33281 - DNA, 1075 bp, Heterodera glycines
  misc_feature (143)..(143): n is a, c, g, or t
  misc_feature (1016)..(1016): n is a, c, g, or t
ccctccgccccttttgttgcccgtgccgaaaacagtcccacgaatacgacgattaacaacaacaaccccgtccacgtcgactccgccaacggtcgtccgacacactttggacagccgaagcgcatttcaacaacaacagattntggacagacggaagacattccgatgccgcgggtcattggtaaggcacaaaaacaccattacggccggcaaaagagacagattatacgtatcatgagttcagaggggcttatcccatgccgactgactgagtgaaacggcatgggttcgattcccacccgcggcgctttgttcattttcaagtcgccctccccctttaaatagggtcccacggttgtctcggcaccgtccgtcgaacacgaggactaccgcaccccaaagccgtcggtgttttcaattggcaaaagcgggaagagtttcgatttgggaggggagacgggcgaatgttcggacaacaacggactggtgaaggtgagcgaacggaggacaaaatggcgcaacttttgagcgatttggggagttacgcaaatggtcataatttaaaaggcatttgagatttttaacgagggatttattggtgggggatttgttcaattttacgagtgaatggcattggataaaatggaattatgatgactcgtcggtagccgtttttggcactttgggccaattgaacggattttggcacttttggaaaagggtcccttcggactttacccttctcccttttctcttcccttctcctttaccatgcctttttttgattatttttccttcactcattctttttttcattttctctctttttcaatttgactttgtccaatgtcttttcccttcttcaaatcaaatgccatttgctcacaatttatttacattttatgccattattcatcactttttgtcgtcattttcgcttttattgcccactccaccggaggtgctttaaaaatggattttcttttaacgaagaagtcatcttcagcaaaaatggnggcgggaggcgagcgaatgaatgaatggcattttgggggaatcaacacagcgaaaaacg

SEQ ID NO: 33282 - DNA, 838 bp, Heterodera glycines
ttttgagtaaagagtgatcaaacgactcatgctcaaatgagtggatcaaaataattatgtggtgcataaaaagcacatgaataggggtaaataaaaacacataaacaaaaaataatcaattaaattttctagtcgaaattttaattttttcaaatttgatcgacttgagtaaagacttttttccaccagtgtataaacacatgatcatgagtcatgactataaaaaaagtttaaaaaaaaagaaaacttttggcaattgaccttttctcatgttactttctttgttggcttgcgttcgtttaaatatattttttggctgcctgctgctgctgtcacctgttatttatcgcttttaaggcctttgatgtgtttaattgtgagcctaaccaaacaatcattgtgatatgtatgtgataagttaaacaaacaattttgatagtctgtctaatctgctttactcacatgtttaatggttaataggcgctattatgcaatacacaaacattgtttgttaggcattaaattgttagattattttacatttacatacatatatgtcaattttttcttttaaatttatttattttaaaatctttattacgtcaagaattaggttatacattacgtacctcttttagttggaaaacctaaattctttacattctttgaatgtaataaaaatgatgtaacattcccattcctttcaaaacttaacctttttgtttaacgatgcgacatgaatgttatgggggtgggggggggggacgtttataaaaaaaccatcaaaatgtgggttagcccaaaaaacatcaaatgaataatttttgacagaaaatta

SEQ ID NO: 33283 - DNA, 939 bp, Heterodera glycines
  misc_feature (890)..(890): n is a, c, g, or t
  misc_feature (901)..(901): n is a, c, g, or t
aattaatttcggaaatttttttaatttttaaagctgttcataaaatgtaataatacccatttatctgccaatttcatttcatttattataaatacaatattgtataatgttaaattttgtttctaataaaattttgtcccctggccttaagctaacaaactttattcatttgctatttattttacaatgcaattcgaactgcattgttatgtgaatcctgccgttgaaatggtaaaatattctaacagctttataattttttaaattcttattttcataattcgtcaaattattgttttttctcatttgctcaacataggtaaataatgtaattagaagtaaatgaaatccgtacaaaaggcaactcgtctaataaaaatttttacaaaataagccttagcttaagccaaaggctaggcttagccgaaagcttaggcctaagcttaatccaaaaattttggcttagcctaagccattgtacggttcctttcgtatgaattgttatacaccgtaattagtagtttatatgtgttttaaaccctcaaaatatgtgcaaaaactttgccaaaaaggtcaaaattgttttaagttcattatttcattttccaccatataaaaattgtttaaattctttttatggtcccataaattgaatttttcctccaacgaatctttcttttatattatttttactaaacaaggctaatacaaatccttaaatttttcgctttttcatttagcgtggtcctttccgagttttattgtcccctaaaatgccggtgccgtcgtcgtcccctccctgtcgaacttgtcaatgaatttgtgtcctttgtccctggtcccatttgtcgcaaattcgttctcccccacaaatttctcattcttccatntattactcagntcgaaacgtttcaaaatttggaaaagcaaagttagaaa

SEQ ID NO: 33284 - DNA, 1087 bp, Heterodera glycines
  misc_feature (790)..(790): n is a, c, g, or t
ttaatcacaatcgggccaacactgtcccggcaagctttgttcaggcaaatttaataaggcacaacttttatttcaattaaatgaaattttataaaattgtcaccattcaaaaactcttatcaagttttaatagctttccaataatcgcaaaaatttgcaggcacaaaatataaataaaatgctaaaattaaactttttttacggtattcatgttgcaacctttttataaattctttaattgcttgttagcaatagctctacttgccttacttatcctgatcatttattttaaatgaaataccatatttgctctttttatgtgccatggtatattatttttcaacctcctcagaaaggggtagataattagagaccggcagtttaatggagactggcacataaaaagagcaaatatggtaaattattttcgtaacatttttttatccttttttaataaaatatacttttcccccttttctcctacaaattggcgtgaccgttttccatttttgctctttttaagcaacaaaaaaagcatgaagtttatagcagctaaattgtgcagcagcagaggtggcaaggatttatcatcgtcattttgcggaaacggcgcatttcaccggggggggggggggcgggggaaatccggtcgttttgcgcacccaaaatggcgccacattcaaatgacggcgcggcgcggcggctaaattgcgcgcaaaatgctctcggcttttgcgaggcggaaaactgtgcagcgccgccagcagttcgccacacaaatccgaacaanacacaacgccaatacataaatcgttcattcattcattccattcattcacccattgtgtaattgtgatgccattttggaagttctgctgctggcattgcgaattttgcatggggtcataaaaatttgaaggaaatattctgtgaaattgtttataactgtgttaaccaagtttttttcctgttatactttttattataagttgaaaaagtaataaaattgttctttaattaaatttgaaataaaaattttttggtttaatctttttttaaaatttaaatttggaaattttttttaaaa

SEQ ID NO: 33285 - DNA, 499 bp, Heterodera glycines
ctgtcacgaaagcgacgagagaaaaaggatgggctttggatggccgggattgttcccggcggactgaaggaagcagggggctcgatgccaaacagtgattaatttatgatcacccccaccatttttgcttccttttacttcaactatttgcccacctcccccccccccccctctttttccgtcttatccaatttgtttaccatttcccttccttttgcttctcagcatttctcatttgcatttttgtccccccgctcacttgcatttcaaatgttttcctttgttgctccgccgcggggcatctgctctccgatcgcttctttgtcccaattttgcccgtttttttctccccattcatttcaattcattttgtaccttgagccccaatgtcatcgggcaagttttcttcccaactttgtccccgtccgaaatgaccattcacgtgatttgcatttctcattgcccggcctatttaaccccagccggtaatctctccggg

SEQ ID NO: 33286 - DNA, 935 bp, Heterodera glycines
ttgctgtttcttaattcgtatttcttttttccattcactctaattattccctaattgaccttaccccctccccctcaatttgtccacctttgatgaatttgttgcagtgccaaagtgcggtgacgtgcatttcgtttttggtcagtgtgcccgttttgtcagatgcgattatggccacttggcctagcgcctcgcaaatgtccaaacgtttaacgtacacatttctgctggccaagcgacgcgcgatgaccgtcagaatggaagtgaccgttgcaggcaatccgcagggcacctgccgacgaaaggaacggaaagaatgactggcggtgccgtgccaccaaagccgtgccgtggaccgaccattccgatggcacagacgagaaagccattggacagcaattggacaacattcgcccatcgacgcacaaatccgcccgcgacaaacacaacgaaggcggtgccacaggccaagacgatcagaaatttgacgtatttgcggatttgcatttccagccgactttcgttggactgctggcccgtggtcaaatgcgcaatttggccgatcaccgtttgggccgcgacgcgaatcactgcaaaaaatggaaaacgcaaaataactgagttttaattaaatgccagcaccaattgcaattgcgtcgccctccacgcaaagtgagccgttaaacgccacattccgtgcctcgaacaccgacacggactcggccacttcctcagcttggtactcaattggctcagattcgccggtgattgaggaggattccaacttcagctccgaacagtgcaaaatgcttaattcaattatttacttacgtctaattgtaatttaatatatgtaattgaatatttgaatatttaaattaattaattagtttaatttgcgtctcaccgacagtccgctggcacgcgattccctg

SEQ ID NO: 33287 - DNA, 979 bp, Heterodera glycines
aaatattttttattaggaacttcttaacttttgagtttgagcacagaaaataataattgagcatagaataatgcagaatttttttctctatcgatttgcaaaatttggtgtggatttaataagcaggaaaaaagttaaacaggatgaagtgaatgttgtttttcctaataataaaaatattagatagtacgccaaaaggagacaaaaaattagagaaaaaaagatattgtttttctctggcactctctatttattggtacacatctcgttttttcggacggtgtgaatagacaatggacgaatttgtacatttatataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttctataaatagacaatggacgaatttgtacatttccataaatagacaatggacgaatttgtacatttctataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataaatagacaatggacgaatttgtacatttccataa

SEQ ID NO: 33288 - DNA, 98 bp, Heterodera glycines
cccgtgaatcctgaccgtgaattaaccccgtgaatcctgaccgtgaattgaccccgtgaaccgtgaatcctgaccgtgaattgaccccgtgaatcctg

SEQ ID NO: 33289 - DNA, 1391 bp, Heterodera glycines
ttttccaagcattcccaattcatactgaaaatgccaaaattctctattcagctttttatataatgctacaattctcaatttagctttttatataatttaaacattaacaaaaatttcttgggagcttttgcccccacatttcttccacgaagacggggagaaagaaactctaatcaattaaatttttaatggggatttttggtccaaattaggctgtattttttgcctgtcaaattaattttttgaaaattccttctgctaaccctccttttgctgctgctgcctatttgttttttgtcctttttttgcaaaatttgggaatttaatttgctgttaaaatattgctccatgaaagtgtaaagttcgggcggctgttctccattattgtcagcagatgatttctccgtgtttgaccatcgcattaaaattgcttccaacactttgtacacctcgtaatatgacaatgtgaattcaccgagtttgagcagaaagttgaaattttctgaaatatttatggaaaggcaattgttagggctgtcaaaaatatgtacataaaatatataagaaaaataccaaaattgtacgaaatatgtaaattaaatgttaaaatcgttatttttggaaaaaaaaattctataaacattgaaataggcacaaaatgccataaaaatgatataaatagggcttaggattatgtagggtttccagtagggtgttgacgggtccgagtccaacttgacgctttggcaccctgtcaaggacccgcggtccccggtattcttaacacaggatttctcgaggcttacaaaaaaacagattttatggtaattttaaagttattaagaaaaaacttaaaaatcccgatttttggcaattttgatgctagaactttttttttaataattgccaaatcaccaagggaaagcttagaattcgaatgctattaaaattgttgaattttgtcgaaaagaaaaataaaataattaaaacgattaaaaatctttttttgtacaaaaattaaattattgaaagcagcttcataaacctttttaataaattaattataattttattttatttactcgctttgttcacccaccaataaattgcggttctctcgcgctgttcgctttaatttcatcccaaaaatgttttttggtttgcgcgtcaatgcgaatgatttgaaaaggaaatattctgtaaattaaattaaattctttaaaaaagtcattaatagcaaatcacaaaattaaaaacggaagaaaaatattttacccattttcgttggtgccgcctctttgtgccgatataatttgaaaagcggacaaaagttgttccaattgccacccgcccgacatccataataatgcgagaaataattctcataacta

SEQ ID NO: 33290 - DNA, 866 bp, Heterodera glycines
  misc_feature (30)..(30): n is a, c, g, or t
tattaaatttttgggtgggtggtcggcacnaggacggatggcgtgtacacggagcaaatggtggaggacaaatctttggttggaactgtgaaatatgacggggcgaagcagtgcttttacgacaggtgaagcagaaaaaaggccggacggtggtgcaaaaggtggtggaccaattgaattggccacttcctgcgttttagcagatgatttaccctaaaaaagcgcaaattaccgtttttaaaaatcaatgaccggaaattcctttttttggcaaaattgggtaaaaggttttcacattgaaaagtgccaattttttaactctttcaaaacatcgtcggaagagtttttgtttttttcatccccaatcatagtaaacattctaggtactgttcaaaagtgcttgacaaacattaatttacaaaaaatttaaacgaacaaaatgttaaggtctaaaagcgtcattttgggtgcgcccccattctctttttgatgtttatgtgttccacaatcacattcagtttattggtgccgaccaatttggtgggaatgatacgcggacgaaatagcagcaacatgaagccaattcaagaggaaaatcggtgtcaaattgaatttccgaaaacaccaaaagcgtctggtacggaaactgaaatcagtgagttgggacgggaaaagaaaaatcagccagccaatttttgaatgaatgacaatacattatggatttttgtgccaatgtttttttcattggtctttcccccaatagagttttcctccggcgaaagtgccctccatgtgcagaagtgtggcgaagcgttgaaaaaagaattggcaaaagcgaggaataaggcggcgccgacgcatttcag

SEQ ID NO: 33291 - DNA, 683 bp, Heterodera glycines
tgctttttcattttttaatgccttagaaattttaaatttatgaaaagcattttctcaattcatttttgaatatttatttattattttaagttttattaaattagaaaaaataattttattttaataaaagaaatattaaaattttaatttttttaaaaataaaataatgcaccgtaaggacagagaaattcactgagctcataaatcggtgacattttcatcaaaaattgacattgtaagctccgccgatggggttaaagtcggacccatttcttcttccgacatccaatcacaatgtgtaaatgtgaaataggccccggagggggcaaattcctccccgtgtcagtgtcatgtccacttttgtcttatttcacccgtcaaaaaagcgctattggcaagaaaaataaatttttggcgacattaaaaaaaaagaatttttaatccactaagatttgtttattatttagcctgccaaattacaaaatttcgttaaatttcaaagttttggccaacaaattttgaaacttggtttttgggtttctatagtttttttttgaaattttaatatattttttaaattttacatggtaatagagaacacttaggctatctgcaaaacaaaaaatttttatttctatcctatatgcccgtcaaacccaggacaggttcattatcctaaaccg

SEQ ID NO: 33292 - DNA, 905 bp, Heterodera glycines
gcgcagaatatctggagagacttagtgttagcgcatcaattatttttttcagaatgtgatgggtacaaaaaatacgggtccaaaaatgggtgtaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgccctcgcgttggagaaaacaatgcgcagaataactggggagacttagggttagcgcatcaattatttttttcagaatgtgatgggtacaaaaaatacgggtccaaaaatgggtgcaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgccctcgcgttggagaaagcaatgcgcagaataactggggagacttagggttagcg

SEQ ID NO: 33293 - DNA, 774 bp, Heterodera glycines
ttttaacaaattaaataacgaatggttcttattgtcctccaatttcaatgcttttatttttattttaattattatttttagtcctcaccttaatgattttgtcataaaatggagaagattgcagataatttgaatcgtttgtataaccttcttcgatctctctttcatttttgaacattattttcaatttttcgtcaaatctcttgcgaatagcattcaaattgccaaagtttgctttataattgcttaatttgtcctcatttagcaaatttaattgataaaagtagtatttatttgtaagtctttcagaaagttccattgaaatatggttaaaaatgcgcacgacttcaattagttttgttgcatttgaaattgttcgagttgaaacatatggaagaaaccatggcttgacaatgggcatttcttttgccaatttcgggttttcagctttaaaattgaaaaaaaattgtatatagagaaaaattccaagcaaaaaaataataatattaatttttatttactataacagaatggtaattaataaaatcaattccctactttttgcgtatactgtgaacaaatactcatacaaaatgttcaaataattgccaactttttcacataatttccgctcctcatttcttgccgcaacaattttggcacaattccaattctttttcattaaatacaaaaggccaagaactatttcatatcttcttggcaacgtgaagtctaagactgtattgatccgtcgcacttcgtcatcattcttca

SEQ ID NO: 33294 - DNA, 60 bp, Heterodera glycines
ggcgtccagcacgccttcgaacagcgaggtgttcggggtgtggccgatggcgatgaacac

SEQ ID NO: 33295 - DNA, 305 bp, Heterodera glycines
aaattttatcttccgttgcttaattctgcatgcatggtaatgtccttaattatgcacttttctacctaaaaatgacaagttggcgcacataataaaaattgtatcttccactccttaataatttacgaattgaaccttctttctcttaattctggatttttctacctaaaactgacattcccaattgcttaataatttacaaattgagtcttccattgattaactatgcatgaattttaattaaaaacgtaaataaaatgaccaaattacacaatttcgaggtataaaatagagaaaataaagtg

SEQ ID NO: 33296 - DNA, 868 bp, Heterodera glycines
  misc_feature (750)..(750): n is a, c, g, or t
ttagtccattaattgtcctctacgaattaatgtgtctgaaaatgaaccgttttcactttttgtcgaccaatttaaaggcactgaaagagacaatttaatggtatgaatttatttttatcccaattttattttttcgaatatttagttctttaacattgatgagcaaagaacgaacaatggacgcttaattggaaggcaattctttaattttaattattattatctaattattaattattattttataatttagcggtcaaatgtttcgttctcattcacatagcgttttgctgaacattttgctcaattacacttcaagcatcgaagcaaaaattgcatattcgcttggttttatttatgaaatttatattaaattaaatattttttgccattttttgctgtttcggccatttcgaattgtttagtgccaattttcttttatatttttagactgccgaaagccgttcctttggcattctgttttcccacaaaaaatattgccaaattcgactttggatggtcatcattttccttttcgttaccgttttccatccgtgccatgccccgtgggcaacaaaagtgccgaattaatttgtgtcgatggaggaaaatggcgagccatcggatgccaagaagaaggagatgagaatgaaaattatggtaaaaccgtaaaacattaataatcattaatttgttattacattagcaaaaattttaatcttcgcacatttaaaaaataataatatttanattaaaaaataattctaatcactttttttgacggaatgccttctcgcccgtgtgttgtgccccgcatcagaaatggcctcgtgctcgatttgaatcgtaagcttggcattttgcgctt

SEQ ID NO: 33297 - DNA, 307 bp, Heterodera glycines
tttttcagtcgatttttaggtgtgtatttttcgtttttaagtcgatttttagggggtgtatttttcgtttttttgaaatcccgaattatggggtgtattttacaaaatttttcgccaaaaaattaatattttttgccattttggcctccatttttcaaaaatatggtaaaatgggggtccggcggtgccgataggcgccgctgggaaaatttttgagtattttaatgcaattttgttaagaaaattgcttaaaatttcaaaaaaaatttactgaaaatttttatttttttgggtttcgggggggggg

SEQ ID NO: 33298 - DNA, 418 bp, Heterodera glycines
taaaaaatgctaccaaaaactcacaattttcaattttctttttccggcacctatcggcaccgtcagtccgcaaaattgtgcttaaaaaattttgactaaaatttccaaagtgctgattttgaccccaaatgatgattcttgttggctaaatgctggttttgaaaattttcagttagcagccctgtttttaaagccgtttttttaatcttatttttggggccaaaatcttcgttttaacctcgttttgtccttagtttatattttgatcaaataaattgtaaaaatttactgatttgaaaaaatgttgctaatattattatttttgaccctaaaatcttatttttcggccttggtgttcatattttgaaaaattactgatcggaaccatggttttgtggggccggcgggtgccgatagg

SEQ ID NO: 33299 - DNA, 586 bp, Heterodera glycines
  misc_feature (23)..(23): n is a, c, g, or t
tggtcatttttaagtaaaatttntggattagataccatttgcttttcgtttcccatgtttaggcatttctccgtgccaccatttcttcggccggctaccggaccggctcagttcggccccgcacggttcggccccagcccagttttcgatctataacttttttctttgtcaactgacggaaatgtgcatgtagaatacgaatggaaagagcgatgggtaatgaaacgatgccaaattggggcgatgattcaatgggaggacaaaaagacggataatttgaacaatgtcgactttacgttgaatgaatttggatgattggaaacaccattttcttttgtttaaagtaatttaaaaaacttaattcaggccattgtctccaccagagacgggtcaaatgaacgcaaaaagtcgtatgaaaatgaatcccgggcccagcggacagcggaagaaaaagtgaaggaattagtgataaatgagaaattctgatcaataattatggatgtaaattgatctgttgattgcatttcacatttatttgttgcttctttcgtttgaatacatttatgtaagtgattgtttggatttt

SEQ ID NO: 33300 - DNA, 943 bp, Heterodera glycines
ccatatatttgatcaattgttttacttttttatatttttcatcatccgtataataatgctttttgatcattccaaattctgttttccattcgtaaattttcttttgatttgtacccaatttttttgcaatttttcgttcaattttttgccattctttcgttgaatatttcttttccatttgcttaactttctccttaattttctgaaacttttcaacaatttctcttttctttttatcaattgcttttgaaaaatcctcacaaatttgtccaatatttgttgacattggcaattggccgcccaattcatcacaatctgtggacatttcttcactctgctcttctttcacttccaaactttcatcaacaatttgatcaatatgttgatcattttgtccaaattggttattctgatcagcattttcttcataaattattggaccaattcgatacatattttcttcagttctttcgtcccatctttggccaaatatttcagcaaaacttttttcttgatttattttgccagcctcaatttggttaattgtattttcgaatattaatgcgcataataatattaataatattttcatgattttttataaaaatttaatgaattatttttattaaaaaaaatattttacgcaatgaattttgtaattattaattttatagcctggctaaattattcaatcaattcttaacaattttaatcattatatgatcaataagatacaccatttttttatataattcatttattatattttcattttctcagcgaattggggagcaataaatatgagctaacaataattattgttgggccccaaatgtcagggtcctcaatataaatattggcctctaaaattgggttagttcttgaaaagaaaaataaaatttttgaaatttatcatcaaaagaaattcattgaaatattaaaa

SEQ ID NO: 33301 - DNA, 724 bp, Heterodera glycines
aaagggaccgaatgccgaatgttcttacggtaatggcgataccgtaggcattggcctcaattcggccactcgacagatcattttcaccaaaaatggacttcgtttgggttggtaattaattaattattatttttttcataaacttttcacagattcctccgatttgttcattcctcaatcttttgctggtggccctgtgttctttccatttgtttctttatgggaatcgggtgacaaaatcgaggcgaactttggacccaatttcaaattcgatttgaccaccttttaaaggaagaaacaaaggttctagtcggttttacgcgtcccaaaaacggtaatacttgagaatctgggctccactcaaaaaaaaaaaattttttctgttatgaaaaggccaacctgggggtttaggggcctctgatcacgaatatgaatcagatttgcaaaaatcattggtcctatccttgtttttgaaaatcatagagatcaaatgtttcataggcaactcgaacaattgcttagactaggcctaagctttaggcttatgcctagacttaggcctaagcttaaggtttttttggaaattttttattgccacatttcagtatattttaggggtactttttgcaatttccgatatcacaaatatacaaacaacaaacaattgggacgaccttaaatgcttaaagtttcccaatggacggtccaaaaaaccccttttttt

SEQ ID NO: 33302 - DNA, 754 bp, Heterodera glycines
  misc_feature (665)..(665): n is a, c, g, or t
tgaatcaaccaaaaaccaacgatgaatttagtcaaggagattctgtccaaattggccaaatttataaagaaatttttggcaaaattctcaaatattttcagccaaattttgttgaatttatgaaagaccgaccggatttgcttcacaaatggcacacaatggagaactttatgaaagaatgcattaagcaatttgaagaaaattaaattcgtggcatttcggcaaatttgaaattgtcattttaggtttggcttttaaaacaaaattttgggaaaatttttatatgttgcacaactgaattttttttttattgtaatttgaaattttgagactctttatgtaacagattttaatttggataaattcattggattaagtaataaattattttattaaagctcttcaaaagctctatttgttattaaaaaattaataaattgatgcatccaacaaaaaaaaaacaaattttaaatcatgtgaaaaagaagtttttattctttttttttgttacaaaaccctgccattttcgaaatcttactcggggcgctgacatttttttcaaaatgattaagtaatattaatttttttgaagatttttattctttattttctcttaaaattttcaaaaaatttttaataaattttcgcttttttaaatttattgnaaataattaaaatttgtttttttcatttctttcacaaatttttttttttttttgctattatcctcccatattaatcatcataattatca

SEQ ID NO: 33303 - DNA, 989 bp, Heterodera glycines
ccccgaaaacaaaaaaatcgattttttcaagtgtccgttttggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaaga

SEQ ID NO: 33304 - DNA, 171 bp, Heterodera glycines
acaaatttggtatcatttgaaagctcttgatgtgccaagtctaaaaacaaggtatatattcgaaccgatgccatctaaacacagggacaactgagtcccagtgaaaatcgacacttcagtaccaaaaaaagacggtacgaaataacaattaaaggcaacaaaaacgcaaaa

SEQ ID NO: 33305 - DNA, 1164 bp, Heterodera glycines
tagggttataatttatatgattttgcatatttttcctgcgtgtatgccatatgaagaaaggggctcaaaaatagcatttctacattaaaatttttttgatttgctgcaggtttttagtgcatataaatccatattttgggggttttcgagaataaatgcatattttgccattttgcatttttacagcatatttcggccattttttggaaattttcgtaagaaaaatggaaaaaaaagcgaaaaatacactcctaaggatggactttttaagaatttttataaaaaataactttttggcatttttttgagggttaaaaaccatttttggcagtttttaaggcgtattttagtgcatatttaggcatttttcgggtttttagggcatatttgagggatttttagtgcatattttatgcgcatatttgccattttttagtgcatacaatttataaccctagtcattatcggccacacagaaatcactattttggcacttcgtcactaaaataatgaaaattcattattttagcattttgtcactatttttttcactattttgatattttttggaaaatttctcaacaaaaatgcaatgaaaactaaaattactctctaagaattgacttaaaaaatttcagaaaaattacccctaaaaatcgacccaaaaattttcaaaaatatactcctatgaaattaaaaaacttcattggtaaaaatttttaattttaaaaattattttttagctaactattttgggttttttgctcttaaaactcccagtcctactcatttgcaactgcaactagtgaataaaaattatttttgctcaatttttggctaaaaatgatgtcactcttcgtcactatttcgcactttttgccactattttggcatttttactcactattttagttaattattttgagatttttcgtcacgaaaagtcgcggccctaattattacctttttttgcataaatttcaaagaaatattcgtaaataatgtgcacataattcttatatttttcacagcactttccatcgtaaaatgagcggtgtttatattgtttggtgattttcttacaattccaattttctttcatcaaaaaaataacgccaaaatacgcctcgagcattttcttattgtgttgatcaacagcagaag

SEQ ID NO: 33306 - DNA, 814 bp, Heterodera glycines
gcccatttctccctcttctcctctccatcttccctgatctcttcccctctccatcttcctctctccatctttctcttccctcttccctcttccctcttcctcgcccatttctctctcttcccctctccatcttcctctctccatctttctcttccctcttcctcgcccatttctctctctttccctctccatctttctcttccctcttcctcgcccatttctctctctttccctctccatctttctcttccctcttcctcgcccatttctctctctttccctctccatctttctcttccctcttcctcgcccatttctctctctttccctctccatctttctcttccctcttccctcttcctcgcccatttctctctctttccctctccatctttctcttccctcttccctcttcctcgcccatttctctctctttccctctccatctttctcttccctcttccctcttcctcgcccatttctctctctttccctctccatctttctctcttcacctttctcttccctcttcctgggacatttctgtcccttccgctctccagcgtcgtcactccacccttctcttcgctctttgccgcacacttatgtgtaggcaaaacaaaatggtgccgcggcattttatgaaggtcgcgcggaaattcccccaaggtcccttttcaaatgttggcacagaacaaatgtgataaaacaaaaattggactaattttaaagctctttactaatatctcttaatcaattaaagattcgctgaattcttatttgcgcaaaaaaacaaaagcaactagcaattcct

SEQ ID NO: 33307 - DNA, 83 bp, Heterodera glycines
gctgtcctatggtttgcccgtcgatctgctcgcggcgttgagcgatggctgcaatgtcatcgccaatggctcgcgcaaaatga

SEQ ID NO: 33308 - DNA, 1506 bp, Heterodera glycines
  misc_feature (8)..(8): n is a, c, g, or t
  misc_feature (25)..(25): n is a, c, g, or t
agaagaanatttggagaagaaattnttgaaggatcaaaaacatagaaatctatgaaaaaaaggatacatttctaagaaaataattatttacgatagaaaaaccaattaatttcttatatttttattaaatcattgtcatgataactggcataaaatccgtttattttttcaattggattcgatgaatttgtttcgctttaaccacttttattaaatattaaaaaaaaatttatttatcaaatacaaatacaatatttttgaaaatttatataacaaatctattttttagagcgcagataattttttaaataaatttatccaaattttcgtaaatttttccgttttttcaatccttcaaaatttcttcgccaaaatgtttcttccattctgaaattctctgttgatgaattttcaaaatttttccaatttccgtgtcctcatttttggattttctttttttatttgccaatacattttcattttttccattttttcttttttgataatacttttcttgtgtatgccattgccaaattgtttcttccatttctcaattattctttgactaactccaattttcttacaaatttcgttataattttggttccattctttttttgaaaattttctttattttcgcattgattttactccattcttttgctgaatatttcttcctttttccttgattttctcttttattttataaaattttccaattatttctcttttttcttcttctttttcttcccatttttctccaaatatttcgtcaaatgacttttgttgcaattttttcctttctgaaaaaatgaaattttagcgacgaaaattacccaaaatagccttttgaaaattcctattaaaaatttctgatttcggttatggaaacccacaggtgttcaaagcattcaaatattcaagtttctattattttcgtgaacagcaacatttttctgcgcaaaatttcatttttggccattttacaccaattttctgaaataatgaaatttcataaaatctctttaatttttctaaaatctctttacattgtgaatttattttatttttattgaaaatatgtttattattttcgaatgagctccagtagaaagtaataaaattttatttaatcattaatttaccaattggcaattatttggtcaataggataaaattattattattatttctttgcaattaaacaggatttccttattttattaagtaaaataatgatttattcagttttttaatcagaaaaaaatcatttaaatgcctcaaaaaatgaattgccatttaattgaagaaaaaataaaatcattttaagacgacaaaataattaaatgcattaaataaatgctagaaaattttgaaaaattatccaacataaatatatataaagttaacatttgattaaatagaattctaaatttataaattttaatttttaattattatttaaaaataagcgcttgaaatttaaaaatcatgaaaacaaggacg

SEQ ID NO: 33309 - DNA, 903 bp, Heterodera glycines
  misc_feature (18)..(18): n is a, c, g, or t
cgacggaggtgtacaccncttcggccaagtgcgacgagtacatggactatccctacaaaaattcataaattttctgtaatttcacaaaataatacgtgtacaaaaagctaccaagtagacactcgaaaaatgatggcatcgagctctctctctctttccccgttcactttctttctctgcgctctctctctctctctctttccccgttcactttctttctctgcgctctctctctctctctttccccgttcactttctttctctgcgctctctctctctctctttccccgttcactttctttctctgctttctctctctctctctctttccccgttcactttctttctctgctttctctctctctctctctctgctgggttagccgagcagagattttgccagccattttttaatttaatcgatattatctgaatgcattttttaaatgctaattttttcagttggcccaaaaagcgtacgacgactttgaccaattgtataaaaatgcgttttccttgcgcacattggaacaattggagcatgtaagcttttgccctcaatcaatttccttgtcgcttttggatcatgtgacttttcctatttttttgtagaattttgcccaatcgctttttgaacgggacggacaacggcacgccaaactcaaagggtggctggacgggctgcaatgttttgtcgcacggattaggacaattttccaaaaaactgtctcctactacacactgttcgacattgtggccggacgaaggtgttgtttgttgctatggggataagaaattttggcaaaaattgaatttttaatactttttttcagcgatttgccggcactgattgagggcgagtcgatgccgttggcactgttcacatccgccaaatattctgac

SEQ ID NO: 33310 - DNA, 903 bp, Heterodera glycines
  misc_feature (884)..(884): n is a, c, g, or t
ataaataattattaaaataattgaaagccatgatttttcatagcaattttacctttggttagttaatgacgaaaaactccgaataacaaattaaaaaagataggctaccaccatattttaataaaacatcaatttgattaattttgagcaaaatttcaaaaaaattttcaactttaatgcctattcatttaaactctaaaaaatgattcattacatcggcatcatattcgaggatgtcccatgcaataattatttcggtttcgggagttaacgaagggctgtaggacattgtgaaattttaataaaaatttgaacggaaattcaaataaaacatgaaaaatggattcaataatgattaatgatgggtgacccacctttaaacaacctgtccctttgatgtaccgaccgattgcgcctgcttaatcaaattaaacattcataaagttgaaatcgcgcgattcaaattcaaaattttgcaaaaaacattatcgctactattaccctaattacctattcacatacaatggtaaagcggtaacgggattcccgcgtcaaaacttgggattcttgttcccgttccctgtcataggcataaaaatcatcaaaattaaccatttttaacgcgaaatttgttaataaattcaggcataaatcagccaattttaccgccagaccaatctttttagtttgttaaaacgttaaaaaatgacatacaaaatgccaaatgtatcgtcaaaatttggacattttatatgaatatttatttccagttatatgctgaaggtttgtaaaattttactttatttgaaatttttttcattattaaaataatattaactagggattcccattttagtcacaagaaatcgcgaattatgcattanatagacgccaaaaattgaa

SEQ ID NO: 33311 - DNA, 999 bp, Heterodera glycines
cctggggttcagagtcaagcaaccctgggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcagtacaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgaattagtcttagatgaagttaccacctgatttgggctgcgatcccaacaacc

SEQ ID NO: 33312 - DNA, 873 bp, Heterodera glycines
tcagttcatttaaataatttttatccaaaaaattttttttcgtgttttcggggcagtccccctgaaccgatgcgcccagatttatcggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgagtctcctattattttatttttttttcaaattttgaaggggggggggggggggg

SEQ ID NO: 33313 - DNA, 1589 bp, Heterodera glycines
  misc_feature (1385)..(1385): n is a, c, g, or t
  misc_feature (1410)..(1410): n is a, c, g, or t
  misc_feature (1463)..(1463): n is a, c, g, or t
  misc_feature (1521)..(1521): n is a, c, g, or t
aacaaatcgcacttaaaaattacaaatttttcgcaggctttgaaaattaaattaaattttcgtaaacaattttcgaggggggcgcgacgaactgtgccctgatttataggaattttttggtagccggcgcccacccaaaaaaaggaatgttttgtctcttttattgcactgttttgtgcaggcgaatgcgtgtgtccgatcactgatcagacgaccatttatctgcgcctttgccccgcctttctgtgccgtgagccgcccccgcatccgttgtccccgttccttgtgccgatctttacgcgtttgccaccaccgatcacccgggcggcactcaaccgcatggacgtactttcgcaaaaagttatataaacggggaaatcgaaaataattttaatattttttaattaataaagatttgccccgaaattgacggcgtccgctgcatcaaagacattgcgtgtgctgtccaaattgacagtaaatgaacattattactttttatatatttttattttgattcggctttgttattttattttggttttaatgaattaattattttttaattataataactttcttttcataactattgtatatttatttattgataaaatcccttccaaaaaatttttttttttaattaattatttaagaaaatttaaaaaataaatagtttttatttaaaaaaaactaattagtcgattaattaattgctaatcacatcttcaccaatttagctgatctcgtcggccgttgtgttcgcaatctgtgcttccacggctgtgttgcgttgttgccccaatttttgtactccaactgttacgtgcccactgaacgtcttcgccacttctttgacagtccccacattgtggaggtgggttcaaatcaatattttcgaaaaaaacagaaaaattctaccagaaaattgcttgcgtctctttaaacttcattaattcaattaattatttttgccagaaatgcctcgactttgtgcgcttacgccccttttctgaggacccgtcgccggtgcttttcgatgacgtcgctcgcctttatttgggccttaaagtgtgattgattatacatttttgcaaatcaatttacaaaatgcctccacgaattttaatcaaaattttggttttttaaatacgggaggtggtgggaggtgaacctaccaaaaaaagaagggccatgtcaaaaaagcgactaaacatgagaggaccccatccccgctcagttcgaaaaaatcggctgtgaaaagtgcatttcttcgctctcgtcacgaattttattaaagttcggtgctgtcgtgatcacccccgtgaaaatttttaataatttcggcgatttttgttgatttttttctcttgaaattgtcattntgttgtttcattctcgactctcggncttctcgagagtctgatcagctgacaaaaaattaaaatcgtcgtctacattanattctcctcccccctccagaccggctccccgctcagcgaatggctgctccgaatgcgntcccggcagctgcacgtggacgagcgcaagctgatccaattcggcctctttctacgcattctgcgcaa

SEQ ID NO: 33314 - DNA, 693 bp, Heterodera glycines
accggggcacctctagagctaagccaaataagaaggaacacgagcaggaggaggacccctaggagaaggagacgtactatcaagtaccaaaagtcaagcctttgaagacgaagctgaaccaacagtcaggagaaggaaagagacaccgaaacaccgccccacccggagaaggaacggaacccggtaaagccaaatgacggagagaaggagcaggaagacgactccgaaaagccaattgagccaagaaagaaaccagcggaaggacccgaacagcaaacgcctgtgttttctttaggaaaagccggacgaatttgaggagccatcgaatggggagaagaagccaaaggggggagcggaagaccaagctgacccaaagaagaagccggacggagtggaagaggagccaaagtcggagaataagccaaatgaagcggtgtcgaaggaagaggaaaaccaggcggaggagcccaaaaaggcaccagagctaaagacagcggaaaactcggaaaagccaccggtgtcacaggaaaaggcaccgccaaatggcacagccgaagatgatgtacaagttggcaagcaaggggaggaacaccaaaaacaagagcaaatgcaacaggcaggtgaccaacagccccaatcagacgaagtggcgcccgcgcgtgggaaccgacgccgacgaggtgcaaaagtcag

SEQ ID NO: 33315 - DNA, 873 bp, Heterodera glycines
cgcacgcagtcaaatgctgtcactgtggcatcaactttttgtgtgatgcaagagtgccacgactggatttggacgcagccactgatcaatggacatcctgtcaaacttgcggctgactcgtgctcgcatctgacaattattcaggagccactttggataagtttggggagtccaaaattgagaaaacaaggtaaaaaggttggcagtttttccggtcacaaattgagtttgttgggcgaattcgattgtttggtgcaatttaaaggtgttgatttaaagcttaaatgttcagttgcgaacaccgatgctccaaacatcatgggactagattggatcgtgccgtttgagcaggccacacagtctccaatcgcgaccacattggatttgtcaattgccacaacaaaagtcaacgcaattgaaccgaccgatgaaccaacaaatttggctgaacaaatgaaaaattcttttccacaggtttttcggccaggtttgggcgtgtgcacgaagatggaagcaacgcttcatttgaaacctggtgctcagcccgttttttgtcgagctaggccagttccgcatggagtttcggaggccgtcaacagcgaattggaccgtcttgttgaaattggagcgatccaccccgtcgatttttcgcgttgggcggcacctgtcctcgctgtgcgtaaaaagtctggtgaaattcgtgtttgcgtcgacttcacgaccggactaaatgatgcgttggaactcaaccgtcatccattgccacgaaccgacgacattttccatgcacttcgtgggtcaaaagttttctcacaacttgatctgcgcgatgcatatctccaattggaattggatgaaaagtcaaatcgttag

SEQ ID NO: 33316 - DNA, 1050 bp, Heterodera glycines
gaaaaggaaaaattcgaaccaaggaggggggaaagaggaggaaaaggatgaaaataacatcggggaaggaggagagacggaggagaaagagagaaaaaggaaaaattcgaagcaaggagggggagaaagaagaggaaaaggatgaaaatatcatcggggaaggaggagagacggaagagaaagagagaaaaaggaaaaattcgaagcaaggagggggagaaagaagaggaaaaggatgaaaatagcagtggggaaggaggagagacggaagagaaagagaggaaaaggaaaaattcgacggaagaaggagggggagaaagaggaggaaaaggatgaaaatagcagtggggaaggaggagagacggaagagaaagagaggaaaaggaaaaattcgaagcaaggagggggagaaagaggaggaaaaggatgaaaatagcattggggaaggaggagagacggaagagaaagagaggaaaaggaaaaattcgaagcaaggagggggagaaagaagaggaaaaggatgaaaatagcagtggggaaggaggagagacggaagagaaagagaggaaaaggaaaaattcgaagcaaggagggggaaaagaggaggaaaaggatgaaaatagcattggggaaggaggagagacggaagagaaagagagaaaaaggaaaaattcgaagcaaggagggggagaaagaagaggaaaaggatgaaaatagcagtggggaaggaggagagacggaagagaaagagaggaaaaggaaaaattcgacggaagaaggagggggagaaagaggaggaaaaggatgaaaatagcattggggaaggaggagagacggaagagaaagagagaaaaaggaaaaattcgaagcaaggagggggagaaagaagaggaaaaggatgaaaatagcagtggggaaggaggagagacggaagagaaagagaggaaaaggaaaaattcgacggaagaaggagggggagaaagaggaggaaaaggatgaaaatagcattggggaaggaggagagacggaagagaaagagagaaaaaggaa

SEQ ID NO: 33317 - DNA, 954 bp, Heterodera glycines
  misc_feature (895)..(895): n is a, c, g, or t
ctcgaataaaaatcggaattttgaatttttcaaattatgattttttgttcaaatttagattaggaaatcggaattgatcaaaataattgaaggattcgtgatcggggaccccaaaaaccccagagaataaatttttatgactatcacaaaaaaaactttgcaaaacaaaagggtccccccttttgaaaaaattttcaaaaagggccacttttaatatagcgcctataactgttaactatgtagggattttttgtcactaaaattcacagccctagtcattaggagccacattgtaagacggatgtcgtatcatttcccttcaagctcttggaattccatttgatcaattgtacgatgggtatggccaaaagtacatcaagcaaccaggtttacaaacattggccataacttttttgaaactcaacgaaattttttgaaattttgcagattattagaaaacacttgtgttagggctatcgaatgatatcaaaaattaaaattttagaaggtgcgtaaaatgccgtttttctcgactgggttccatatttaaacaatcaatgtctttgatcataataatctttttctgattcaaagtgcattttcgatagagaaaagaaagggcttcaaaatgatatacaaaaatcaatcaatcggtaagatatttaatacgtttagagctttccaacaaaaacgaatggatttatgttaacaattcattggacaattacccgaaatcgacaatgacaagttgaaaataagtgagggggggggggacaattaacgaaggcccgcgtgatggcattggagcattgtctgaatggcattttggcagatcaaatgctgaatgccgagcagtccgaagccggaagaagggttacagaatacttcgcattgngcaccagtccgtttaacaatctcgtgatgccgacagcactgaacgttgttctgtccctg

SEQ ID NO: 33318 - DNA, 649 bp, Heterodera glycines
attttatttaaattttgaatattcaaaaaaaacatcgcttcaaaaaattttctttataaaaattttacaaccaaaaaatgcgcggcacgccgcgcaaaaaaaaatcccgcggccgcgcaccgcgcattcaaattgccgcggtcgcgaccgcggatcgcgcaaaaaaaaatgccgcgaatcgcggatcgcggtcgcgctccagccctgttgcaaatgtgcgggcgaaaaaaaacacttgatttttccaatttgagaacatgcatattcgcacttattttggcttttttttttttggtttttagcatattcaacctttttagcacatattttattaccaaattaaactatgactccacccaaaaagaaatagttttttgaaaaaatttgatagaaacttgaattattgaaacgtgggacagaggtaaaatccctcgaatccccagtctccgtttgacctgctgaagatatttcatccaaatcatccgtatcgtaattctgagcatcattttccatccaagcagctctcacagaatcactaagcagtgcacacacaaaaatattttccacatagctaagaaattaaaattgaattttttgcatcaaatatgatttttgagatcattttttaactcatcatgcattttatttg

SEQ ID NO: 33319 - DNA, 926 bp, Heterodera glycines
acaacctaacttaaaatcacaaaaatttgaaaacgtaatggttgagtattttatttaatcaattttttaggaaatttttttttaaataatttaaaaaaacattaaagaatagtaaattatataatttgcaaataattattatacatttattaatgagaaaaggcggacgacccaaacgcgcctgtaagtatcgaaccgaacatggaaataaaattaaataatagtttaaataattataacaattttattgataaataataaaattaatgaaaagtttcatagattttcaatgaaagtaaaaaagaaattaacaaaaattatttttttatattaatcttcataaatagatcatcttaaaaaataaattaaaattatatatgtatataattaaatagaaaatggttctaattttgaataaactcctacctaatcaataattaatttcatctcagatctaaataattagaaaaaaaattaaatagtaaaatctgttttttaagttaaataaattcacatttatggtgccaagcgctgcgattgattttggtaaaaatgaatatgtaattcaaattgtataatttccaacacattaagtgataaaaaaatgaccaaatgttttgttttttaattatgtctgtaaatattgaaaataatcaataaactgatgccaattaaaaatattaagtactataaatgaaaattaaagtttaaattgaacaaccaaagaaagtaaattaaacattaagaagaaaattaatacgaaagttatcgaaataatcgatgtcatattttaaatagttttaataaagagaagtgaagttaaaacgataatatttttatgatttaattgtatttgaaatagtgttaaaatgtttttttttctttaaaaatttcaataaaataatccaaatttatttttttaattt

SEQ ID NO: 33320 - DNA, 984 bp, Heterodera glycines
ttaatgttggacgatgccagcacaaatacttatattttcgctaaaggaagctaattcgatgaatttgccgcttactccaaatttagtcgaaattggtgtatttaacaaccccaaaagcaaaccactcacatccttccaaactaaatttggcattgagttaattaatggacagacaattattgtaacggctaacaccgttgaccatttaacccaacctacaccatatataccgttttctcccgaactactcactgatgccgatttagtatttcttgattccacggtacgccctattattcttttgggttctgattattattatgaagttgaaccgacccccgtctcccgccttccctccggttatcatttaatccaaacacttttgggtcccattgtagctgggaaacattttggaactgccatccctccccctctccttcaacaatccaatttttgcgttcaatctccaaatccgtccatccccgcagattactttactctagaaggtattggtataaaggaccaacccgatgataccagtgtaaacgatgccatcatttcccaatttaattcggacatccaatttatcagtaatcgataccaagtcaaattaccctttcgcgcgaatccttcaactctctcactaccttccaattttggattatgttatggacgattacgtaatgtattgaattccttatccaaaaacccttcccaacttaaacaatataacgaaataattaccgagcaagtgaagctcggaattatcgagtcagttccctccccatattctttttcaagtcctttacattatttggctcatcatcccgtaattcacccttcgaaacaaaaatacggattgtatatgatggctctgctcactgtgggaaggccccatcattaaatgattgtctttatcccggaccctcaattcttctgatttaataggactgcttatccgtttccgcctccccaaaattgcta

SEQ ID NO: 33321 - DNA, 1032 bp, Heterodera glycines
ctgactcttatattatcaaaaagggagatgaataaatactttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatgtttggatttttttttggcttaacaaaacttcatcgaacctggttctttctattctctttcaaatcgccccaaattttttttacagcttaactaggcccaattaagaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgcccaaattttttttacagcttaactaggccctattaagcttcagaaaatctcgcatgaattctcatttttaaattttttatagatttttaaatatttggattttttttggcttaccaaaacttcatcgaaactggttctttctattctctttcaaatcgccccaaatttttttacagcttaactaggccctattaagctaatttcagaaaatctcgcatgaatctcatttttaatttttt

SEQ ID NO: 33322 - DNA, 807 bp, Heterodera glycines
ccaccgtagtgattccgaagttttgccaccatctggaggtgccggattgtgtcgaatatcaattttagtctccgcatttcagcgcttcagcaatctattcccattgatgtgcataagaatgtgccgcccagtgatttgcataaccgtgtgccgactgtggtgccgactgtgccagtcatagaccgatcgaagaagccgttaaatggatgtaacgtccgtgatcagcaaccccgaagacccccacccccgcaaaggtgattttttccgactaataaaaaaacgaaaagcacagttacctatgatttacaacctttggtgtttaataatgcctctttaggactgacgatggcaccggcaattactttttaagtgcgtattcaatgtctgcgcagagaattggcaatgattcggagtggaagaaaacggtgcgttaacttggcgggggacgcgacaaaatatcaccgcagaatttaaaaattttttaaacagaaatttttaaagaaaaaattcttagaaaattttttatagaaaaaaattaaattaaaattgaaaaattttatgcgattttttttgaaatttaattgtttttttcaaaaaaattttttcaatgcattttttcttgaaattttcttataaaaaatttctgcgcgatattttggggtgcacccaacttggcgaacgtttcttttcacattttagccgcttggtcggaccggtctcttcaacatggggaacacgtgctttatgaatgctactcttcacccgctgttccatacgcccggattttctcaactgttccaacaaaaa

SEQ ID NO: 33323 - DNA, 893 bp, Heterodera glycines
ccacagcatacgccgatgccaccgccgccggtcagcagtggaggggtgttctacggacagaatccgttcagtcgtcagaatcgttagaaagtgataaatagaaaaggagggagataatcgagagaaggaaaggaataaagtgcatcgaatggcgattaaattatttaatttgtttgttctttttgcgttgactcgtccgataaatgtgatccttttgtaacttatccaaaccaataaatcgttgaagattatgaaaaaattacttgtaatcctgtcattttatgagaccaataaagtgttgagaatgaaaaatcatccattatttcttgcttttattgatcgaattaaatcaaattgaaggatttaaaaatgtaagcaactgaaaaataatttgtttagaattagcagttagtacactatttgtcacaccacctcccttttgtgttcgttttttctcccttctctgttaatcaatcactgtctctaatttccctcactgtctcaaactccgccttctttccttttctgcctatgatatttcctcgtcccattcaaagtttgtgcacaatacgcaatgtgaaaatgaatggtcaaaaccaaaatcgaacgaacagcacaaaaatgacaaaggctgatgggtccgaagaactcaacggaattgacaggaacggaacggaccattcggaatttggtgggtcatttaaaaagtaaacatttgattggtgtgctcccctcacccctttaggttctgatgccggattctccgcggccgaccgggcaaagtctgccgcggcacgcgcgtgtggtgaggcggaagtgtgcagcggaatgaaactgggcgttggcagtgggacgacgatgaaattttttcatcggttggttaagggcacagc

SEQ ID NO: 33324 - DNA, 1043 bp, Heterodera glycines
  misc_feature (771)..(771): n is a, c, g, or t
ctaattaccaaatttaattataaaaatatgcaaaaaaaaactttttttttcatttcaattttaattttttcttacagaaaatatttttttatttcaattcaattttttctaagtggttaagtgctgattgttggattggagaaatgacaatcgtatacattatgcattcacattcatctttttcacagctcatcctcatcccgcgattcgtatctctccgatcagcagcagaaaatgctcacaatcacagctcatctccctccctattcccatcatccccccccccccttttacgatcggagcacagcaaaaagaaataaataaataaatgttcgccctttcatcttaatcggatttcgagatggtgtaattaatacgaaatgagtgccatcatcataatccatccatgacttgttccaagatcccgccagaacagaatttcgggtccaaaaaattttcggaataagtcaaaagtcggaggtcctatccccaaaaatgtcgcgagttaggcaactattttctaaaggacggtaaaacaaacgttcaaggatactttttgcggcccggatagggcacatgtaaaaaataattgttgaaaatctattttttccgcgggaaccccctagacatcgaaaaccctaatttcctaggcccgtcgctggcttttcccgtaaacatttctattttcattcggcataagcagtaatagccggcttttcttgcctctgccgtgtcccttcccccaacaaatatttgcccatatgatttggncccgcggggggcggtccctgtctcggtccgcttttccttgtcctccctcgcctaaatgaggcgaggacattaatcaaaggtgcgcgtttcctttgttaaccaaaagcctcagaaatgacaatataaatgggggcgtaattattgtagcttaattaagcaattcgaataacagtgaaaatgggaaattgaattaaaaagaaattatttttttgttgaatttttttgtgaaaaattttcaattatcattttattttttttgtttaatttgactt

SEQ ID NO: 33325 - DNA, 655 bp, Heterodera glycines
  misc_feature (43)..(43): n is a, c, g, or t
  misc_feature (66)..(66): n is a, c, g, or t
ttcgtttttagtgccactattcatcactagatgctcaggtttnagttggagatggctgcgaattantggatgatcaaaacaaccaatgcaaaaagggcagtgatcactgatcagtattttttttttttgaattagggcctaaattatgctatttggcattatgaatcattttttctaacactggatttgatttgtctaacattgatttaaccaatagttataccatctacctttttaagattacgaattagaaaataacaggaaaatttattataaatatgtactaacattttcaaattttccatattactttctaaaaaattctctatagtgtcgaatttactcaatgtcgatatggtccagtgccgaaaatgcaggaaaacagtgaaagtttttgaaatagttcagtgtcgaaatttctctatgtcgaaaacgtagtgtcgaaattacttagtgtcgaaaatactcagtgtcgaatttacccagtgtcgaaattaccagccacggtatcctctgcatctcccaatgtcctcagaattcaacatataaaaacatcttacagtatacctaataaggtaatactggagaattggtgtcccgacgaaaaataacgttaagaattttctttacattttttctagggtaaaaaatacac

SEQ ID NO: 33326 - DNA, 954 bp, Heterodera glycines
taaaactccattttttcataggccagcgtgtttaaagcaaactcgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaatttgacatcccataaactccatttt

SEQ ID NO: 33327 - DNA, 912 bp, Heterodera glycines
ctttttggttgctgttttttcttcattgctctgtgagcttagcaaaagaaatgaaaatttaaaggctttattaaaatttgggaattaaaataatttaattgtaaattagccccttttaaagactgaaattgttgaaaataatacaattatttatttgtaataattgcaacaatggccatattttttccaattgattagaaatttaagaatttcaagggattttaggggaagacagtccaagaggtgccaagcaaagtgatggaaattgagtcgaatacgccggcaaaaaatctaaaaatgccgtaactgaaaagcgcgccatgagacaaaacgcagcaaattacgcatttcccaggcaaaaacgcatctccccgccacgaacaaaaaaaaggttcatcgggggggggggggggggatttggatttttggctggtttttcggatttatttcgcccctacatttgcaaatatattaaatgtgactttaatataatggtgaaaaacaattttttaacagaagagtgaatgcattttaacgacaaaatggatggatacggtatggaggggagagaattacggtaagtgctgcttcattaaatatatttttttataaaaaatgaatattaattaaattttgtcttctttaaatagaggatttttggaaaacacagatgacagatgcataactcagaagagcgagcgcgaattaaatatataaatttggcaaatgaattattattgggctaaattattttggggttcacattttgaaagggattaaatattgtcggcaccctttgatggaaaaaaattcagtcttctttgatgtgaaaattaatccagcagttaaatgcattcaatttgaaggtggaattttccaaaacgaaattaatccgctttaacaaaaattatt

SEQ ID NO: 33328 - DNA, 738 bp, Heterodera glycines
atccgtgaaattccggacattccggatgaatttgcaattcgtaacggattgtaaaccgggaaggcgaaaacacaaaaaaaatcttcttttttcgacctttgccggggtataactttgttcgaatttgtcgcagagctacgaaatttttttctcacccttcctctcgacgagctctacaaattgttcgcttaccgcaaaagcgtagctcttacggttcctgagaaataaggtgaaaacacacattttacaacccatttttggccaattgtaaaaagccgggttttttttctttaacccaattttacaaaaaatttttgctggtgcgaattttttccacacgggccattttgtagagaaaaccgagctctttcgattggtaccggtcccgtggcgatccgttgagcccttaaggagagggaaatcgtttagtggttagcccccccgttatttttatatacagataactaggcgtcccggtagatggctgcgctttatagaaagccgagcctatcccgtcgaggtgtagatgcgtaaggtgtgcaccgtcgcggttgttagtgcagtagcagctcaggcgcagatgcgtgtctggatgttcgtgcagtagcagctaccggtaacagcctagcctagccgttcacccccaccccaccctacgcggcatgcaaaagaattgatcaggttcgtattgactcggtacactccgctcgtcgctccgcttcgctccgctcctcgctc

SEQ ID NO: 33329 - DNA, 935 bp, Heterodera glycines
aacgaatacaaaatatattctacagagaatataaaacgttaagtatatattaattttttattcgacaaaaatcaagcattcacgcttttttatattttgcaggtaaacgtacgcagctatcaaatttacaacgaatacaaaatatattctacagagaatataaaacgttaagtatatattaattttttattcgacaaaaatcaagcattcatcgcttttttatattttgcaggtaaatgtatgcagctataaatttacaatcgaatacaaaatatattctacagagaatataaaatgttaagtaatattaattttttattcgacaaaaatcaagcattcatgcttttttatattttgcaggtaaatgtatgcagctataaatttacaacgaatacaaaatatattctacagagaatataaaatgttaagtatatattaattttttattcgacaaaaatcaagcattcatgcttttttatattttgcaggtaaatgtatgcagctataaatttataacgaatacaaaatatattctacagagaatataaaatgttaaatatatattaattttttattcgacaaaaatcaagcattcatgcttttttatattttgcaggtaaatgtatgcagctataaatttataacgaatacaaaatatattctacagagaatataaaatgttatgtatatattaattttttattcgacaaaaatcaagcattcatgcttttttatattttgcaggtaaatgtatgcagctataaatttacaacgaatacaaaatatattctacagagaatataaaatgttaagtatatattaattttttattcgactaaaaatcaagcattcatgcttttttatatttcgcaggtaaatgtatgcagctataaatttacaacgaatacaataatatattctacagatgaatataa

SEQ ID NO: 33330 - DNA, 869 bp, Heterodera glycines
ggtataaaaattctcaaaaaaagaaatagccctttttttggattaacgtataaatataaaaatccccccagaaataaaatgtgtattgcgcacaacccgccctctcatgctcaagtgcttttgtggggtatataaattttctaaaaaaagagatagccctttttttggggtagagcataaaattaaaaattccctcaaaaatataaaggtgtagttcgcccccaccttcctttcaatctcgaaagcatttggatgtgtataaaatttatcaaaaaaagagatagccatttttctgggataacctataaatataaaaatcctctgtgaaataaaatggcgattgtgcacagccctccgtctcatacgcaagcgcttttgtgaggtataaaatttctcaaaaaaagagatagccctttttttgggatagagtataaatttaaaaattccctcaaaaataaaaggtctattgcgccccaccctccctatcatgctcgagagcatttgtatgggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcgaaaaataaaaggtctattgcgcaccgccctccctatca

SEQ ID NO: 33331 - DNA, 668 bp, Heterodera glycines
  misc_feature (275)..(275): n is a, c, g, or t
  misc_feature (277)..(277): n is a, c, g, or t
  misc_feature (480)..(480): n is a, c, g, or t
ggattgagtaattttaattttagatatttatgtgtattaaaggattttatttttgttcaggtacattgactattccgtgatcacatttcttcgttccaaccagcaaatttgggacagaggcaccaaattggatttggatgtgggttcagaaaaaactaaggatgtccagccgatttgggatgtgtttgtccgtgaaatttggcccatttttacgatgaagaatttgaagattttgtatttttgttatgggtatgatttggagaatttgatgaggnanaatttgagaaaaattgtgtgggatataaaaattaattaaattaaatgtggtagtgtgtgtaattttgaggggaaagggttgatgaagtggttataaagttgaaggaaagatggagaaaaaaagtgattgtattgttgtgaattgagtgaagtgaatttattaattttgaatgggtaaaaaattttaaggaggtgtgagtgtanatattttgataaattttttgttttgaaattgtattttgattttgtatagggtttttgttagtgatggtatttttgtgggttatagtattgaattgaatttttaagttttaaaggaaaaaaagagattaaggggaatgaatgaatggattattatttgagaaaatgattgatttattcttttttggatt

SEQ ID NO: 33332 - DNA, 780 bp, Heterodera glycines
ataacaaataaaaatttgaatttcttaattgttttctaccctattgatttgccattttaagcactttaaaagggatttcaaaaattaagatttaaattgaactaacattccgactcactttggccttctcctcgtagaaacaacaattttcaaattggtccgatcacaaattccaccgtcagatcaacccaaatctcgagaaaatccatgggtcccgaattcgagaagctcgacgccggctgcggcgcgcgtttcggtcacattcccgggggcaccaggtgccggaaatgttgggctggcaggagttctcatcggacgaatcggtggattgggacccgtacgacggcttacacgccgagaaacaggtggagagattaggggaaaatcgagaaaaaatgagaaaaactgagaaacatgggaaacaccagagtttaaaaaaataagccttacaagggaaccacccgaactgtaagtcggaaaatgcatatgtattatataccattcgatagagcagggtcgacttctattgtgaattttgaatattacgcccccataggaagaaattaaaaagttatggggcctcaaaaatcgaaattttggcttgtattttcccttcacatttggtggtcaagtggcgcgaactgctgtcgggttgctggtggttcgagtccgcgtgggtttaacaatttttttatatgtttttggggccgtagaatccaaatatgatattcatttcggacccccaaacccgaattcgaacaaataatttttattaataac

SEQ ID NO: 33333 - DNA, 979 bp, Heterodera glycines
  misc_feature (36)..(36): n is a, c, g, or t
  misc_feature (752)..(752): n is a, c, g, or t
  misc_feature (913)..(913): n is a, c, g, or t
ttcgtcgagttcgtcatgcagcacatctagggaccncggagcgcaacaaccgatactccatgggcgcggtgtacgactggctgaagcgacaggcgaaaggatcgcagaactagtgcaacatgtcatcagcagcagaagagccagcccgaagaacgatgcgtgtgcagaaatcggatcgtctgccccccaattgttgtattgtattgtaaacccccattcacatgatcaatcccccaaaaactgttgtcatttcaattaattgcatgtttgaatgtatgtatttgtatgtcgatgtgtgtgtgtgtgggtgaataaacaatgtaagactaatggttttcgtttttcaatgtgtacagagagagctctcctgaaattttgtgacttttttgttcaaaatatgtaggaatcagttcttcggatagcgaaaatttgagtttggagtcgtaaattagcatcagtagggccccagaaataaacaaattcgagttttttttcaaaaatgttaaatagttggccgcttttcgcggcgtccccgtggacgtgatgcgaaagccgcgactggtaagaacggcacacattctgacaccatactattgattagagccgacatttcctagtcattttaatcattgccgaagtcgtgactcttgattttgccttattaaaacttgaatttcccggttttcttggcccgattcaattcgatttcactctcagtcactcactttaaaataccaattatcatcaatatnggcccggatttgtttaaccgaaagaagacaaacgaaattcgattttttcaaaaatgtaaaaccaaaaatgcatgaaaacatttgcgattttggtggtggtcgaagaatgggccaataatctgctgctgatttgataatggagatgctgactcattattccnattgggcatttttcttatgatcttttctccgtgataaattaatgcagggctgccatcgtccatgct

SEQ ID NO: 33334 - DNA, 953 bp, Heterodera glycines
  misc_feature (863)..(863): n is a, c, g, or t
atagccatttttttggaccgtccataccccacatatactcattcggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcnaacggcccgaaaatcatttttagagcataacaactgatgacagccactgtcattgtttccaagagatttctattaccagattgccaaaaa

SEQ ID NO: 33335 - DNA, 927 bp, Heterodera glycines
  misc_feature (885)..(885): n is a, c, g, or t
  misc_feature (902)..(902): n is a, c, g, or t
ttctgtgcccgagattaattctcgggctccgtatgggacggtgtgatataacaggtattccaacaggtagagtctgtgtgcgtcagtgtaatgaagcgaaattggataatcgctacagcattctaatcccttaatatgaaattttatttttgacctacagtatgatgagtgaaagcttttagcatgaatgagttacagctcaaattaattaaaaactttatagtatgctaatttgtattattgacctgtgaaatgggataaaacgataaatttcttattagttgattcacgtaatcatgtgttgctacaggccataaaagctgcaatatttggccaccaaaaaatcggtgtcttccttgagaatcgcgcgagtcgccaactttcactcccaaattgcccatgcatatgccaagaatctggaaagatgtttctgtttttaatacagttctcagggctccaaaatgtaattttacaaaaaatttcttagcaagccaaaaaactcttatttttttagaatttcactcaacatgtaacaaacaaacttagtaaaattgtcaaaatgttgtgatgttttcatgtcaggatcacctcacttttttacccgaactttttgggattttatggtcagtgtcccaaaaatcaaaagtttattttcaaatgtaagttcatcggccaccaacaaatttaaaagattctgttttagtgtgtaataaacagggatgggatttttaggtgctaaaaatcgggaattaggtactaaaatagttgctagaaaattgaaaaatgccaaaatagttgatacaaagttccttttgaaaattcgattctcaaggagtgcattttattttttattgcattttcagaacaaatttttttccacaatcncaaaggggtgaaaatangtgctgaaaagccgctctaatcaaa

SEQ ID NO: 33336 - DNA, 1182 bp, Heterodera glycines
ttaactcattaacaaacaattaccgtttaaattattggatgaagcccctctcttatgatttcttaattaggtatgctttttttaccattttgaatgggttgaaaagcgatgttccgcaaaattcgattccgtcggaccaccgcaagccaatggtcggcgaaccgtctcaaccaccttcaaaaacaggatttattctaaatttgcattgctttttgctctcgccttttcttcctctcattttccatttgttgcattttcttcgttgccatttgtttcattctttccggcgtcattttcttcgcgttcggcctgaacaaaggttgtgatggtgaaagtgtgagagtgccatttcctgaaagtgcctttctttgcatccataatttgaccaattaggtataccattttgatttgtcaggaaagtgatgttccgcaaaattcgattccgtcggaccaccgcaagccaatggtcgacgaattgtctcaaccacgcgcggtgcaaattctcacgaatgttgtgcattttctcatttatatgacgggctttgttggctcgaattcggtggacagttgagtgtagcagtttgggcacaatttggtcaagaagtgactccgactgagaaactgccatttcgagtgccatccgttgggaaaaaattttgttggcacacaaatggaattgacgagaaacgacgcgttcaatgagttcggatgccaatgcattggccattctttgctgctttttcttcgcaacgaatgaaatccatcgacgaatcacctttcgagtgcttaaacaatttaccagtgacctcgaaaaaatccgatttttaattttttgactaaccgcaaattgttgcgaattgtattttcaagtgcaatgccggcaattgctgtcagttccgtcaaaacgactttctcaagcaaatgctcccgcatggacagcagctgctgctccgtgttgttattagcgtccagcacggcgggaactcctatttggcgaaacggtttaaagaccgattggaatggttgaatggctctaaaatacgatgagaaaagtgccaatgtttagcaaaaaataaataaataaggctctaattgatccaccgaaagacctgacgaatgaaaagctcggcggcgcttcaactcgcatatttttgcgcgcagtgcaaaagacgagccgtgcaa

SEQ ID NO: 33337 - DNA, 1073 bp, Heterodera glycines
tttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttacgggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaatcatgtttgtagacaaaagaaattggcgaaaaaaattgcctcaacaatcagtggtgaaactgaaagaaaaaaacttccccaaaaaatcggagcttttccgacggcatcagctgcatttccacagttcaacagtataaataaatattaggcaaatgaaaaatttttttccttcctcttttagaaatggctaaaaaattttttgtggtaatattcagaaaaacgtggtttttttttactgaaaattttt

SEQ ID NO: 33338 - DNA, 1128 bp, Heterodera glycines
  misc_feature (53)..(53): n is a, c, g, or t
  misc_feature (60)..(62): n is a, c, g, or t
  misc_feature (64)..(68): n is a, c, g, or t
  misc_feature (74)..(77): n is a, c, g, or t
  misc_feature (89)..(90): n is a, c, g, or t
  misc_feature (95)..(99): n is a, c, g, or t
  misc_feature (102)..(103): n is a, c, g, or t
  misc_feature (110)..(110): n is a, c, g, or t
  misc_feature (120)..(120): n is a, c, g, or t
  misc_feature (123)..(123): n is a, c, g, or t
  misc_feature (129)..(129): n is a, c, g, or t
tcttttgaaaattactgaaaatttctgccgatttcactttcctgggcaccgancggaccnnnannnnncggcannnncttttcaggaanncaaannnnnccnnaaaaagngaaaaaaagncanaaaaancccaaaaagtagaaaaaaaagtcaaattaaaaatgcatgttagaagcttcaaacaaagtgtagaacactcttgaactcattttaagggtcatttaaagtcagcaaaaaaaagtcatttgacataaattcccatccctaatgatgatgtgaaaataggtatgaccataacatttttttaaatttacatgtgattttgtgtaaatttttcagtttgtaaagcgcagaaaatttgaaatatgaatataaatattagtatttattattatttacatggagagaccagatgtttttttgggaagaaaaatttatagtcaaaatttttaaagttttttttttaattttaattcaatcatttgaatgaattttaatcaaaattcagtaaacgaaaaaaaacaattgtatttttagtgctatttgttagtggtctcatggcaaatcatattttttagaaacaaaaaattgtgatcatacattttgatttggtattgttaaaaatatgaatcattgatctaggatcggatggcttccctgtcaggatttcccagatggacccggaagagtcatttttaactaaacttggccttaattttttttacttcacttgttcttttgcaatttcatacgcaacttggcccatccattcctgcacttacacactttgtccatggctaattcaactaatttttgaccggcgggttcatcaccaccagtttagatatgtggttatgagaacacttcgaaagatgcttatttacaaatttacctaattaaaaaacccatctcgggttttttgactattaaatgttaatatttcaaaacctaattttgagttgacgaatatatgggaatatcatctctgatacatatgaataattagagaggtgaaatgctgtaaaatcgccatttttaacaaaactgggccaatcaattgttgaaattattctgatcaaaagaatgaaaaaagtttttaaatatttttttagtctcattttaggattt

SEQ ID NO: 33339 - DNA, 1314 bp, Heterodera glycines
  misc_feature (1254)..(1254): n is a, c, g, or t
gacaaaccctgcgggtgctcgactgcttcaggcagttttttgccggggattgggctgttcggatgattccgaagcaatttaagaccgggacgcttcattttgacactttttgctaatgaacattcaaatggagcaattgaagtgcagcagagattgtgggcggaggatttcccgggctatcggcgactgagcgttcaaatgcttcgccttcaggcaaattgggggggggagggggagaaatcatttaattagtcgaataaaatgccaaagtcatttcagagtgacactttgctgttcgctctttacgaccgtaaagatgaaaaatgaacggccgattcaaagcattgggaaggaataggtggagaagaaaaggaaaaaataggcaaatgccccccccccaattcgtaatttgagtgtaacgttatttattgtatttgaagcaaattatgacagttcggagtttttgatagttaaatcgtcataagtatgatgcccaatttggccatcatcagaatttacaataaaatatattaaaatttttatgttagaaaaatcgctaaagatgcaaataaacatttattaaaatggcaaaaacgactcaaaatataacaaaaattaaaatgggtaccaaaaagtccaaaatatgttgaaaatatacatggtacatatttcctcacgtttagacaacattactctgatcatttaaacctcgtaaaaataaatgttcattacggctcaacccccaaaaaattactctttcgctttgccccccccccattttcatttgtccgttatcttcgatcgccatctttcacttggggcaaattttgagaaacaatcggcggacaataaaaatgtttatttgggaattgaggggggggggggaaatccaaacgatttgcatttgggcatttcgaataataataatttggagaaagtgtccgagtggaattggtgcccttttctctccgccgtctgtccgtcaatcatcgcaaaatccgtcgccaaatggcaaatttcgagcagagattaagcgataagtaactcatcagttatctttcatcagaagctctcaactttcgggggatgccaattttgcccggcatttcttataaccaaacgaagtgccaaaaacatttgaggacagacactgactgtaccagcccaaattcgttttctcatcttcgtttaaatgcatttattaatcgggtcacaacaatcaaaaaaaaaaaagacaatttaattttctactanaagaacgaaactttcggaactgccctaatgagacgccatcatttgctttggtagtgcatc

SEQ ID NO: 33340 - DNA, 913 bp, Heterodera glycines
  misc_feature (54)..(54): n is a, c, g, or t
  misc_feature (65)..(65): n is a, c, g, or t
  misc_feature (67)..(70): n is a, c, g, or t
  misc_feature (92)..(92): n is a, c, g, or t
tctaattttttgtttttttatgttacacgggctgatctccttagagagagaganagaagagaccngnnnncaattgcagttttgccacttgngaaaaatgccaatgccacctcgtaaagaacacgttgaaaaagtgtaaccaatggcagaacactgacgagaacaatgctcttgggagagggatatggcagaatattgtgattgataaaaaaaaaacaattactttctgaaaatagcctctgggcaacatcgggtcgcgttgacgtcggaaaaaggaaaagccgtggaaataccgtgggtcaggccatagcgaggcgggcacaatttcttccaatttggaaaggctgtcaaagcaacaaatgttttattgttttttccctttttaaaaatgcattttacttggtttgctcattaaaagatgctctccgaatacgaaaatggtgcatagaatcggaagagtcagaactgaacgaatacacatttattggacaacaaaaaacaatggaattcaaacatagggtgccaagaaccggaaaaccaataaacgaatgaataaataggttaaaaacaatatttgcaaacatttttttacctaataaggacaaaaaagactaaaaatttagggtttctttatggaaaaaaaatttattttttggcaaattatataccataatctcctgaaaataataaaacctcataaatcagctgtgtgaggatttttaaaagttgtgtttaattaaattgtaatattataaattttaatacaaagaacaactttttcccggatagctcaattttctcatttaccctggttaagccccgtgtgattctattccgcaaaggactgtgaccataagttgacggtgccgacgaatttgagtccggaatgccgcgtagcacaggtctgaacgct

SEQ ID NO: 33341 - DNA, 470 bp, Heterodera glycines
tttacgcgtccaatcacagtttgcgcgtccaatcgacttttacgcgtccaatcacagtttacgcgtccaatcaaaagtttacgcgtccaatcaaaaatttatgtgtccaatcaaaattttcctaattcgaacatccttttgacataaggtaccaaccattgcaaaaataaataataatttaaatattaaaaacgtaatccgtcattgatcacttattatcaaagtatcgataggtatatacgcattcaatcaattgttataaaatttaataatagagagactaatttgtgcgtgcttattttggtttcgataacctctgatatcaaaattttttgtgattttttattaacaatttggccacacaattgaaaacactgcgtgggatctaacgaaaaaatttttcagcaaattctcgaagagatacgtattcaataccctgtctaatcatcttgtcgatgtatcaatcaaag

SEQ ID NO: 33342 - DNA, 1606 bp, Heterodera glycines
  misc_feature (19)..(19): n is a, c, g, or t
tgcaggtcgaagaatacantcgaggaaataagatgaaatttgcaaatacttttaaataaaaaaaaaccaaaattagccctaaaattaggaaacaaattgtcgattgtgccggcagattcattcataatttttttttgattgaataacaactaaaaaatttagtagctataagaaaaaaaaacaatttttttttgaattattcatacttaacagattaaaaattacaaattaatcacattgagaattaaatttttggttggccagcaaaggaataatactcttccataaatagataagataaaagacatttacgagttttgttccataaaatttgaatccaataaatgcaatttagtgaaatcaaaagagattatcataatcaatgggcgctgagaaaattatagaaatatgtaaattactattttatgtccgagtgctgcaattttcatgagaaatatataatttgtggaaaaaaggttagcagggattattttggcaattttaaattgttttattttatgtatagaataaaaatgattagattgaattaaattgaatttaaaattttttaattattatgaatacaaaataaataagttttataattaaaaatcttaatgatatttttcatttaatggatattctaagtttttttcaatcacacattcgaactgcatcaattctttatgggatggcaaattagtcagtccatttgattggttttttgataataacaactgtttcttgaatttttggaagcgaacctgtaaatttgttttaaattcaatcaaatctgaaaattctaagtcactgttagctaaattaaattaaatttgcatttctaaatccttttaagctaaatgcaatcagtttagaaaactcgaagacactgttttttttaaatttaatcaaatatgaaaattcaaaataactgttagctaacttcaaatattttaaaaattcgaaatcactattaggtaaaatcaattaaattagaaatttaaaaaagtcacaattagcctacattaggcagctgcaaatagaattctttgtccaacattgccagttgctcctctcggctgtcgaattgtgtacgattgtaaagagactcatacctaattagttaatagggatggttgaaaaatgtatgtaagaaaatcgcaaaaaatataaaataatttttttcgacaataatttattggaaaatgtgaaatagcataatttccacaaaaaagacccgcgaatttttgtaaaaaaaaatttccaaaaatttcaaaagaagaaatcccgggctttaaacacgatgtcggcttcgttcttgacactttcttaccaacaaacggttgcgcctaagtcaaactcgggaagaaatttattggcgtaaatatgtggccatcggatgaaatttgtgcctaaatcctccatgccaaacacacaaatgccgtgccgcataaaatgtgaagcgcattcatctgctgagtaatttatccaaacaacagccctaaatttttcatttatattttatgataattttgaaaaaatttaaaattagtcaggattttaggaatagattgatcaatttttcttaaatttatttcttattttt

SEQ ID NO: 33343 - DNA, 981 bp, Heterodera glycines
acagatatgaagttttatcctcattttgtggtttttggctattgtcaatgagaatttttttttcttgaaaagggatttgtggctttttgagaaattttaagggtttttgaggcttttggggaaaatcgtcagaaggcacaaccgttttattggtggttcctgaatttcaaatattagtaaaatataaaaaatataaccaagtgaaaatgttcaccattttgatgacgagcacggacaatgtgtatcaattaaaaacgaaaatcttcgagaaaattaaaaatgattttccaaggattaattccatgacaataaacgacagcccaagttcggaatataatgagctgcttaatgatcccgaaaattacaaaaaaacattgaaattcccggtcgccctaccgggaccgggacctgagcttttcaaaatccgggaccgggaaccgggacctcggatgaccgggaattcccggcccggtcccgctcaactctacttttattgatcaattgatttaaaaaaagcattttcatatattgcagagaaagaattttacatacactacacattacattttatgactagaaaaatggtgaataaaagtgatcacttaattattaatagaattaatttttgagttgaattctgcccataaaataggtcatcgaacagttttcacattcattcattcctaattacccctccaaatcctacaatttccatccaaattcctcacttcctcccatcccatcaaattgccaacagatttcccgcataattaatcattttggcatttctgctgggattctcatggcaatgcttattatgctaatgctgatgccatcatctacggatggctttaaatttatgtgtctttgcccgtggaagtggaggacaccgacactgtggccacattgaagcagaaaatctcagaaatcactacaatcccgccccgacaacaaacaatcgatgacgaggacaatccaaat

SEQ ID NO: 33344 - DNA, 1036 bp, Heterodera glycines
tagggacgtgaattttagtgaagaaaaatcccgaaatagttaactaaaatagtgagtaaaaatgccaaaatagtgacaaaatagtgtcaaaaagtccgaaatagtgacgaatagtgacataattttcagccaaaaattgagcaaaaataatttttattcactgattgcattgcaaatgagtagggctgggatttttaagggcaaaaaaacaaaataggtacataaaaaataattttttaaattaaaattcttgccacgaaaatacctttttgagaatttttttttcatttcttaggagtgctttttgaaattttttttgtcgattcttaggggtgtattttttgaaaaaatttttaggtcgattcttaggggtgtattttttggttttattgcatttttgttaaggaattttgcccaaaaatgtcaaaatagtgaaaaaatagtgacaaaactccaaaatagtgaattttcactattttagtgacaaaatcccaaaatagtgatttctagtgaccgataatggcatcagaatcgaaaaatttttatgcggaaatgcgttttttgagctcctttcttcaaatcaattgagcaaaaaaaaatagttaaaacctaaaattcacgtccatagttattagtgattatttatagcctttttctgttaaggtgctcccatttgctttccaaaatgcgggaaagaatggcgtgcaatttaataaattaattgataaaatgaactttaattcacacacttaattgaatttgcttaaataaatcgtaccaatttgttggaaaataagtgatcaaataaattaatttaaaaaatatttgcttagaagaataaggcaattttcatgggtaaaaaggacaattttatgtaaaaaattagaatttttttagctttcgaaattaaaaataaaaataaaattctcttacttttataattacttaacccattttgtaccaaattggagacaaaataattgccaagaaattgggaattggaagtgcaactctgaaaagatggaaaaggaatttg

SEQ ID NO: 33345 - DNA, 978 bp, Heterodera glycines
ttttattgaaaagtgccataaagagttttaaaattaaattctcgtgctgtcaattcaattgtatgaaattctcttacaatttaaagattttgagagtttgtattttaagaatgattatatattaaaatggatcaacgttcaaaaaattaagcactccttcctcacattgatcaccgcgttgctgtacggcagtgacactttgtccgccaaagtgatcattctgtccgactcaaccacggcgtcgagctcctcgtgcagcttctgctgcacccgtggggctgtggatcaagtgaatgatgccccagttcagcgtgtccgtggttgtctcctggtcggaaaaagaagctattatggtcaaatatgtttttgtgatgacaacgttctgatcaccaccaataaacacagctatagtaaaaacattcattccatcgaatccaatttaattattactacgctttacaataattatttggcttaattttcattgaattcatttatttactttttcaccatttctcagttttaatcaatcttccttcataatttgatgagggatttacataaaatttgttactgacctgtcccgctatccaaaagcccaacaaatgcgcgtacgaattaactctggctaaaacagacgtaatttgtcaaattttgagcataaaattaaatttttaaatttttttttttttgttttattaaaatcccaaaatgtcgggtccccaagttgcaaattcccaaaagtcgcatcacgaattaaacaatctgttcgggaaggaataaccctttccactaacatttatttcatatggttttaaaacaaacaggcagggatttttgtacaatccgcagaagtattattttacaaacagtttggtcccatagaagttttacaaacaggggggattttgtacaatcccgcaaagtattattttaacacagtttggccattcaagtttacaaacagggggatttttg

SEQ ID NO: 33346 - DNA, 1076 bp, Heterodera glycines
  misc_feature (62)..(62): n is a, c, g, or t
atcagtttaaacaataccgactttcgaaccttaaataaattttgcacatcaccagagtcccnccttagggttttaaaaaaattcgaaatctacgattttattaacatagcgctcattattcaaatatgaattcgaaaaagaatttaaaaaaagtaaataatttaaattttgtataaaattaaataaaattgtgtaaaaataaaatattgaaataaggaaatgaatattgaatttgcaaaaacaaaaaaaaatcaatcaaattttgttggcattaattttgtcattaaattaatacaatgaataaaaataatgctactttaaatcacaatgattcaattatttttatttgttatattaaaatttttcatttcattcgaaattattttttttacaataaaaaaatttaataaatcattttactttatataattttaattttttagataatttcgttgcaataattgtaatttcagagacataaaaatgatttatttaaaaataaattttttatttacttttttatttgtcaatttttgttttgtcattgccatggataacgacgaactcacaaaaatagtgaaatcttcgaacaaagcgacaaagaataaacaaaaagtggtaaaaaaaattaacaaaaatttttgaaaatttaattttttaaattaaattttattaattagacaacacctagtcaatcaaatgacagtgattcttccaaaagatcatcgcagaacattgatcaactgacgacggctatttgtcttgaatttttttattaaaatattaattataaaaacaaaccgaaaaatgataaatttaattaaaaaataaataaatttaggaaaaagagaataattaaaataaaattattctcttaaagtaatttccagaaccatgtgatcctttaagagtaccatgaaaaaatttttttttaagattgttaaaataataattttataaaaatataatttaataaatttaggaaaatacaatcactaaaataaaattattctattgatgtaattttgcagaacgtggtggtcccttgttgagtaccatcaaaagaattttcttta

SEQ ID NO: 33347 - DNA, 1025 bp, Heterodera glycines
ttcccatatggcactgcttccgaattattgaactgtttctcgactgattgttgagataatttttttttccgattcctttatctccaagcatgagccttataagtgattgttcatatccttctcttgaaaaaaattgtcactaaaaaaaacacgttttctgaatattaacaacaaaaatttttagacagtttataaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattagttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaaatcttcggcagttgcctttatttcgagcctactctacttgtgcatcttttcccatatggcactgcttcccgaattattgaaactgttcaccgactgatttgttgagataattttttttttccgattccttta

SEQ ID NO: 33348 - DNA, 1016 bp, Heterodera glycines
ttccgattgtccccgaatgcaatggtctttggcattgttgacgaagcccccgtcagtgctgtttctgcttcgtcttcggctgcccaccatcgtttgcttttcgttgcgggaaaaggcggcgtttttgtgctggacagtgacagttgggagcagcggacactgctcacccacgccgaattggcttatgtcagagcgaatttctaaacagatgcatttaaattaaaacgaaatgctgcaatatattgccaaattaggccagaatcaacccaaatgattttggttttccgtatttaggacactttttccgtcttggctatttgtccttcttccgccggtcattctctgctcgctgccgccactcttggcggtgcgttggccctttggcgactccccgccgacggctgtcgcagtgccgcccaatttttggccattcactcgcaaatctcagccaatttgggcacaatcacttccattttgtttaggccaaagtcagaattaggcagtaattttgatcgacaaataatactaaattcgaaccgtcctccgacttttccctcgtttagtccggaagggaattgcgtcgatgaggaaaatgctgtaattttagccgccttctccgaggtattactggtatttccgattaattttttggattttttttcaatttttagggttacatttgctccgtcaccgatgtcgcgcagtcggccgattcggcacattcatcagcaaaaaacaaaacgtcggcagcttttgttgttgacgacgaagcgatcgaaattgacgaagaggcgacagcggtgagggcgccgccaaaaattgtgttaagcgacgacgaaggcgacggtgctggtgccgattcggtgatagccgaaaacgacggtgggaaaatggcaatttgcttcaacaatgaactgaatttcagacctggacacggatcttgggttgatcaaagtctctaaattgaaattagtcctaatttctccatcaacctccgttcagtctcaatgcggttt

SEQ ID NO: 33349 - DNA, 739 bp, Heterodera glycines
ttacatactagccattttttattttattgtgaccaagcatatctttcctcgtatttctgggatttttttcagaatgtggtcatagaattgaattatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaattgaattatttgtattttttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagcggaatatcctgtcaatatttccctattagaaacgatactgtgaattctttcgcctctttaattcattcgtgctttgcttcggattagtctaaaaatttctggacgccaattttacatattagccattttttattttatttgtgaccgcaaa

SEQ ID NO: 33350 - DNA, 800 bp, Heterodera glycines
cttcttcggttcgtctgcttcttccgccgattgctcttctaatgcgtcgctgtaaattgacaattcgtcttcatcccccgcttttgctgttccgttttgttccttttgccattttccgcctttctcttaaattgtggttggcttttgttgaataaattgtttaagcaattgctaatccgtccacctgctgctcttttgatgcatgtttgtgctgtgtacaccgccaggtactgcttgggttccatttgctctttttgctgctgttgctgctcttttttgccatttttatgcatttcggtcccttcccttcctccgactcctttctgctcttctaattgctcttcctcttcctttcctctcactcctttctgctcttctaattgctcttcctcttccttttcctcctccttttccccttcccttcctcccactcctttctgctctcccttttccttttcctcctcctcttctccttttagtccgttttggcccatccattggtcctcctcaagcttcacacgaatcacttccactttggtcgtcctcattattgtggcgatcactgcttccaccgcccctccgattatcgtcttcaccccggcggccattgtccacttcgatggtaatacgacccctccgtcttaaaatttaaacacggaaatgagtctaattaatgctaattaatgagttgagggggaggggagggaaagcaaaagccaacccttttgctttgcagggatttctttcttttctgttgcacgatgcttaagcctttttttaagggtttttttctccccgcg

SEQ ID NO: 33351 - DNA, 864 bp, Heterodera glycines
atttgctccgctcaagatgctcttttctctgcacgggttggccaccgcctcggcggatctgttgatgaacatgttcaacatttacctgtacttaattggaactgtgttcgtctgtggcgtggcattgattttatgcgacagggactggcaaatggtggaggagctgtacttgaacatggtcaaatgggtgcaggaccaactcatcaaggcaggcacaccatttgttgtaaaaaaaaagtgaaaattgtaactttcttgtgaaatttttttgaaattttggcttattgcaatttgatgaaatattatttttaactaaattttgcagtgatttgggcagcaaaaggagcataatttttgtgacttatgcaattcgctaaaaagatattgttaatttaaatcgaactttttttaggtggcacggtttttcgaaaaaaaacagaaagaggccctacgctttggtccggccccaaacagctatttttgctttttcagttgcacgaaatgcacctcaccggccactcatttcgacggagtaataacagcagcaattactcggctgatgccgacccattctgtgctctcggggactgtaatccgcagcagcggacatggccggtgagaaatgggcacattgttgccactttttggcaatttatttgccaatccaaattcacagccatttttttgtctttttgttactcattcggtccattgttttttgtgtggttatttaattacaactaaatcaaattcagttattttatacaatttaaaaaaaagaattatcacgggaaatgtaaaaaaatgttgcactattcctaactcccgaataatttaatcattattttgtaggaaaatgcccgt

SEQ ID NO: 33352 - DNA, 942 bp, Heterodera glycines
ttttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttctcagagaatttttaaatttatcttatatccaagaaaaatgactatctcttattttgagaaattttatacgttacaaaagctctcgagcatgataggaagggcggtgcgcaatcgccatttaatttctcagagaatttttaaatttatcttatatccaagaaaaatgactatctcttattttgagaaattttatacgttacaaaagcgctccagcgtgagagggagggcgggggggcaatcgccattttaattttctcagaaaaattttttaattttttctatatccaagaagaaagactatctcttattttgagaaattttattcggtaccaaaagcgctccagcgtgagagggagggcgggg

SEQ ID NO: 33353 - DNA, 152 bp, Heterodera glycines
cggaacccttgatgacttcgatctgttccaggttgaagacttcacgcgaggtcgcgccgatgtcgcgcatgccgtcgacataggtgctggcctgggcgtcgtagccacggatgatcggacggtcgcccagcgggttgccgccttcaccggcg

SEQ ID NO: 33354 - DNA, 942 bp, Heterodera glycines
agggccgactcagtccacaaggatagaaaaaagaaatagggatttttggaaatattttcaaattttcacggacaaacccgtactggaaaattccaaggaagtattgggttccctgatatataatttcaagggccgactcagtccacaaggatagaaaaaagaaatagggatttttggaaatatttttcaaattttcacggacaaaccgtactggaaaattccaagaaagtattgggttccctaatatataatttcaagggacgactcagtccacaaggatagaaaaaagaaatagggatttttggaaatatttttcaaattttcacggacaaacccgttatggaaaattccaaggaagtattgggttcactgctatataatttcaagggccgactcagtccacaaggatagaaaaaagaaatagggatttttggaaatatttttcaaattttcacggacaaacccgtactggaaaattccaaggaagtatttggttccctgatatataatttcaagggccgactcagtccacaaggatagaaaaaagaaaatgggatttttggaaatatttttcaaattttcacggacaaacccgtactggaaaattccaaggaagtattgggttcactgctatataatttcaagggccgactcagtccacaaggatagaaaaaagaaatagggatttttggaaatatttttcaaattttcacggacaaacccgtactggaaaattccaagaaagtgttgggttccctgatatataatttcaagggccgactcagtccacaaggatagaaaaaagaaaatgggatttttggaaatatttttcaaattttcacggacaaacccgtactggaaaattccaaggaagtattgggttcactgctatataatttcaagggccgactcagtccacaaggatagaaaaaagaaataggg

SEQ ID NO: 33355 - DNA, 941 bp, Heterodera glycines
aattaaagtacaggctatagtggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagtaagcctacattttttggcatatttaaaaagaattaaaaaatttttaa

SEQ ID NO: 33356 - DNA, 813 bp, Heterodera glycines
  misc_feature (728)..(728): n is a, c, g, or t
ctacattggtgtttttgccaaattatttgatttgggtttccgagcccggcaaatggttgaaatgtgcccggtcttaccacaaatgtgacacttaaccgaaatcggataccggcagtccgaattccaatgttgacaatttttacgaataaatattaaatcataaaaatgatgacattaatgaagaatttaaaaaggtatgtgcggtctgttcctcaataattaattaaattttcaagaagattggtgaactgcttgaaaaagatgaaaaagaacaaatgattctgaacaaaacagtgtgactgctgtgttacgaaaactaatcacaacattatttgatcatttattcatttatgtgatctctccccccccccattccccaactccaaaattttcagaatcattcttaaaattaatcaagaaaaaatattcaaaataaatttattttaataattttttgacataaattcctaaaatttagagaattaatattaattgaatgaatatttttcacaattttgacttattgtcatgttcaaaacttttactttcaatcacaagtacaaataaaacagaaatatttctaaatattataatgaagataaactaataaaaatgtaaaaatgcgttaaagaaattaattcaaaaagctcaatttagaaaaaagcaaaacataagaaaataataaaaatataagaaaaagaatttacgaatgctgtgaatttcatgtnaatcacatatatctttttctggattctcatgccttttaaagtgtaggtcatttcttaaaacgctaaggggtaaaaaacaaaaaaa

SEQ ID NO: 33357 - DNA, 826 bp, Heterodera glycines
cctgcgcatttcgcttttgtcgtccaccgcaggtcgctttagttggcgctgtctctccgtcccccgaatcgcagtcaccgggggtggttcgggcgacaactgtccctggacttgctgccgttcttgctcgtcgatttgaccccgtcggcggaccattgattgggaggaggaagccaatcgatcggctaaggaagaagtctgactgtgagacgcagattttgtgccaacgattgagacattctttaaataacaaaaatattgtactatagagttaaagggtgttgttttggaaattatatgaggtttagagcatggctttgtcctttggaacattactttgtccatattctgatggtcatctctgcccggctcttcgtccgcttcattcgctgttgcttcccaatataatttggtggcattttcggtgtctccaattttgtgtaggaattgtgccgctttctccatccaactttcactgtttttgcttcggctgctgtctttttctttgtcttcctctgtcctggtccctctgtctttggatcgacttcgtcgtcttccgcccctttctctctctcgttctctgtccctctccccttttttcccttctctctctcggcttcggcttctttttggcttttctgtgctgctttgttttgatcgttctaaattttaatttcccttggttttaaaatgatttgtcaccttttgacttgtccctccttcgttcacttctgctactgtttgattctgtgctcacgtcgctttccttctgagatcgctttttctctttcgaatttgtgacatttttatcggcttcttcggaact

SEQ ID NO: 33358 - DNA, 472 bp, Heterodera glycines
ctgcaacggctttacctcgttggtgttctcagaataccaggcacgaaaaaagtattggcacattaggactaatttatatgggcgtaaaattataaggaaattccaaatatttattttactgggctgtctgaaatgtaatttaaaaatgaaaatttgcttttgttacgttatttttctaaaaattaataaaagtaaatttgttttttttctaaaagtgtttttgaatgtattatcctttaaagatttttaattaggaaattttaagtccatagttggcgatttatgtctacgttttattgcccttttcgcaatttataattttgcgccctaaataaaggaatattttgtaaaataaaaaaaaatgatgccaaattagaattaattaaataaattgttaaatttttattataaggtctaaaatttgcagaaaatgccttagaacttacctaatcagtctagtaaatttcaaaag

SEQ ID NO: 33359 - DNA, 1254 bp, Heterodera glycines
tgtattgggtgttgggttcgttcccccccccccaatttttgacattttcgcttttcttttcgcaggttttggcctctttctgatgctctctcattccaccttttacgcttccgaagaagtgcccggctcggagttcgaagtggtcaccgcctgagggatttgtcagcgaaagtgccgagcgaagcgaacgccgaggaaagggccgcccgactgatcatttgttgactaattattgaccgactgatcatttgtttgttgactaattacttaacgaccgattgatcacttttaattgttcctttttttgttgcccttttcatttcctttttcttccgtcgcttcgtttcgcttggcttcatttgtatttaatttaacacttttaatttgactttgttatttctctctctctctgtctgtctgtttttttaaatatttttgaaaatgtcaccctttttatttggtttgcccatttttccatgctttttttttctattttattccatccgtttttacggccaatttcccctttggggatgaatgaatgggcgcaattgcaaaagcattttccattctccgcggggaattcaaagcaaagaaatgctaattacagagaaactgtgacaaatcgtaccaaaatggggacattttgtctgttttcgtcttcttcttctgatgctttgtctgtcggctttcgatcattcgttggcttttcccttttcttttcctttctttgctttctcaattctatccatttgatcacttaaatcggatttactttcgtcaccattcattgatcagctgtttctccgcgattcgtcgtgacctctctcagtgagtttttgacacgacgactgaccttccctcactttgttgtacaatcactcttcgccgaagacacagaacagacacacagcaaattcaaacaatgacttgctgatcggactgatcggccaccctttctttgatctccctttcccttaactttttcaccgatcgctctttcccaattgggccacccgccacccattcactcactaattttgggccctgcttaaaatgatgacaatagaacaaaattgtcatttgactaattagtctccattagcccattattataaaattctttctgagttgctcaacatatttttttttggctcaacgtgtttttgaagtacgattgcctcaaatgggttggacgattgggggaaaaagggggggaaggggaaggtgggccatggaatttgggggtgggcg

SEQ ID NO: 33360 - DNA, 880 bp, Heterodera glycines
attttattttcattttttcacttataaaataatgaaatcaaaatttccaaaaagatagaatttttttgaaaaaaaaaatcccaggtttaatcccaaattcgtttaaaaagacattagacttaatttagtgcttagttcaaaacaaaatttttccgagactaatgatccgagaccgagacacaaaaaaacctgagacttttcccgagtcgagaccgagactttttcaaaaaaatattttcttgtacaattataaattaattaaaacttactacatttaaaaaaaattgaggcgattcttaacaggttttttgctattttgtccttattcagcatttcattctatttattcgtgttttatcaccaaaaataatcatttttagcctattgttttataaaatttgctatttattttcggtgcaaaaattgtgaacaaatagcatcaaattttcaaaaatttccccggcggcgcctttcggcaccacaggtcactatcacattaatttcatttggaagaattgattctgctgaataaaaatgcaataatattagccgtggattgtgttttaattaagttccttatttttggtgttagtgcccttcctaaaagcgacattttatttaatagaataccaataaataaatgcaaatacataaaaatttattataagtttgttttttatacatatcatgaaataatgcaataatatctaaatttttggcaacattgtttttgacatggatttttcaaatgctcattttttgacttttgaactaaattatttgaaatacgccgctggaaaaattggatttttaatgagagattgtgaaaaaaattagaaaatttaatcacccatcgctgacgattttggatgaacattta

SEQ ID NO: 33361 - DNA, 443 bp, Heterodera glycines
attagggagtatgagatggaactttgaagggggtaatctaaagaatctttttaaaaaaagaatatgtacaaaaagaacatcggttggaatagttcctttcccagcgggttcatcactgagtccacttcatcccccccccctccgaaaaattagtttttcaaaaaaattattcaaaatttctgttagaaaaaaaaatattttcaaaatttttcgggggcgggtgggggcgacctgctccgacccactacataagccttaaaaacgaattccctataaaaaacaatcactgatggctaccttttctgagtcttttgaaaagcaaaaatgaaagttcatcaaaattggagaccttcctcttttgcagttttccgactccccccccccccccccttaatcgacaaacttcctacccgctccctcaaacggaggtgatttttaaaaga

SEQ ID NO: 33362 - DNA, 773 bp, Heterodera glycines
  misc_feature (17)..(18): n is a, c, g, or t
ccgaaaacaaaaaaatnncgattttttcaagtcgtcccgtttgggggtactcaaacatttatgggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcgggcctcgtggtgggccttcgcccccc

SEQ ID NO: 33363 - DNA, 765 bp, Heterodera glycines
aaaatcttttcgctttttgtaaggctaatagagcatgttaagagctttcgaatgataccaacagtgttggatttggatgccaaagaaaaaagcttaagtggaaaaacgagctggcgccgaaacgcgtgggtcccttttgagttgggcattaaaaaaatatgaaaaaactcatttatgctaattttcgaaaaataaataaaaatttaaaaaaaaatcgtgtaaaacgcctttcctggggtttttaggtcgctgatcacgaatctggcatccatttgaaatatctatctaattccggactccgaacccgaattcgaacaaaaagtcgaaaatttaaattttacaaacgcagactccgacttttcccaccccgaattgctacgcaaatattttagtataaaaatgccttttttcttcccctccttctccttctcattccatcatattctgaattttgtgacaaaaatcaattgtaaaacagcaaactgtgctaattacagcaaaataaatgaacagacggtaatgaatttatcgaaaaattataaattattttatccaatttttttcatgtttcagttggatttgcaacgacgtgtggatggacattgcaaattgacaatttggagagatataacaattcacaaggacgaaggaactagaaaaattcaaaaaaaatttgttttatcatgaaaattcaaggaaattttaaaaaattttcaaattttttggttttttccgaaattcagtaaattttgtttattaacactt

SEQ ID NO: 33364 - DNA, 335 bp, Heterodera glycines
cttttcctttggaattgaccatttccatatcatctgcactatccatttcagttttggacacttttgctgttactataaaaagttgtgaaaaattgggtaatcgttcacatcattggtcccataaaaaaataaaaaaaggggtcgtttttttgcgattctgagaactattgggggttatctgggtcgctgatcacggatatgacatccatttcgaccaatttctaaacccggacccgaattcgaacaaaaaataaaaagttcaaattttcgaaattgtatttatgtttcgaaaatgatttaaatgcatgaaaacaaaccaaatatcatcgttcctg

SEQ ID NO: 33365 - DNA, 830 bp, Heterodera glycines
ttaaaaagaaacattttcttttaaggaattgatcaatgcttagtccaatcttttggtcactgaaaatttgccgagacaaattgcacattctgccgatgatgagcaacagcagcagagttcgactgtcgttcatcctcctcccctttcaccgttgaacagtgaggaccatgaattgagcggaatggaagaaggatcggaagaaggtataaaattaaattttttttttaattaataaatttaaaaaaatattttttaatcccttttttaaaatggtttaagtttataaatattattttttgtttttttataaagcattcatcgctcatttttgacaagaaataaaaatagtggtgccacttttaccgctcttggaattttgataattgaatatttattaatttatttaatttttgttttttttaattttaaaaattaaaatcggtacttttggaagaatggcgatgccaattaggattaatagattttgttttccaattctggctaatttgaaatcaattagattcaaaaatttcaacggatctacctatctatttttgatgctaataattaattagcccataatttaattgctgcttttttaggaagcactcatacagtgattaatcggcacgaacgaatcagtgaagatgaacacagaacccgatcactttacggcgcatttgcacccactgatcaagaagatgtacatttaaaaatgccaaaaatagtctaaaaacataattttcaaatacaggaaactcgaagcaaaacaccgagtacgccagtgatgtcagccgctcgatggaagagtatggatgaacagttacagc

SEQ ID NO: 33366 - DNA, 918 bp, Heterodera glycines
taattatttcatctaagttcatacaatttaaaaatggattcaaaagttgctcaaagcgggctataaaaaagactaaagataggttaaaaattgagatttctcaacaaatatcattcgatagctctaaatgagacaattcaaaaataatgccaatagtgactcaatgaacaaaaaggcaacaaaaaaagtgccgcgaaaaaggtcaaccataaaacccagatgggataaagaaaaaaaaagaaatagacaaaagaaaatgacgaaatagtacaaaaaatgggagagaacggcaaacggacagggagttgaaggatgggaaatcaatcagtggataatccgtcagtaatggacggacaatcaccagcaaaatttattttaagactctttttatcatatgattttgtttcatagactttgtctatgatttatcatatgattttgtctatcatttcgcagaattctatttttccaacccatttcaaacctttttacatcgattctgaccgtttttaagcatttttgagtttggggcctatgatcaatatttaccaatttcggttttcgagtgccattcattccccaattttaggtttttaagttagaatctattggataaggcgcgaacattggacttgaagacgcaggcctggctgctgttctacagaaaaattcgccaaaaaactaaaagaaatttccgagtgcacagactcttctattgatatttctttagcgagttggtatcgtttctgttttcgcatgtgatattctcagggtagccagattcaattttcaaaagcctcatttggcatgcaaaagaaccttgtgccacaaaaatcttcaaatcatcatttcaaaaaaattctcattgacctatcaaaaaacacaaaatgaagaaatcctcaaatctggctactctgc

SEQ ID NO: 33367 - DNA, 928 bp, Heterodera glycines
  misc_feature (847)..(847): n is a, c, g, or t
  misc_feature (849)..(849): n is a, c, g, or t
  misc_feature (895)..(895): n is a, c, g, or t
ctgtaggcaaggcacatgaaatgtcatttggaggacgaattgaaaatggcggacaaaagtgcggacaacaacgacaaaactattaccggcacaaagtggaggttggagtaaattatgaaaaatttaataatttaaaaaaatgggcaaaaatgatttaaaaaattactttgccacccttcgtcagaagcgcaaaaatttatttttattttttttttgaaataatactttttcatgcatcctcaggaaacttatattcggaatactgctgagataatctcgctagcaaaatttgttttttcttaagggaccgtttcaatgaacacgcaatcattttaagtggatttaaaaatgttaattgtttttcatcttattttttagtaagacatctgtggcaccaaatttggcactggaacacgaattgcaaatggaggacgaaaatgtggtcaaaaaaggcaatatgacctgcagcaggtggaggacgggaattaattaatcttttttatatatacattaaatttattcaattattaattaattcatatttttaagtttttggggtttaattcctcattaagaaattaataaattttcactacttttaacactttaattgtctttcaatttttttagctcgtcatcatctgcacgtaaattgacattgagaaaggaattgacgagtgccaacgatgataatttccggtgagtttttaaacagaaggaaataattttacaaaaattaattccaacttaattttttccataaaaaattacttattagtacctttcatttaattggtttaattaagcgagtcgtccgcttcacaaaagttcgtttttgcgcagagtngnggaggattcaaagcgcgatgaccgagatactgatctgattggctanagcacaactgaacatcagcacagggctcggatt

SEQ ID NO: 33368 - DNA, 781 bp, Heterodera glycines
aataaatttataactcatttcaaaaaaggcgctaaagaatatttaaatattcataaaatccgcaatttttttctctataaaaagaattttatttgacctttttatcacatttttaaaaaaagatataaaaataaaagtgattttgggattcgggaccaaaggggggtgaccagtatttttgagtggaaaacttttttcacccaaaatcttccaaaaacatgtcattaggcgttatttgggccgctgatcacgaatacgtgatcagattttacttttgacatcgtcaagacctcagaatccctgtgtgattggggtttctgaggcatcttttttttggggggggagttcggatccggacggtgttcattaattttctatatattttttgcttatttttacatgtttttaattaatttaaaatagtttgatatataaattaataaaaaaataattttaaattaaaaattttcattatttattttttgaatttgcaaaaaaaattaatttcatttcaaattaaataaatattcaattattaattttcaacgttgtttttaattaataaaacgagtattttattataaaaaattttaaattaaaatgtatgtgatttttaatctttaattaaaaaattttccttatttattttttattaggtttttagcgggtatttatgacgctgatcacgaatctgaaatcagatttaatacatcgttaaagccttagaatccctgtgagattagggattctgaggctaaaattttagactaattattaattt

SEQ ID NO: 33369 - DNA, 805 bp, Heterodera glycines
  misc_feature (27)..(27): n is a, c, g, or t
caacaaataaagctcggtgtatgtctncatcatttgggtacttacgcatttttacaagccaaattaatcaacaaaaacattcaattgtcaaccaaagccctaattgtttgttgtctcaacaaagtcgtacattattaacggtgcgccgggacagcacgaatttcggatgacatcggagggagcgttggccgaatcagcgaatttcacctcctccagttgtaaagtcgagagcaaaaagtcgctgatttggctgagcgctgccttctggtcgaattcctcttccgacgtcaccgcaaaaatgccacgctgagcaatgcgatcgcggaacatctaaaaatgttcgaaaaaatttagtatattttgataatgggaaggaaacgggatccgtggtgcgacttttggggatttgaaacttgggaacccgacatttggggacggacccgacttttggggacccaacacttagggtacccgacatttggggatcgaaagtcttttggggatccgacatttggggacccgacagttggggattttattataacaaaaaaaaatatttaaaaatttatcccaaattagacaaatttacgattgcttttgccagagttaatccattgcaagaataaacaacatactatttttaatatcaagtctaattccggactctaagaaacagaaaagatggacctcggaattttgttgctgtacgcaattagacagtaaagtcagccttttaacctttttgaatgcccttgatgaatttctgtgcccgttgggccttgggaaaaggcggttttaataaaaa

SEQ ID NO: 33370 - DNA, 425 bp, Heterodera glycines
aaaattgttaaaatagataatatgagactaaaaaataaaatttgatacctttttgagcgaataaattgtaaaaataactgatttgaaaaaggttgcaaatgttcacatttttgatactaaaatcttattttttgggcttggtgttcatggtggaagccctggtttaaaaatacctggaggggggagggggtttaactgaaatattgcgaacccgtctcaacatcgaatttgaccaccatttttttgcggcgctctttttcaaaaaaactttgggctacaacagaagggggatgggcggcgatgctgttgggagccgcgaggaaaatttttaatttattaacagatttttcctaaaaatacttatttttgcaattttgggacaattttttgcaaaaaaaaaaattggagttttggggggggggggg

SEQ ID NO: 33371 - DNA, 794 bp, Heterodera glycines
ccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagctctttctgaaaaaaatatttatgaaacaaaaaaatcgattttttcaagtgtccgtttagggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaacccaaaaaaatttttttggataaaaatatttaaatgactgact

SEQ ID NO: 33372 - DNA, 1206 bp, Heterodera glycines
tagagctcgcaaaaaaaaaggcaccaaaaatcgcgaaaaaggcattataataggcacaaaaaattaaaaaaaggcttgaaaaggcacgaaaaaaggtatttaaattttttattaaagatttttagggagaaaacacgtaaaacttgaccaaaaaatacttaattcaggtcatttcttagaggtgtattttcccgattttaatggattttttcggaaaaaaagccaaaaaggcaccaaaatgccaaaaaaggcatttaaggcacgaaaatcccaaaaaaggcataataaaagtcaacgtagaagcctcgaaccaagtgaaaattgcgttttttatgcttaatatatcgaaactaatacgcagaaaaaaaggcatatgcctcaaaatgcgcgctctagttattaaaaataaaaaatcgacacaaaatgcaaaattttgcataaatttcaaaatttcccccagcggtgcttagacttaccatactttaattttaccaaaaaaacaacaacaacatagagaatttttaaagcagaagagcaaaaaattcattttaattcattctaaattcaaaaagagaaaaaaagtgattccctaaaattgaaaaaatttttattttatctaaaaataaaataccatttgcttttaaatattatttaataaaactttaaaataaaactcatttagaaacctgataatgataaaatgaacacgattaattcacgaaagagagatgcgaaaacggtgtttatagcaattaaggtttgcaaaaaaacaacaacatattttattggaaatataatttaaaataattaaatttaatttgctctcatttttcatttcaactttttagaatttgaacaacaataatttggagaaactcattgaggtgatttccattcagtttatttatatttttttaaatgatgagtaggacgtgaattttaggttttaactattttttttttgctcaattgatttgaagaaaggagctcaaaaaacgcatttccgcataaaaatttttcgattctgatgtcattatcggtcactagaaatcactattttgggattttgtcactaaaatagtgaaaattcactattttggagttttgtcactattttttcactatttcgacatttttttggaaaattctttaacaaaaatgcaataaacccaaaaatacacccctaagaatcgacaaaaaaatttc

SEQ ID NO: 33373 - DNA, 289 bp, Heterodera glycines
aaaaatgcgaaaaatttcattaccgtatatttcatattcttatttttccttaatcgttaatggataaattttgaaaacaattcaaataaggcctttttaaaaagctcaatgaattggttataattattttaaaaaaattaatcaggtttaaaagcattaaaaatagttaaaaatgttattcttataaatatagatttctttttaggcacaaaaattggggaaatagaaatttgatgattcttgctgatttttgaaaaaatcctcaaaagtagccagcaataaactattt

SEQ ID NO: 33374 - DNA, 958 bp, Heterodera glycines
ttcaaatctagcaatggagaaacaatgcatctaattgttttatctcgagataaattgaaagatggcaaattattatttttccttagcttggtaataatcttaattgaatgttcaattcaataatttcattcaaaattatttttcatgttttctttaatttataatttattgtgttttaatttattctttcatgacatccgttgacgataattttttgtagttaaaaactaattatattttcaaattactttaagttgaatgataaacatataactgtaaatttattttttactttaataaaaattcatttaattgttttaaatattagtttttggaacaattaactttttattcgtttttatctaagtcaccttcactttctttataattttctattattattttctattttttctattaatttgctttatacattctaatttccatattttaccgtttttcaaaaaatataataataataataataagtaatcttttcgcaatacacataaattatttttaaatgtgacttcaatgttctgtgacgattaaaacagatttaatttttaattctctcttgttgattgcacgtgtgaaatctcatgtccgcaaattatgatattaccatccaaattatttaattaaaagaccagtcgttgctcattaattctataattaaaaaattatttatttaagcaatatttaatttctcatcatgggtatagaccatcatattttagtctttttttaatttgttttgttttacagaaattttttacaaaatactatttattgtacatattttatatatttatcttttatgctttccgattatttaaacttatgatttaatcaaatggttaatattaataaggaaatttacttactttttttgaacagaattaaattccaaaaattaagggcaataataaaaatgctttttttaatggactttttt

SEQ ID NO: 33375 - DNA, 1449 bp, Heterodera glycines
  misc_feature (17)..(17): n is a, c, g, or t
  misc_feature (892)..(892): n is a, c, g, or t
tctttttattttatacntttttaaaaatttaaaaaaaaaactgaaaaaaagaagattaattatgtaattataaattggtgctgagatggcagaaatataataatctgttaggaataataaaaaataaatacattaaaagcctgtaaaaagtggaataaatatttaagttccgcctcatgagttttcgcaaaatttatggcagcaaaacatactctccacgaggaggagtagcaaaatattcacaaaaagatactttaatatattatgtagttacatcataatatgaattctaaataaatctacaaaatattacaaaattttaattgataaaccttaaaaggcaatttttacataattttttcaatcgaagatgaatattaataatcttaaaaatatgtaattattaactaaatacaaattaaaggtattaaaaccaacctaaattgaatttaaattaaaatttcttaatttcgctaattctgaagcattttattaaaaaatagaataaatcaatgatgagcattacagaaactaaaattctaaattatatgattaaatatccaaaagttaaataatgtttatatttgatagtttatatttaaatcatttttgaattattgtggtacaattttattttgaactgcaggagtaatttacaattgcaaaaatcaacattaatccggagacaattttcaaaacaaattggcttcctgtgagaagcataaaaaaagtagatatcaacgcgagaaaataatacattcattatatattctaatgataaaagaaattgaagaaaatataataacttaaatttatcaaagaatcaattttagacaaagattttaaaaaacttactatttattttcatttttgctaaaagctatttatatancataactagcgggtgcgtgaaccgtcgttatttggctgggaaaaagcgcttcgcgctttgggagcttcgctacctagatttgatcgaattggttggagagatttttttgaatttttaaaaaattagtaggggtttttagtccacatcgaggctcaagacgggcgcttcgcgcccgtttttaaatttgttggccttggacgggcgcttcgcgcccgttattcaaattttgttggccttacagagattagaagaggtacaacagtgattaaaagacgtcaaaagtgattaaaagaggtacaaaagtgaattaaaagaggtacaaaagtgaattaaaagaggtacaacagtgatcagaagacgtacaaaagtgattaaaagaggtacaacagtgatcagaagagtacaacagttattagtaggtacaaaaattgtaggaatggtacaataaaacagtgagaagagtgattagaagaggttcaacagtgattagaagtggtacaacagtgattaggagaggtgtacaaaaattgtgaaatggtacaacaatggttaacagt

SEQ ID NO: 33376 - DNA, 1020 bp, Heterodera glycines
gtccaattaattatcggtatgtttggcgttcatttggtctcaatttgttgtttaatttgataatgctttaatatcaatttcatcattaaaattaattgctacaaattcattttagcatttgtttgggttgctaatctgttgtttgtgcttcatctcttctgctgatttgcggatgggtgaagatgaattaatgcgtttataaagaaagatttaattaatcccttaattaattaattgctaattcatataatacaattttgtcttccctcagattaaagtattcttttttattattattattaaaggtgatgaactcatacaaataacggatttattttgttaaaactgctgtatatttataaacaaaatgtaagccattaatcagttggtttgaaactgactagagcattgcgaaagacaccgaatgagagagaaaatattattgacagggtttgtactaaattctgaaccaaaaattttgggatttatttttctctccctggcttttcttaactttttgcactatttcttatcatattgcacttggaaatgcagaaaaaaaattggctttttgtggccatttaattctgcgtcgtaagtgtcgcttagattgtgaacgcaaatgtcatcaccatgcgacccaaccaatagtaattgccagggctgcaaaaaatatgcatgaaaagtggccaaaatatgcgcataaatatgcaaataaagtcgtaaaatatgcaccaaatatggacaaaaaaaaacttgaaaattaggggtgcaaattaatttaaaagttttattcatcataaattttgtcagttgtttttgcaattgcaaatcaaaaatttgtcaagattttcggcaatgaagctcacttttgacccactcgcgcatccatttaaatttggatttaattttatgcataattaaaaaattcttcctaaaagatatttaaatcgaaatatttgatgaaaaatgacaaaatatgcaaaaatctgaaatatgtacaaaaaatggcaaaattga

SEQ ID NO: 33377 - DNA, 903 bp, Heterodera glycines
  misc_feature (49)..(51): n is a, c, g, or t
  misc_feature (59)..(59): n is a, c, g, or t
cccccccccctcccgttggtgtaaagggaccttaactgtgatcatcaannntttaattntttcgaatgttttttcggcatttcactaattactttcacgtaaaaacatttggaaataaatactttgttcctctttcttctgagaattgtcataaaatttaactattcgctaatccaacatataacccctttccaggtccgtctttcgccgtctccgccgccccaaaaaaagccaacgaaagtggccaggcaattaaccttcgccagctcagatcgcacgcggacatcgaagtggatgacgaggaggaggagaagaagaacagacggcccgacgggagaagacgcaaagtgccaaaagtggtgagaaaccagcaaaattccaaaaaatttatcaaaaaatatatttttcccattcgttcgtcgtgaggggggggggtcgaagcgaagcgggaaagagaaaaaattttaaaatttgaacaaaccccttagcaaaattcatttaaaatttcaaaaaaaatttccccagcggtgcgtaaaaatcctaatttttcttttagaaaaatacgctcaaaaaattgcaaaattggttatttattggacaaaatctatttaataaatcgcaataagatttcggcccgagataatttccgttatttttcagccccgccgttgtgataaatgcccgatggaaattccacgaagtgtggaagcttgaacgccattacagaacacattctgacttcaaacaattcaaaggaagtatctaaaaaatgtttatttttcaaaaattaacaattaatttttaagtggggatttgtgtccacatcgaacgcattcaaaaagcccactttgaagcgccaattgaaccttcatcgctcaggggaaaaggggtttcttttttttc

SEQ ID NO: 33378 - DNA, 1352 bp, Heterodera glycines
taattgctcaatatctggggagaatggccatccaaagcttagtgcgtttctgataataacgtgcgttttcggctttgatttgcttatcgcacgaagtctccagcttcgtaagaaagtcactttgcttcttatggcttggccaagatcagcaacctcatcaagcgcacccgcagaaatatttcctaaaaaaagtatgcttaaaaaatttccaacaaccaaacccttagaggtgcagtccgccttcatagtgttaaggttgtttttaagttgcgccaagcgcaatttttcaggacgaattttttcttcgttagccatttcatccttaaagatggattgagcggtgaagaaagcatagcttcatccaaaattgattgatcgtctaaacagatttaataattactaaagtgtaaaagtaaaaaaaccaaaaactaacgcattttttgtttttttggaaattcgtacccacttgatgcttctgtttctggattaattttttcatgttgagtcggcgaatcagcgtctaacaatttgcttatatcaattagcaaagctttaataaaaagtaaattacaaattatctttcgttagaaaaaatctttgataatatgtgcttatataagcataaaaaataaaaaatttccaacattgtttgatataaacataaggtagtgtaatgaacaaaaattaaaaaaacattcaatagaaaaaataacaataaaatcaatcaaaatatccaccaaaagaacaatccaaattttccgagtcagattcggcaacgtgcgggtcagtgactaaatccggttctttcgtacccacaattggtctgcgtgttcgatgagtcggcataacaatgttgtcaaggtcgagcagttcatgatagacaacgttttcgataaaaacttcggacccactttggcagaaaggcgcgaacacaggtatgccgtccaactgtgtcactcgggacatggccacgtagacctgaccatgcgaaaagcattgccggccattgagcacgagcgccattcgctggagtgtttgaccttgtgcctaaaataaaaaagataaagtaatggcttttcttaattttaagactttattgatggtcatagcgaaacagagacggacaggaaactgcaaacggcggaagcgtaacccacgatgatgtcgggctcgcccgtattcagattgaatgcgggggatagcgatactgctctgcacacccgcacgaggtccagtcaagatcctgcagaaaaggttgttctcagaagtgctcatcacttgaatccgagtgccattgcacaggccctgagtcacatccatattgcggatcagcatcacaggcgtacccacct

SEQ ID NO: 33379 - DNA, 1164 bp, Heterodera glycines
  misc_feature (170)..(170): n is a, c, g, or t
ttttccctttcagaaaaaataatttacatttcctctctcttcctcttttcttttttctcttcctcctctcttctttcctctctcttccattctcttcacttctcttctttcctctctcttcctcttttctttcctctctcttccattctctttacctctcatttcctccncctccctttccccgctccgtcgatcagtgctctccgtttcactcaaaaattaatcgatcagcaagcagccgccctccgccggtcccacttaattgttcctctcttcagccttcctttgatgaacgtgaatttaagccaaaacaaactttagaaaaggaaatgaatcaaaaaatgaatgccaaccgaacataaattaaaatacatcatttaccattgaataccataataatgataataataatcatcacatttattcaatatttaccatttattttgtaatccaaatgtcacactttatatcttatatcctaaacaattgtctctcttcagtgggcggttctttgatcacccccttccacctttgattacgcccccggggactttctctcgatcacttcataatcatcgggcctctcccccggcagtctctgctcccgaggccgaatcgggaagagggcctaagcattgtatccttaccccagaataaaggcgtactgttgcatactgtattaagggggaataaagggatacaaagggccctacggtgactcaggacattcaccatcattcattatcatatcaagtaaaataacacataattagagagaagcatttgccttgaattcctttccatctccgccgaattaaacaaagcaaaatctgaattcggacgatgccaaaccccggcaattgctcctctacgatgtcttcctcttccgccttctcttcttcttcctcttcctcttcttccgccttctctttcattcctcctgatgaaagagacgaatgtcggcgagaaaatgtcgcgcaaagtaagcaaaaacgaggcatttcgccaatgtttcggtcatttcatttgcttttaaagttgccgcccgactgagccaaggagaggatttacgactggcgatgaaaatgcaagaagaagaatatcagtcgcacttttccaaaaccgaaccaacgagtgactgttgcggaggatgccaaattgagt

SEQ ID NO: 33380 - DNA, 485 bp, Heterodera glycines
tttttaaagaaaagaacaaacttcgcgtgctttccctacccactgaagtcgtatgttcggaacgctgatgtttggcagacaatacattcaacggtgacccgaacagcatgatgccgaaacaccttgtgtggctcgactttgttcatttggtgtgccaaaatagatgcgtttgtgcatatgtaatttgtcgacaaatcgctgtacatcgacgcattgtaccactgggataacgaagccgtatccggattgctagtgtcagaggaaatagaacgagaacgggccatttatcggtactaattcagtttgtgcccccttttgggtcgaaatttttcaaaaattttttttggtttaaaaagcctgaaaacaagggtcctggggttttccaggtcgctgatacgaatatggcatccatttcgaccgatttctaatcccgaacccgaatttgaacaaaaagtcgaaatgtcaaattttcgaattttgggttt

SEQ ID NO: 33381 - DNA, 931 bp, Heterodera glycines
agtgaagcggggccgggacctggtactgaaaaaagcgggacaactgagtaccaaggtcccggttttgaccatttttgaccgggaccgggaaattcccgggttttcccggtttttcagccaaaaattcccgggttttcaacccgaaaaggtcccggtcccggttttgcccaaaattcccggtcccgcttcactttattttattctaatgcactttgactaattttctagcgttttctattatttccaatctaataaattgaaaatattaattttcgactttttgttgagtttcgggtcagggttcggattttccgaaagggccggcgaaaaatcaagataaagatttttgtttaataaacatttttttttttgataattggctttgcataaaagcaaaaaaaaaattataaaatatatttgcatgcagaggattcgaacctgggacccaaagaagtctgactaacgcactacatctacaccaaagtccactgacaaaataaagaaaatgattttcctttactttcattataaaaagctaaaaacttccacgtcataactcggcactcgtgctcattaacagaaactaaaaattcgggctctactgataaataatttcagaaatttggtattatttgaacattttagtttttttttttttttgaagcagaaatggaacttttttttcaattttaaatttgaaattgcaaaatttgttcaacaaaaagtctatcaaatttcttagttctttcaccattcattaaaattttactacctagacttcgaaaaaatttaaccttatacccccaaatttacagacaaaatgatattaattcacaaataaataaataaattgaaatgcaattaactaatcccgatttactccaaaaataacggaaataataaaataaatggacaaaaatatacggaaaaa

SEQ ID NO: 33382 - DNA, 504 bp, Heterodera glycines
gccccccccccccccccaaagccaagggtctggctacgcctttgccccctaggcattcaatttttcatttaaattaacaaaactgaggcatacatagaccatgaggattaagattcaagaattcgaaatctcaacttgtcctggtctttttttctaaatccttttatgaaccgaggccgagagtctcggccaacatagatttatcactaaaattggcatcatttttttttaccaaaaatttctttcttctttggcacgaatgcttttcccttttttaatgtaagtttttttttgactaacataagctcttccaacaggatttaattttacatttatttatttatccatatccatctcccattagaactttcgcttcttttcgccctctgaaattgggtgaaggaaatcaattttaatcgccgccgaatttcggaggcatttccatcgccgccgtccccccgggggcggcggcaaaagtgaaagccgagcaaaagcaaaaagtac

SEQ ID NO: 33383 - DNA, 1035 bp, Heterodera glycines
ctccaccatctcccacactaccacccgtgtacaacgaccaggcaatccccctcctccgcgtcgttctatacccaaagttgaactaaaaagggatccacaaccaacaaagttgaaaaaatccgattcgccaccgcctccaccattgcctccacatcgcgcaaagagagagccaaaatttgagcttgcccctcctccacctcatcgcaatgtctccaaaagggaaccgaaaattgaattagctcctcctcctccacctcgccacatccacaaaggtgaaccaaaacttgaagttgacccgcgaccatccacatcgaagcaaaccgggtacttcccacccccgaaaatcaaaaccgagccaaaacatgagttgcaacctacaaagaggccagtgccataccgtatcccgaaaaaagagccaaaaattgaagaaaagccattacagcagcagcagcaacgacctcctcctcctccagctgttgtcgtcgaagaaatgccctatgttcctccacctaggagggggaccaaacgcacctacccccagaatgatgatgatgaggtgcacataagaaaacgagtgaggcaaccgagaagggtaagagtacagtactcgcccgagccaggtccatcaacatctgcacaacgtgatgaacaacaacaacagcaacgtgagctgtttgctattccgtcaaatcaactgaccatgacacagagaatagaacgattatatctcaaatgtaatcattatgctgaccgtatgggtgttcggatgaatacaattaacaccgcaaacggcaagccattggcgcatagcaatttgcgaatggccatcaagtatataatagaccgaagagcgggccgccccaccattaaaccaccgggagcagatctattggaggagcgggttaagcgggatcccattttgtattcatggacggctccaccaaagagaccatcacagagcaaaaccacccggacggcacgggcaatcaagaaggaagtttcgcccgaaaaaatgggagttgatcaacaccactc

SEQ ID NO: 33384 - DNA, 843 bp, Heterodera glycines
ttggcgaagtttatttcaatgagcatctattttgtgtaaggcacaaaagaaatgattttttctttaattaaaatttacacagcatggaaaacaaaaattttataatcatttcataattcaatttaaaatatcatacaatagaaattatttttaaccttttaatttgcttattcattacttttataaaataaacaaattattatttagttttttcaatttaaatccattttgatattattttttataaatcgcatgtgattcccttttaaatttttgtaaaaaagcccaacaaataaatgctttgaccatccacaatttgtttacacaaaatgataaacaaatgaattttaaaatcaatttttgaaatcctacttttagggatgagcttttttttaaatttcatgaaattcggcacgattctttgaggattcgtttttgataggtttaaattagtgaattttacgaataacctgaaaatggataccaaaaatgccaaaatttgcgcaaaatataggcaccgaggcataaaaaaatttagttgaaatccaaaattaagttaaaaaaacgcgtcacttttcatgctcaatttataaattttcatcaataaattgctcgttttaatgatcaacatcagtagtggaaaaagaaagaagaggggtctgggggatacgaaatatatggaatattgtgggggattgagggtgtgccaatgatgtgttgtccaagtgttgtcaaaagttgggataaatatttattaagaagtaaattgggaaatcggcggaagaaaatggagagacgatataaaattaatgaagaactgtaacagaagattaaaatataaaa

SEQ ID NO: 33385 - DNA, 111 bp, Heterodera glycines
ctgttccgcaactgccgcctggtcggccgccgcttccgcttggcgcacgtgatgttcgggccggagatcatcgaagtggccactttccgcggccaccacgaacaaaatcag

SEQ ID NO: 33386 - DNA, 520 bp, Heterodera glycines
gaattttcgacttcttattcgagttcgggtccgggatttggaataggccaaaatgagtgcctattcaaaaatcatcgacccaccaaaaacgcccagtaacgtgtttgacgacttttaaaacaaaattttttgaattttattgtgtttaaaggccccgaatttttaatttttccgctgcttattaatttttactatgaaatataaattccattttttttcaattagcccaattttgaactgtcctccttcactttggcacgtgatcgggcacgccctttgctgatggagttgaccattggcatcccggccatgtccaaatgtgttgtgaatgttgattatgaagccgcttttcttaggtgtgtaccacatggaagcgaaattatacatgccagagatgtcggaatgcagatttcgggcattttgggctcagagttccgattgtcgaaatttttagagccatcggaattttccgattaccgtaatctttggaacggaatttcgattgtcgaaattttttgag

SEQ ID NO: 33387 - DNA, 930 bp, Heterodera glycines
gtctgcagtgggagttgggaacagaaaagacggacaaacaactaaagggcgcaaatttgctggctttaggccgtacatcgaagaactcaaacgtcgtctgacctccgttcagctgttcaccatgaccaattcatattcctcaattggactctccaaattcgcacaattggtgggattggacgagtcgagcggaactgtgcaagagttactccaaaagtgcaattggactgtgtctgaggacggcttcatttctccggtatcacacaaaaatgattttatcggttccctttaattatttttgggaacgcagcctttaattgctattaaaatgcgccgacactgggaatatccatttgattttaaggtgcgaaacgcagaattaatgcaagccattgaaagtctcaacgacgccaaatttggaacgggtttcgatattaagtttgcggaacggggtgtcggtggagcgaccgaatcggacagcaatttcgacaacttaaaatcattggtatttttcagaacccattcatttatcaaaaaagtccattatatataattaatttcacgatttgttaacccatttttggctaaaactaatatttcagatcgattccacaatgttcttcgatgcaatggccgtgcaatagaaaattaattccgaatgtttattccatttgcattatttattggtttttccatgaatggatttaagttaattacatgaaaaataaaacgaatagctttagtaaagattataaatacatgtaaatttttgagcgtatgaaaaaggaaaatacaaaaaaaaaatttagttggtcattgtgtttttcagaattattccctgggcgggtttttggggaccgaatgaatataatcactggatttttcttctgccaattgttgcaaaaatctccaactaaatgtaaacatgag

SEQ ID NO: 33388 - DNA, 156 bp, Heterodera glycines
ggttgcatctaccgattcatcgacggcagtgatgacagcgccaacggcgatctcacccgcgtctttacccagcagataaccaccgcccggaccgcgcacgctggccaccaggccgttcttgcgcagacgggagaataattgttccagataagagag

SEQ ID NO: 33389 - DNA, 1624 bp, Heterodera glycines
  misc_feature (10)..(10): n is a, c, g, or t
tcatattttntggcggatcaaagtgagcaattcatgacgctgtaattaaaaggtttagataaaatagattaatttttttcttggcattgtcgcaagatttcaaaatttaggtgcaattaacaacagaattagctcaaaattaatcaatttgagggattattagtgtaataaatagatgttgcgaccggaaatttttaagtcgcgatgaaaggaggcgttgggaagaaaaaatcctaattttttgtttttaaaaattatttatctcaatactaatttggcatacctaattttgttgctttttggataaaattttatgcgatttacacccctaaatttgtaagttattaataataactattttcccatttttagcacttatttttgggtgttttttagaacctaaaaccaattattttggcagtttttaaacattcataagtagagaaagctatcagcacttgtttttaacaatctatggccctgcttttagtaaacatcataaagtgcctatttttgggttttggcatgtaaaaatctatttcggctttttaacatctattttcgcaatttttgaagaaattcttaggaaaaaagcaataaaaaaatatttttactcaggcggcttggcctatcggcaccctcgaatcaccccgcccccctcccaaataacataaaattatttttaaaaattccccttaaatcgaaaaaattcctcattaaaaattgtgtttaattttgctgccaccgcccacgtgcaaaaaaaagttcaaacgccgtggaaaaattaaagtatttttggggatggtttttttgtatttttatcgccttttaacccatatttgagatatcttttaattttatttgataaattaaatttttttattttaaattattaatcataattaaatatccacacctgtacgagtgtcaatgtgctgatgagagtgataatttgaatgatttggtcagaatcaccggcacgggctttttgaattttttgattcaattcctgcgcaagtgtctcctttttagcagtgaaatcatctgggaatttaaagttattttttaatgcaaaaaatgatttttatatattttttttcaccggagtcactcgttggcgttgtgtattcaatgcgaattacaaagtcatcggcagtggctgcgtcaccaaacacggcacggaacaattgtgagggctgtcgcggcgcctaaaaagatagtaaaaattaaatgatttaaaatgtcttaaatcgtttcttctcacctttcctttcccttgctctcgaatgaaattaactttgacttcagtgaaatttgcatgtcccacattttccatctcgattatgtcgatctgtttgaaatttattagaaataattaattattttaattaattagtagttattaaaagcaattaaattattacgcgttgcgcgttgtacggaattgcgtccgggcgtcgttcactttcctccgccccgcagcgaaggtcaactccaattttggtatcatcgtccaatgtggccattccgctgatcagcacttggacatggttaacatgggcacctgagaaacacatgaaaaaaatattaataaaataaaataaattaaaatagaccccttgaa

SEQ ID NO: 33390 - DNA, 872 bp, Heterodera glycines
  misc_feature (842)..(843): n is a, c, g, or t
atgataggtttttgcaatttttagagaatttttttaataagatttacgaatttttgggccctgcgatgccgataggcagcgccaggcgaattttaaaattaaaaaaataaattaaaaaagaaaccatcaaactgaatcgaactcacgacagaaagtaatgtcaaggttgattcaccaaccactacaccacactacacatcaatggccaataataaaattaactttaattcataaaaaatttgtcaaaatggttaaaaaaatcaaaattgtataaattttttgccttttatccatgaatatgtcattcttaggggtgtattttcacccccgcgggggtgaaggtcgcgggggcgagggatggcgggggtcagagtcgcgggggcgggggtgaggccaaaaaacctgtcccgcccccggcgggggcgggggtgacgggggcggggtccgaaccctatttttaactcataccgtactttctctaattatatgccgggtattattatttttcaacctcctcagaaagggtgagaaattggagacggggagattaagaaggagaaattatttttcaacctatttctaaaaagcgagataattggagatgggtatattaatggagactggcatataattagagaaaatacggtaattaaaatataaatttagtattttaaatttaccttggatcttgaacctgttcaaaaatcagtttcaactcttttcccacgacttgttttttataatcgcttctaataacttatttgacccctatatggctttgtctaagctttcgattcgattgataccacttttgtcctgaaatctcttctacctttgcttgnntaaagttttttaaacaaaaacgcatgaaa

SEQ ID NO: 33391 - DNA, 1141 bp, Heterodera glycines
gaaaaagctatggtgcattaaagttgcaaaaaaaagcttatggtcgtgtgaaccgcaatagagtccaattttttgccatttttatacgtccgatttatttaccgaaattgagaggtttttcatcataaaatttaatttgatcactgatttgaattatgatcggtcggtcattcttaaataaatcatttcttcttctgttgaccactgtttttgctgggcccaccactcattcattgtcagaagacggcccctttgtgatgctttgtccagtttcttctgccggtgaaggagacaatggcctaaattaggcggaattttaattatttaaacaaaattaaatgcctttttttaattgctcacccaatgcaattagtgtaactattaagccaaatgaacacattgttacaactgttgccccaattttcatctttcttttgctgctgaatcgccgccgtctccccaataattttgcatcgtttcattatccatcggttgtcccatccctttgttttggccaatgtcagcttttcctttgtccattcgttcaccaattcaaatggcacaatttgcattgacggcacaggaacagaaaaattaaattggtaactgacggaagaaatggcattggcacggagaaaatgctaaacaatttgaaaacaaaaatcagtgatttgtcaaaaatgtggccactcacctccttgaaattgttgatccaatctaagttcggttgttctttaaagtctttgcaacgcaatcgctttggttggccatcgtttctcggagagtgcaaccatttggacaatgcttggccagcagaaattgttgaatttggcccatcaaaatcatcaccaaacgcagcaggaaaccgaccatataaattgattgaagtcaattggttgagatcagtgagaattgtcggcgtagtgcgacgaagcaaattgtccaaaccaacagaatcgtaaaagtccaaatggtgaatattttccgaaaaaattggccaaatttcgcgaacaaaaatatcccaaatccgctggccatccgtgttgtgtggtgatgtaatccacaagtctaaattggtgcctcttttgtcgaaaatttggtgatttgaacgaagaaaagcgatgacggagtgatcgatgta

SEQ ID NO: 33392 - DNA, 800 bp, Heterodera glycines
ttttcaaatcgtctgctcagtataatataactttttctttgacatttatttattttgataattaattttttaattatcgtcttgagttctaaattcgaaacatatgaaaaatttcctaaatttttgcattaatattttatttattaaatttaattcattctctcggctgtccttttcaaaaattaatctttgttctttttttttctctatgtatccgatggaaacaaaaatgtaaaagaaagtgaaaagaaaaggtcttctcttactctacatactcaaatttccttctcccacaaattcctgcaaaaatttttgcatttccctcacaaaaaaatttttcgattcattttttttactttatttttttcattttttgatttaatttaaatttttaacaaaattcgtattataattgattcttggaaaaatgcatatatttttaagccgggaagtgattggggatcttgtcgagattttcctgcgggatcttaaaatcccgatcccgaatgtttttgacagggatttcgggatttgaccacggtgtgtccaatcctggcctggttccccatcccgaatgcctgtcccggtccgactttttcaaaattatgcgctttatagtacattttttgattacatataagcctttatcctatccaaattaaaaaaaaaatctttttttcaatcaaatataaaaaatttccgctgttttcctgtggtggggcgggggccttggcttgttccatgtgaatcaccaccacccacagccagtcatcagccgtcccctctcgccatttttttcc

SEQ ID NO: 33393 - DNA, 659 bp, Heterodera glycines
  misc_feature (71)..(72): n is a, c, g, or t
  misc_feature (85)..(85): n is a, c, g, or t
aggtcacttctaattactgtctgttggatttttagctccccataatcccataaggggcccaaaaggagagnngaaaaaaaggagnaactctttttcgggggagagcccccgaaccgaagcgcccagaaaaaaggggagaccgaaacccaccggaagagcagccccacagacaggaccgcagacccgcgccggagcgaagcaccccacaacaggaggaggaccccaaacggacacaagaaaaaaacgacaagccagggagcggggcaggccccccgaaccgaagcgcccagaccgaaggggagaccgaaaccaaccggaaaagcaacccaaaagccaggacaagaaaacagcgggggaaaaaagcaccccacaaaagaaagagaaccccaaacggacacacgaaaaaaacggccaacgagacggcggggcagaccccccgaaccgaggcgcccagaaacatggggagaccgaaaccaccgggaacagcggccccacagacggaacagaagaacggcaggggaggactgcaccccacaagagagagagaaccccaaacggacacacgaaaaaagcgatttttttgttttcggggcagttccccccaaccgatgcaggcagatttatggggagaccgaatccttcgagaataacttccctat

SEQ ID NO: 33394 - DNA, 904 bp, Heterodera glycines
agattggatcgctgagaagatgggcactctttgggtggtcgacggctcgacgtcactcaatgaaatcgctgacgcggaaacgattggccgaatgcagcaacgcattgttcgacccgctgtgtccgcctacccataaatcacaactttttagccgtggcgaaattctctcatcccgttaatggtcggttctgcgattggtggcacctctgctggtgcttttgcatcgtcgtcctatgtgagcacactgtcacttttctcaattcgaattccctttttccttaaggatgtgtgtccgggtcaggccctgcctctccctccgtcccattcgcagcatttttcgtccgcgaatgcgcccgttcctccgcctccgtcgacccatcgtccgctgctgttgagcgacgattggaccgacgagttggacgacccgttgcgcaatgctgcgtcatgctccatggacatcagtcgcccttcgcgtcttcaaccgcaccattctgttgatgcgccgcctcccctgcagcaaaagacgaacaatgacgcttttttgtgtccacctccaacgcagtcgaacagcaaaatgttggtaaaccatcagcaaatggctgaagaacaacgccgtcagcagccgcagcagcaccaattgttgtcattccaagagggcgacacgacggcgaacaatcgcgagaatgtcgttttcggttaacccatttaactaattctctttttgtccaaattgtaatattcgaccgttcaggaaatctcgtcgcgttgaagttggagtccatccacgcccgcaatgcgaacgctgcgattcagctacagaaggcaatcatgggagctgtgcagcaattttgagctgaaggtgctcaattcgagccaatacaataacgagcacttttcggaactg

SEQ ID NO: 33395 - DNA, 436 bp, Heterodera glycines
cgtcggtgtctcctctcccacgcccattaatttctttcaaatttttggccataccaaacaaaccaacagcacaaaacacatagcatacttttatgtatatttctcattatatcttaataaataatggaccctgaattttcatttttaccgattttgggaaacggtcaactcaaagttactgtaattgtggattgccttagttttttccccgcctcctcagcccgtccttgtccgtcttattctgtctgctactgatctttttgtgcttgtttcttttcactctgattgtaataaaggtgttggttagtcccataaattgtccaagcggcgctttatcccccccccccccccggggtccaaaaacactcgacgaacgaaattgggtgaatatggcgcgtccgtcggccgtccacgcccaaatggtcgtccccccccc

SEQ ID NO: 33396 - DNA, 515 bp, Heterodera glycines
atttttggtgaaaagatctgccgagtggcagaattgacgccaattccaacggtatcgccaacaccgtaggaatgtttggcattttttttaatttctccgttattccgagccaagccatcactatcatacgcagaaatgctttcatacatcagccgtttgacggtgaatccgaagaaaatgtaactgaaaaacgaaaaattaattaaaaaagaatgacaattaataataattaacaataattttttaatatttctgatcattgaacattcaaaaaagcacttactttttcatatttttgaccgaaatttcgtaataaaaaatgttggacgagttattgtttaataaaatcgaatattcaccaaagacaaaacaccaaccttttgatgaggaaaaaaagattaggtcgtatatatattattcaaaataccacaatcatttttcttgtaatggacagtcaaatttttgtcgccactgatttcgagattctcatgacaatcattggcatcccaataatt

SEQ ID NO: 33397 - DNA, 1149 bp, Heterodera glycines
aaaaatttattcatctcccttttggatagaaaaagcatcagagtgcctaatctagcatgtaaatataatttggtgcgtttcagagcattttatgaaaaaaatatttatgaattaattatgcaaaaataaataataatttctaacagttagttcgtccataaataatttgtaattgatcaggggctcaccaaattctgcagggatacgtatcggaactctgcaaatgctttctaattttcctagatttcttaagcccggtgaaaattttttgcagacagcaccacttttgcacttaaaaaactttcaaaaatctttaaaaattcatagaaaatttaatttcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggcctcgtggtgggccttcccccccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaaatgggtgcgctttagagcactttctgaaaaaatatttat

SEQ ID NO: 33398 - DNA, 1627 bp, Heterodera glycines
  misc_feature (1583)..(1583): n is a, c, g, or t
tgctcacactttgcctttccgcctcaaattcgtccctccttcgctttgccgcaatgttttcgtcgtattccgtccgcttttgctcatttttcagaaattcgtacgcttcgtacacccgcaaaaacatcgcttgcgctttctccgcattgttcgggtttttgtccgggtgccatcggagtgcttgctttttatatgctttgtcaatttggccgggctcacagccgtgctcaagttgaagcactttgtatgggtcgaagtcgattttcttgctgctctttgccatgaaaatgtggagaaaaatcagagaataaatgctaaaaatttggatttgcaaaatgagtttttccttttttaatttattttgaatacctaaatgttttaattggataaatgtttttcttaattaggcaattaaaaaaagagattgcttttcacttttcattcgttcattggacagaaaagtcgcgcattaattcaatccctaaatccgttgaactatttaactgactttgttctttgactttactatttttgcatttgattttacctaattttggcctcccctttccttcctttttcgcaaattttctcggcaagtcaatcaaacaaataaagaaataatcctcacattaatcaattctttcattctttgcatcccaatcgttcacacccattacattgcattaccattaccattattcattttcattcattcattcatttcccactaattcagctgatgggtggggggagggacagagaaaacagaaagacgacgagggaagaaacactgactaaactgacgtgtccgtgctccccatatttgattttggattggatgtgtatcatgtgaaggaagggaagggaaaagcaattgccaacccacccaaaaatgttcaccgatgcattcccattccatcactttacaatttttacaattcatttcgttcgtcactttacaaatttccattttcatttaggaaaaagataaaattaaaccaaagaaaagtcgtcaaaatgtccgatccttgcgagtgcgtctttaaccatgaggtggcgccgccttctcttgcacttcgtttttcaattcttttttcccttggcaggccatcatgcgccgcattttgtccattttgcaggaggcccaaaccgattgcactgacacagtgagtaaagggagaaacttttcgacggcatttactcatttttcaggagtgttccacgagcactggcggcgaccccacgggcactgccgggtccaacgttctgctgattgccatggcctggggactgtttgccatgtaattccattttatttgtcatttccagggttcctctcattttatatgttcttccattttaaattcattttcgttttaggcttatgtttttcatgcggcctgcttcgatgcgttccggcggaaacgatcgcgaaaatggccaaatcgcgggcaaaccgtcgtcagcagcgaacggacacaacaacgatgtgagagtggaactagtaactttgattttggaccggaaatattagggaatggcaaatcggctgttagattcgtgaccggcggtcttgaaatggntctaataatttagttctagtaaatttttttaatttaccgaaatt

SEQ ID NO: 33399 - DNA, 930 bp, Heterodera glycines
  misc_feature (823)..(823): n is a, c, g, or t
  misc_feature (883)..(883): n is a, c, g, or t
  misc_feature (911)..(911): n is a, c, g, or t
atgtggcggagctgtcgttgcgcaacgtcgtccgtgtggtgggcctggccgacccggtcacacccgtcagcgccattctgcgccgatgctccgtcaaaacggtaaaaatttatttgcaggaactgccggactaccattttattatattttttttttaaatgactcaaaaatatgtcatttttgtacgggcctagggggggggctaggggtattgaaaaattttcgatgcgcaaaaatggtgattttttcccttaaatttttaattttttttcacaaattatgcgcaattgaagaagttttttttttgattttagcacatttgttgactgattttggcctaaaaagactaaaatttggtggtttggtcatttttgaaataaaaaatctgatgggtaaaacaaattttttcttggtacctctgtttttacaaaaatttatcccccattctcagctgatgctccactatggaattgccgaatttggtgattgtgaccaatttcttgcgcatttgtcgcgtcgttttggtcgactgaaaaagggcggacggccggaccacaacgcggctgcacggcaggtgttttttttgataaatagtatcaaaaatataaattttcttaattcaaaattttacaaaaaaaacgaaaaatttaatttttacttttccccctaatttagttttaaagtgcatttattttgtccatcatattttgttggttttaacaacaaatgtataaaaaatggccatgccatggtttagaattgtctagttttcgaaaattttgaaaaaaaatcaaaaatattccccaccccctcccctctttanatttcagtgtttacgattttattatttttttaattaatcaaataataattgcccattttngtagggtgttgacggactggaacagtgncaaattgcgctattacacg

SEQ ID NO: 33400 - DNA, 949 bp, Heterodera glycines
acttggcgcaatgtcgcaatacttaatgattagggctgttaatggattaaattttcactccatatttggccatttattgtatgtaaatattcgagataatgaagtcagtttatccaagaagaaccccccataaatccttgaaaataacattctgaatgtatcttatcacttatcatcacccattgacagtgcatgcgttcacggcttcttcttcagcttaagctttgcctcctcacatgggtcgggcaccggctctaattcctccgggtgctttttcacaaattcgtcatgggttttgtgcttgtacagccaaatactgatgcccaattttttttctatcacgcgaagtggtgatgcggcccgcttcttttcctttttgttggcccaatgccataaatcagtggccaacctcttagccgtccatacaaattttggcatattttcgcgctcattattttctttctcaaaaattttggctgctttacacatcactgccatgtctgtgcataattatgcgtctttattttggaataatcggttcctcataaacagggaacggatttatatgtttttagatattttttgcgcatgtgctatcgcatgagaagctcaaaacatattttggggttttggtagtctttagcacatattttggagattttttggaaaatattggaattttttgacaaaatcttatttggcactcaaattcttggccaaatgctcaaaattaatttatttgtattttttttgaccttttcttgacttttttcataaggcaaaacatttgaattttcgcgaactatttcagaaaaataagtcaatcttagagagctaaaaaaagtttaaaccaaaaagcattgaaatgattttgcttgcatttaagctagcgaattgataaaaatgagattttttaaaaaattaactaggattttgaccagttttttca

SEQ ID NO: 33401 - DNA, 697 bp, Heterodera glycines
aaaaaatttttgagaaattttcagcgattttttggaaatttttttgtagtaattcaccataaaatttctcaaaataattttttttcttagaattttcctatgaaaaaactttctaagatttttttctgaaaaatttctaagttagcaaattttttaaaaaaaaatttctcgggggggggggaggggctcccttcggtgaggaaaccaactgatccctaaaaaatagacgataaaatattataaattatacactaatttacaagtgaaagatgtctagtttgtgtgaatacatgtatttccagggttctccccttcctaagaattaggaaaaggactgtctttttggtgcatgcaatctttagcctggactaggtaggatactatcttgatacatctttggggataatatacatatgtggtacatattttggactttttcggactttttcatacattttttacatattttgtggattttttacagaaattttcggaaattctcaaaaaaaaaatcaaaatttcggcaaatttttcgtacataatttcaaatttttattgcatattttgaggttttttgaaaatttataaaatttcttgtgaaaaataaaaattaaccaaactaatttttaacaatactaaaatgtgattcctaggcttatttaggactttcttacggtcattcgcgcccatttcaccc

SEQ ID NO: 33402 - DNA, 789 bp, Heterodera glycines
  misc_feature (353)..(353): n is a, c, g, or t
  misc_feature (441)..(442): n is a, c, g, or t
tccccccattaattcctgtggtagaaaatgcaaaaaaacattttttaaaaacttcaggcgaatctcaaggagcttacgcagctgttttccgcatttggtgaactcaacttcatccgattaccaaaaaaggtaaattcagcaaaataaaagggaaggcaaaagtgggaatttttggtttcggagaattattatgtgcctttttggactgtggcacaattggctagaaaccaaatattttggaatatccaaggcatacatttggatatttttaaatctaaatattttacaatattaattttcttctggccctcccccattcaatcctttttttattcagcctggctccgaaggcncaccgcggcttttgtttcgccgaatttctctccgtgagcgacgcgcaccgcgccatggacgcgctggtgcttccacgcattttacggnncgacgggtggtgtgtgggagtgggccaaaccgagcgaagaaagcgcggaggagaagcgacagcgaacgcaggacagaatggcaatggccgcgggcgttgccggggcgaagaaaaggccgaagatgcgatcattttagagccagtttcaagaattggcactttttaaccgttaattacattaaaatggtccgtccatcttgcgaaaaaatgttgttactgttatcttttggtcatttgtttttataacaatttacacacaaaaagagatcatcaccaatttattacaatcaaaaactggcttattcaatggtacacacatgattttcacacaaaaatgcattatttca

SEQ ID NO: 33403 - DNA, 753 bp, Heterodera glycines
ctcctcttcgtcttcctcctttttcttctcctcttcgcctccctcctttttcttctcctcttcgtcttcctcttcctccttttccttcttccttctcctcttcgtcctctcgtcgtccttttccttcttctcttcatcgtcctcatttcaactccttttctccattctattcttctttgtctacctttttctcccacccactcttcacttccttcttcccattcttctttttctctgtcttcctcctccttatccttctctctttctctctctctttcttatgttcctttttttctctcttctcctccttttttcttgatttttcttcttgcttcttccttttcccccaattaaatgaatgtcatcgctctgtccgtcctgcgcattttgaccgccatttcgccttgcggcgattgtccaatcgatcagtcgaccgattgaaaaatgaagcgttggctgatcaattcaaagccaaatcacatttttattttcttagcattttcaaatttcgactgatttattcagaaaaacttttgcgtgacaaacactcaaaaaaaagggccaaaagagaaaaagtgaggggagagaaggaaaaggagagcaaatgatgagagaattgcaaaaggaaggcaataaaggagaaatgagcaaaataaattattaaaaataataaaaaaaaatatatatatgaaaggcccgggggaatttaatggcaattgaaaagacgcgaaaaaacaaaactaaaatattcta

SEQ ID NO: 33404 - DNA, 1135 bp, Heterodera glycines
gcaggtaaaaatcagtcatctcttcagtgagcggtttagccattcctcgtatttgcattgttgaccaagcattgctcgagcaaaagtgccgtaaatttggttgagcgatgtacgtccagggtagtcaacgtaaatgactggcacatggcgaagaaaacgtgcagacaatgggtttctgcccggatcagttggtggattgcatgccccgacgaattggatacgctcaagtgtcacccaagtgcggtcgatcgtgcggtagaaggccgggaacagctcggccgccatgcgttgaaggcgtacaatttgttcagcctatttcagaaattgagtccaagtttggtcaaattaacacttgttttggtattaattgagtatgtacacctctatatcccatttttggtaaaaaaaaattcaatttttttcgtttttttttcaaaatcacttggaggttaatggaaaggcgtcaaaattttgctcttaactaaattattcaggcgccccccaacgatggaattgatcaaaaggatcggacattttttttcatttatggtacaaaaactgaaaaattttacccaaaaaacccaatttgtacccttgtttttccatttaaaacctgaatgaacaaaagtgagtcgacgtcgtcctggccaagtccggtgcccaggcgaagaacgcccttcggctgggcagagcccagacggctggcctgcccgccggccaacacaacggccgccacgcgaccttccgcaatggctttcaagccttaattacgaaaaatttagtgtaaataaacatctatttgcgattttacattcatttggattcattcgaaccaaaaaccgaaaatgaacaagcacaaaattaacatttatgcaccaaaaaaacgtaaattttcgtgcaattaccaaaaaaataattttttttttttctgaaaaaggagaccctcaccaccgagtggtattacatatctttgtttgttttgttttttaccgatttgttccaagcgctctttctctgcctcgccgagatgagctgtgttaacgcagcgttcatccgggattggccggatgtcggtgcttggcaatttgggctccaatgctcgcttgaataccttattcaaattagaaaagtcaaa

SEQ ID NO: 33405 - DNA, 883 bp, Heterodera glycines
  misc_feature (849)..(850): n is a, c, g, or t
ggtcaatgaagaggaagaagaaaacattttcggaagaacttgccattaatgatgagaaaataagcagaccgagtgggggaagacggtacagacaaatgttggagttggtatcagcagcggaagagggagaggaggagtaaaaaggaaacaaacaataatgggagagagagagagagaggcattgataagaaagagagaaagacggattaaaggggcgagaagaaaagacattgatggaatccaattggccgtgcattaattaatgattttattgctattaagcggctgtaaaatcaaatgcctacatattctaactgttttacgcttacacaaacaaacaataggacggcattcaaatcactttcggcaaaaatttttacctattcgttttttggtttgagacctaaaatcgaactcaacaataaattaggtattagattttttggtcggttcctgtacgggacagggattttcaaatgataaaaaaaaattaaatattgaatatttaaaaatttcaccgatgttgattgagtcaaggtcgcatttatgtatgtatcaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaaaccttctgcctttcattatttttctcttgnngttcattccccacggtacagaatttttttaata

SEQ ID NO: 33406 - DNA, 737 bp, Heterodera glycines
tttgaaacaaatgacaaaaaattgccaaaaaaattttcatttttatttttattcgaactcgaagtaaaaggtaaaaactagggttcggaccccgcccccgtcacccccgcccccgccgggggcgggacaggttttttggcttcacccccgtccccgcccccgtgactctgacccccgccatcccccgcccccgcgaccttcacccccgcgggggtgaaaatacacccctaagaatgacatattcatggataaaaggcaaaaaatttatacaattttgatttttttaaccattttgacaaattttttatgaattaaagttaattttattattggtcattgatgtgtagtgtggtgtagtggttagtgaatcaaccttgacattacttactgtcgtgagttcgattcaggttgacggtttcttttttaatttattttttttaattttaaaattcgcctggcgctgcctatcggcatcgcagggcccaaaaattcgtaaattttattaaaaaattctctaaaaattgcaaaaacctatcattttttggacaaaatctattaacggatccatcagttttcaaaaatttttcccggcggcgcctatcggcaccgccattttattgtttttcaaaaaagttatgaacaaaaatcgtaaaaaaaaattcgtacatgactttttttcaatcttcatcaaattttttgaaattttgcctgtatacagagaatctttagggctatcg

SEQ ID NO: 33407 - DNA, 1029 bp, Heterodera glycines
  misc_feature (943)..(943): n is a, c, g, or t
  misc_feature (995)..(995): n is a, c, g, or t
gagatagccattttgtgaggcccgaaggaaaaatttgagagggctaatttatatgtaatattcgaaagtgccaagctaattagcgatcagggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtactaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaagganaatttgagagggctaatttatatgtaatattcgaaagtgccaagctaataangcgattcaggcgcacattggggcctgaattaagc

SEQ ID NO: 33408 - DNA, 898 bp, Heterodera glycines
ttgaaattttttgaaatgctattaatacattgaataaaataccggttttcatctatcagaaccacctgataattaaattaatagtttattttttattgaaatttttcgaaactcatacccaaaaacaccaaaaaaatgtttatattatttaaaaataatgaattaaaaaaataagaaataaatatttatgcaatatgttttaatttaaaagttgttttattgaattaaattaaaaatgatttgaaaaatagcttaaaaagtaaaaaatatatatttaacgtcgtaaattttttgtttataacttggtaaaaagaaaacatggttttaattcttggttcattccgtagcctaatgttcagtattcaataataaataaatatgacaactttaaaattcaaaaccttaataaatatccacataacataatgaaatcactaaactaatcaaaaaccaaaacaacaaaacttaaatatggaagcttgagcaaatttaaaaataccatgaactggtgagcaagcgtattaaaatatcttaaattcgaaaatctaatgaatttttgatttattttaataaagaattattaaaaggaaaagtgaattggaaacatattctattttgtaataaaaaaaatttttaatagaaaattaaatagagagtatatttattattataatcagaaaaatattaatttagaggtattaattttaaaaaatatagaaaacgcaaaagatcatataacaaaatttaataaattttaaattaaataaacagtaatatttaacaggagattaaaatagaatggaaatgtggcaaatgaaacctactcaaaaaggagaataaaaaatatatatataaatgaggtaaaaatatttttaatatttataatttaatataaata

SEQ ID NO: 33409 - DNA, 898 bp, Heterodera glycines
cgttggcttaacattggccttttggcgcaaatggactttgcggaaggaattatgggatgaatagggccacaaatgcaaaagtggcagcaaagaaagctaagcaaaagaacaagcagcacccaatccaacccaacccatgccatcctattccatgccatgccaattccaccccccccccccggggggtttgcttaatcagcggttgccgttccacttcaatttcctttctttccccgcatggattggcacaacaaagggcatttttggcattttgttggggagtgtgcgcaaagtgtgaaaatgaattaaaagttggcccaattggaatggaccaatgattgggtgaataatgaatgaatggaatgtgccgttggcttttgcttccccggcttttctcaccttctctgacaatgctctgcttctcttcctcgctctcttcctcctcttcgctatttcgtcgtttcgccgttctgctgcaatgcatcgcctgtccgttcgtcgtccgtccataatttgccgaataaattgaaagtcttcggccggttttacagcccaactgcgcgtgttggccctcgcagaagttttggtcttcgaagttttcttaaatcattaaaatcacttaaaattaattgaaatgagaaaaaaactcaaattaaaatggtaattaaaaaagattggaattaatttaatttgaaaaaataattaaaaataactttttaataattagaagccataatgaacgacaattaaaaaaatatatcccagcacatgacacccaaaattcatcctataccaggcgagcatttgtagccaatctgaaggtatttgcttgtgcccgggcacggatcgcggtcgccgaagaattcggggcggaaccaaagtcggcactttcttttgc

SEQ ID NO: 33410 - DNA, 1204 bp, Heterodera glycines
  misc_feature (1127)..(1127): n is a, c, g, or t
  misc_feature (1163)..(1163): n is a, c, g, or t
aaaaagcaagtgagggtcggtacagtcgcaagagggcaacagtttggcgccgtctaataaaatgctaattaattaaatcaatttctactgtttttgggcgattgaaattgttggcaccattacactagcatcaaatatgaaataaaatttcgttttaaatacgcaatgattttttgtccgtaaatatgcgtaagtgtatatggtatggcacctggtgtacataaaaaaaatttcattcaaaaaattacaacattttttgcgggacgagatttttatacactttttagggggaggggggggggggggtttattgctcaaatcacaaaatttttgggtcatttttttgatgaaaatataatcaaactctaattttcaaaaatttttcccggcagccgccatgttctccaacttttttgtagaaaagcgcgtcgcatgggcgctctgtgttgttgatattcactcaccagtctcataggtcagtgcaaataattccgtttcaacagtggtgttgattcgggcggaaatgattatgtccacgtccgcttcctctgcctcgatccaattgcgcgaaatatttccctcaaggatgtcactggcacagcaaagcagggcacctgaaattggcaacgaacacttgcgcagttgaacacgctgctgcggctgctgtgcctgtctggcatatggtggtcctagtttttttcaatgtgccaggcgtagcccgatttttaaagccctggataccggctcccctacatttttgggcttggaattccttccgactcggtattccgtgctcctaaaatgcctcgaaattcgcagtgccattcctttcctgctgaactatacagactagagatgagcgggaagaatttttttggataaaccgggattttgggaccgtgacccccgggttttcgagagggacccagattaacctgggaatttttccttgagaaattttttgaaaaattttaattttttaaaatattaaatgccaattttttaacaaattaaccaattccgggatcggtcttcgctcgactctaattttttacaattaatttttcattctgacgagctctaattcccggtccggtcccactcggctctaatgcattcattcccanccatacacattgcttattaatatttcagcaatattntctacactaataaatgtcgttggcacgtccgaatgaattac

SEQ ID NO: 33411 - DNA, 515 bp, Heterodera glycines
ttggtagaaatttatgaatgtcaattccaataatgaattgttggcaattagctaattgatttgatgtttaggcaaatgttgctctcaacagaagtgttcaggtcgtccgaattgtggctgagtcgccatttactaccgtacagcatttgactgtactcggaaattgtaagttttaagaacggaaattcccgcgttttcatttccaccagacttaatttcatttaatttacaatataatgctcaaattctttccctttttttgctttactcctttcgaagttcggattttggtggctccttcttgatttttagactgttttttgtggagttttatgaagtattaaccggtcatttggttttaaaatatttttggtcacagtttttcgagtaccatcgaatttttgaaatttttgcagatcaatcgagaaatcgaaaattatcgagcgaattcaagctaaacttaaataatttaaattatgccttgcaaaataactccatgtttagtccttcgtgaa

SEQ ID NO: 33412 - DNA, 644 bp, Heterodera glycines
tttgcagtatggtcgcattgctcaaacattggtggtcggcttctctgccgggctaagcgatcacaatgtccgcacaatgcacttgcccaactacacaacggcggacatccaacaggcatgctggaacttcatgcgcccattcaatcgtgagaaggacggccattcgtggtacgggtacaggtcgaacaacaggaggagggggcggggtgaagacgacaagggcagtcctacgaacacgtaccaggcttcgtaagaaaagaaaaaaattttctggacgactggaaatccgcgaatattaaattttttttttttttttgcttggcccactcggaaaaaatttatggggtctctggcacccctagcaaaattttgggcaatttttttttaattgcaataattgaaaaaaaaacaacaaatgcgtcaggtatccgcatgtcagttgcatttacatgtccgcgagtcgttttgaacttgttgatcgccggctgcccaccagacgcatcaccgaattcttccacaaaaaagccttgggtgttgaatgtgatggccaacaacaatgttcaggttggttttggcaaaattagtacaattaaaaacaaataataaatacctaatcataataaaatgaacgctttcaacagttc

SEQ ID NO: 33413 - DNA, 957 bp, Heterodera glycines
  misc_feature (5)..(5): n is a, c, g, or t
ccccnctttggtcccgaatcccaaaatcacttttatttttgtaacatctctcaaaaaagtgataaaaagatgaaataaaatttatataatagagcaaaaaattgcggatttttttagtattttactcttccctaatgacttttctgaaccgagataaaaatttttttctgaaaaatcgaaaatttccagaaattctggaataactttttttctttagaagataaaaaccccaaataaaacccataaaattctcctgatttttctccatttttaatgctttatttaatcaaaattggtcaaaccttaggccagatatgaattttcaaattttaacccaaatttccaaggaccaaaaaaattaaaaatatttttgaatttttaaaaaattccaaaaaatctgaaacttaaaataaacatcatatttgtgctcaggaccctaatttaccccagaaaaatatttttcacaccctttttcgaccccaaaaaaatttttgaaaatttctagggggcctagctcgaaaatttttgaaaatttctgaaaatgaagtaaaccgttcgatagagcttaaaaagctctacaattttgctcttaggcattttttgtctaaaaccgacccctgacgagttatgggcccaggactcaaatgtcccgctcaggccaaaaattttttctatttcctggaaaaaatcgaaattttttcaaaaatatcaccaatcgatagagctcgaaaaacggttgcttgaaagtggtctccgtttttctgggaaaattcgttaaaaaatcctaaaattcaaaaacccgaaaaccgttttttaggcctagctcgaaaattttcaaattttcgaattttaaaattggaaaatcgagctttcgagctctacatagtgccgctggccccctgcgctcggtcaagcctatgagtattcacgggactgactgggacaagtgtactgatt

SEQ ID NO: 33414 - DNA, 1571 bp, Heterodera glycines
  misc_feature (4)..(4): n is a, c, g, or t
  misc_feature (16)..(16): n is a, c, g, or t
  misc_feature (61)..(61): n is a, c, g, or t
  misc_feature (1512)..(1512): n is a, c, g, or t
gatntaagacacactntaactaaacattgctgaatctcatataaaaaaggggattttaatntaattcgaaattaaaacaatcaaacattttcgagtaaaataaataattgagggtttatcaaacagttaataaagtatttaaaaaatcgtgcaaaacaaagcttatttttagtagagtgataatttttttaataaccttgtaaaattgtatgtcatacatccaaaatttctagcataaatacatgataaactgacaaatattaatctcttcaaaaatattctttttttttcggaataatttattttttatgttaaattaaggttatgtttcaaagttttttttttaataagaagtaaatatatataagttcatattaattgtgtgttttcaagaatttttctttatatgaaactttcatattttcttcaatatttaggatttctttttatattttgaaaaatctaaaatatgagttgaatctgttttttcaaatataaaattttcaaataaaaatataaattgtttatagaatagtaatttataagtttttgatatttttttttattctgaatttgacaagaaagaaacattaaaattaaaatatttaattaaagaaatcaataatgattatttaatgctcccaaaagaaatagagaccatagcgaattcatgaaaaaatttattctaaaataaatatctatagcatatttcaaatcatttaaaaactataatgataattaaagtttaaaaaaaggtaaattttataaaaaaagaacaagaaattaattatataatattaaaataattgcctaccatgtcaaccaaatatactaaatatttaattgtaccatagtgacctatatgataaaataatttataaacactgaattgtttatttcatccattaattttattcatttatatcatttaaacttttaatattattgaaaaataaaaaattactaattatattattagaaacgactttaaaattatttttttcagaaatatctccagtgatgcagaatttattacattttaaataatcaagcataaaatgtgctgtgctccgacagttgcatgaacactgcagagaacaagggaatattaatgacaagggaatattaatgaaaattaatataaaaacataaacattttaagactaagaaataataaaaaacactcttacaaatattatgaacaatttactgaagctttatgctaaattctgaaaaaaaactaaataaaataacaattaaaatgtaaattacataaaatagaaaggaataaaaagaaataaccaaaaagttgaaattacaaaatataatagtttgcattttaatatttaaattttatcaaaaatcaaagcttgacttaattcaatattacatagtttagtaaaaattttatatagtcaaaataaaaagattaattttcaaacagttttatttataaatttataaaaaaaaaataaaatgtttagtattaattattttattttattttattanattaataaatataatatattattgaaactgaaaatgaatgaattattaaaaaatctttt

SEQ ID NO: 33415 - DNA, 933 bp, Heterodera glycines
  misc_feature (819)..(819): n is a, c, g, or t
  misc_feature (875)..(875): n is a, c, g, or t
gtctgccgcttctccattttttccccgaatttttcgagctttccatcaatgttgttcccttgtctgttgaaaaaaaagagaagacccatgaagatcgtcacaagtacagagcctgcaaggcctgcgttgaacgcaaaaactttaagtccgaatccctgcagttgtccgttaattgcttccctggacactttttcaattgaattgtatctgtcgtcggcagattgtttgatgttgttagtaattttttcagctgcctcaaaacggatatcattgctgtttttgatgtcatcgagctgcagacaaaaagaacatggtaaataataaagtcatgtttttcgtttactttgcttagcacagtgtctctgaatgaacgcaattcgatctgatcgtcagtcgaagtagagactaaatattacaacataaggacaactcactagccaaagcaataataataaactttcgctattaaaaaattatcgaaaaatcattttatttggagcttcagttaaattttctgcttacaagttcgaatggaatgcaattgcatggcagacgatgagccacaaaacatcgtctgaacgtccgaaaaaagtgatgtgaatcatatcactaaatttccatcccaccttgagaatgatgtccttgcttgctttccatccggaaagacgccccgtcagtttgactccgatgacatttgggcacttcaattcccaaggaaaatcagccatcacatcgaccgcatcagcaccaccgacaccaatgcaaattccgcccgatcctcctaaaaaatgtttgtcctatttcaaataaacttttttnaagtgacgaacctccgtttggcgtgtgcgagtccgtgccaattagcaacagtccgngaaaaagcgtagtgttcccagatgacttggtagataatgcgggcgccgggtggccaaa

SEQ ID NO: 33416 - DNA, 650 bp, Heterodera glycines
ttcataaaataaaatattaaaaattgtccttaattaataattgaaatatctttagaaacctcaattattaacatttatgaaagttagtccgtttttcacgaattttatgccttttttaaataatattttttgttattttatattctatttaacaaaataatggaattgtgaacaatttttatttaaaaaaagagtaaattattttgatcagggctatttaaattaagcaaatgttatgtggactcataacaatatcgttgcctgccgttaaataaaaatttttccatttattgaactttgaattttttgggaagtgccgcaagaataatcatagaattgaaaaatccaaagcaaattatttttttactaaatttatttcgtttaaatcttttattacttatttttatttacttgtcgttccccataaaaaatacgttgttttttaggacgaatattttttattttgttacatttttatttaattttttgctttaaattgtctattatattcaaatacgggttcttttcggttttgtgacccccttgaaattttcaaataaaaagtcatttctagggtaatttgtgacgttgataacaaatataacattaatttgcagaattccgaatccctatcctgaattcaagcaaaa

SEQ ID NO: 33417 - DNA, 884 bp, Heterodera glycines
atttgttggtgatccgcacggaaatcaacaaattgtttggaaatttagaaggaatgtggaacggaattttggccgatttgaaaattttcctcggactcgcacgaggcggtaatccaaacgtgaatgctggaggaacaagaatggaacaaattcaagacctggacagagaaagaatcagtacgaggaacggaatttcatgccaattcccgaaccaaatatgagacaaaatgatggacaaaaccaaaatttggttcaccaacaagtgcagggccaaaattttcaacaaaacatggcaagagtgatgccatacaccgagggaattcctgatattatccttgaacttcacaaagtcacactttcaaatcagtacgcaaatatccttagagaaattcctactctttttggcactgaaggaagggacgatgtcagcgatgatttcaacactcttgcatcgtgaatcaggcagatagcagacgaagaccaacaaggtgaaaattgagagcggatcgatgattggggtggagtgcgattttgagccgatgtcataatatctatatattctttccctctcccctcttttagctggtctgacccaaatgcaacagaatctgcaaaaggactccaaattctctgttcaaatggtgccggttccgcaacagcaaatgatgacgatgggcggcggcgccatggatggaccggcgcggacgtattttacatcgcgaaatccaacatcgattgcggtaccaggtcccgcccagagcaaggcgtccgattgtgatgagaagggcaccggaaattttggaaacatcccacccctcgacgggtttatgactcgggagatccggaaatttcgtcacgaaacatgcgaaacgatgtgaatttct

SEQ ID NO: 33418 - DNA, 918 bp, Heterodera glycines
caatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaa

SEQ ID NO: 33419 - DNA, 733 bp, Heterodera glycines
ttcaattatttaaaaaattaattccctcccaaatttctcttcgtcagcaatttgtaccgctccaattcgttgctgttgcggcgcaatgcgttgatgcattatttgaacgaaatttcggcaagtgtggccacagtggaagtgttcagcctgtccctgttctccattatcaccatccgatttgattatgcgcgtcagtaattaaattatgcatttattattattatttttatacggattaaagtgtcagtaagtcacagctttaaatcccggcttttccggtcctagtgaatttcggtcttcccaattcatacgacattttaccaaaacttttcctgcttcaactaactaaagggctttttcaatttaataaattatattttattttcagatttttacaatgcaatgtttggcactttcattctctccgccaccttttacatgtttctgcgctcaatgctcactttcagtgccgacgaattggaggcgatttttatgagcaaattttattagatttttacattttatataaattttcagcccattgaacagctcaccggtgctgtgcgcctggtctgctgcattttgttcacctggacagcgtcacaacttttccaaattcatcagcggttcatctatcacacgggatgccatggatacggtaggcactacaaaaaaacattagaaaaagaatattttgttacgttaggtgcggaaaaattgaaattgtattatt

SEQ ID NO: 33420 - DNA, 922 bp, Heterodera glycines
  misc_feature (825)..(825): n is a, c, g, or t
  misc_feature (908)..(908): n is a, c, g, or t
cgagttgtccaccttgatttccatctcaccgccagcgccgtcaattctcgccttggactaaaaaataattaaaaatgtttaaaatttaattttattatttatataaatcgaaagcagagacccgcgtgggattttgcgggctcacagtcctcaatcccatattattttttgcaaattgctggatgggtggggtaaaaacggttgaatttcaatttgatcctccaaccaaaatctaacagattatatcaggcccctggtaaatccgtccatttctaattcaaaatttgtgttcataccgccttggccaattgccattgtccattcgggtcgcgctggaaggtgttcagttgccaatccgcggtcccacaattgttgcctttcagctaagaaataaattacgataattggtggtaattaattaaaaataaatctaggtaattattgggcaatatttagacggtaatttaaaaaaaattaatcccatttttacaatgacgcgcgaagttcccggaccttcgaagatcaactgctccacctgttgtccatggggtaccttaaaggagtataaaaattcaaaaaattattttgaaaatcctgggacctcaattttgaacaggaatggcgttttcgtctccgaaattacattggccagaatttcacagtaggtcatgggaggcggcggcggttgtgccgcttgggggcgccacctgctcaaatggggccaacaaagggaagaggaacaggggaaaaacagtcgtggcaattagtaatagcatttgaaattctaattaaatttaaaatttctaattaaaaatatatttttanaaattctaattccttaaataataattttttaaaggctatgtgcaagtttaaaaaaaagtgagttcacactctgttttatttanacaagggaagaaca

SEQ ID NO: 33421 - DNA, 902 bp, Heterodera glycines
  misc_feature (802)..(802): n is a, c, g, or t
  misc_feature (852)..(852): n is a, c, g, or t
  misc_feature (883)..(883): n is a, c, g, or t
ctgaatttgtctcctccaatttcagccgtcgttggatggactggtaacatttgttgttcagccgttcctcgtcaatgccgtgcagttcaaagtcggaataaattttctgaaaatttatttttggaaattttgggttggttgaattttaagaatttttaatttccaaatttttgaaaaatgggtagagtgtgaaaaaaagctaaaaaatttacccttttcaaaaattttttaaattttcatgaaaaaataaatttcgcgtcgctttttcaaattgatttgatttctttaaatgtttttatttttcacctttacaatgagcaataaactggtgagttgcgtgttggaaagtgattgttgaagcctttcctgcaggaagaaaataaacaattaaatttaattggtcaaaataatttttgatttattaccgtaagccattcgttcagcatttgcgtttgcccatcataccattcctaattaaaatttaaattgattaataatttttaaacgatttgataaaattgaattattattaattgttattgctctggtcttggtaatttgcataaaatccgaaaatactattctgatcaaaaagtgcacactaatctgttcaggatcacagttcattctattcactgttcccaattaaatgaatccactgatcatttggtcgtaatactccgatctttctagtcagatatgaaaaaaaaaatccaaatcatggccttgtccttgaaattttcctaggactctcggaaatcaccacaaattgtaccagttcaagctctcttgaataccatgngtctccttgaaattggttgcccctttcacctgtagaaaaggaattcttanatactctgggaatccgctaataatccgtccnttggatttgcctaatatta

SEQ ID NO: 33422 - DNA, 1536 bp, Heterodera glycines
cgcgggactgagtcggtccgacgctgcgttggtcttcgagcagttggctgccgggtgttgcagcaccgccgcttacatggcggtgcacaacatggtaacaacgcagaaggaggagcaaaccagcaactggagacaggattaaattcacaaatacttttttggagagatttttatgggggctctttcctggatattcaagaacttttccggtgcaaaatccgaaccaatttggcaaacaatgcattaaaccggacggaactcccatttcgtgcttctttatttattatatttgcttttttgaatttgattttcacaactttcccctttcttttggccaggtgccgtggatgattgaccgttttgccaacgaggagctgaagcaacggtacatccccgaattagccagcttcaccaagttggcctcctattgtttgactgagccgggcagcggctccgactcggccgcactgcgcaccaacgcacggagggaaggcgaccattacattggtgggaaaatggacaaaacccattttaatgggtttatttattaattccataaagttgcctttttatgatcaacgatttttcaatttccaatggatggattctaatgaatatcattggatagaacagaatattttctatcgaatggtattattttaatgtgtttttggcaaaatttgaaaaagttatggataattttataaaattagtttatttatttgtaacttttgagccaagagagacacaaaacttgaaattttgccgattgaataacattttttaataaaaaagtaccatatttattagaattgattaattaggaaaagagttacggactcgaaaaatatacgggttaaaaggcgaaaaaaacatcaaattttttgcagtaaatggctccaaggcgttcatcagcggcagcggcgtgtccagcgtttatttggtgatgatgcgtcacaaagacgcgccgccgggccccaagggcattttcgcgttgattatgacgcccgacatgccgggcaagttcagacaaatttaaatttctatgacgttttcatttaaaaatatcccggagaaaaaaatagggcaatttttcaacctttaggcttccaactgggcaaggacgagaacaagttgggctggtgcacgcagccaacgcggatccttacttttgaggacgtcaaagtgccggtgaccaaccaagtgggcgcggacgacgaaggctttaccatcgccatggagggactgaacggaggtgagcatgccaccattttgccgctttggtaaaactaccatgattttgaccatgaaaaattgctgtatttttgactcggtccctaaattccgaccacgatttttccaatcctcctctaataatgaccaaatccaatccattggaaaattattaatgacgaaaaaacctaatctatcgaaaaataaataagtgagtggtaattgcgcttttccattttcttttcggccgtgtgaacattgagaaatgttccctgggcgctgctcagatgagcatggacttgg

SEQ ID NO: 33423 - DNA, 933 bp, Heterodera glycines
tattttaagtgattattgtaatcactcgaaaattttaaatcatttttatattttaaggacggccttctgcgacccttttattatttggccaatttaatccaaaagagtggccgcgcaattcgaaaatttttggacgacaaattgccaaatgaatgcaaatatttgatgaaaaaagaaacattagacgaactggtgaaagcagtcaaagaaacatcgtaaacagccaaaatggagcccatttgcttttaattatttactcaattttgcttcttggcaatctgaaggacgcgcaacaatattaaaaataacattttttatttttttaacatgaaacaaacaatttgtaaaaattcaaatggttttcttcccacttggaatcccttccgtcattttttgcatttcctacttcgtatttcttctttttctttcattcatcttcggtcgtcttcgtccattccttcactcttcccctcctcctcctcttccgtcggcaattttatgttttttgtgagcaatttgaacgccgtttggtcgctgtagcaattggcgtccaatgggagaagcattgggtaggagtgggccaagcaagtggccaacggcagccaaaagcgcctgtcctttggtagctcagacgcatcgacccaaaaatggacaaatttcaaacattcagaaaaccaatgtaaacgaatttttagggaaaaatacccctttaaaatggcacaatttatattttaagaactatcttttgaaaaaaatgtcaaacaaaaaattgacttccttcaataattctctttcctaccaattgatcggcggtaaagcgaagagcgcgtttttgtaggaagaaattgtagtggacggtggtgaacatctgcaaaaaagaaaagtggaggagaaaaatggaaaaaaagctgaaatatttggataaaacccaaa

SEQ ID NO: 33424 - DNA, 933 bp, Heterodera glycines
ttgatttcaatatccttattaacaaaataacaaaataattgatttatttttttgaaaattataagactatttgattaaaattccataaaataacacctattattagaattatttaattcagatattttaattataatttttgacaaaaaaatttaatattttattttacataaaggaagtatcaatcataaaatttttcttcaaatcaattagaataatggtatattattttttttcttaatgtaataggtattgctgcggttttcctttttcaaattaaaataaattttataattaaattattatttagtataggacttcgccaaatgataattgattcaaattaaaaattattcagctgaagaattgagaattgtcaatcttcagccaaattaataataaaatctgtccggtttatattaaattgattaccgttgattaataccaaaaatttgtttgtttaaaagagatgattaaaatgatcaactaaaaattaatgcgttgtaataaccttatgatataaaaacaactaaaataatttaagcaatgcaaattattttataaaatatttaaaattatttttaaatatacatttttaattaattttaatttttaaaattcattgttttacatcaaaatttcatccttctcatctccactttccgtcgaagtgcaattcaatgtctcaccagtatcgcaacctttaaaaaaatgttttatattaacatacaatatttaaatataataaaataaatattaattaaaaatgatttttttttccattaaaaattgttaagcatattactgtttttcttaacaagtcttgatgtgtcctgtttgataaggtgcacatcctcttcatcctcctgcggggcttcatcattaacacctaattgccacattgaattaccctatataaattgattatccaaa

SEQ ID NO: 33425 - DNA, 1355 bp, Heterodera glycines
ccccccccttccccaaatgaaaatttttaaaaattttccagcaaataatggaaatttttttcgaattccccccccaaacgaaaattaaaaagtttaataggcaattttcgtaacaaataacactctaatttccaaaaattttcccggcggcgcctatcggcaccgccggacctaccttttccactatttttacaagttttttgccttaaaacggccaaaatttggtcatttttagtgaaaaagtgcagttgttacccagcagtgaaaaaaaaagttattggttaaatagcaaaaaaaaaaggtcttcaggtcgggtcccccccccccccccgaaaaatgtttctagatacgcccctggtctcaattgtcctctattagtttcgttgtgtttcaaaaaagttatgaccaaaaatgttaagaaagccaattttaaatattgggaaacgaaaatacattaagttttctttaatggcaatttatgctttctcatgtttagaaacgttaccaagcacagtgcaaaattcgcgaggatcacaaaataaatgtggaggaagcgaaggacgcattcaaaagtttggccaaatattcgccggcagagaatgaacagtcccacgaggaaacgagggcgttcaccaaaatgaaaagtgttggttggcacggggttcatgccatggcattttttgtgatttaggatttcactacccatcaaattccggacgacgcggacgcattggatgaacggatgacgagggaattgagcaaggcgtccaaagggcgtcaggagggcactgaaaaggcatggcacaaaaattttttggaaaaattatttaaaaaacatgaaaatatcaacacaatcagaccgtagtaatttcggaggggaaaatccgaagatttttttgttgctcttcgggccaaaaattatttctccagtgttattttaatgttttttgcgccgtggggaaaagcgtgaatttgtagctgtttttcgccacaaaaataattaatttttgccatttttgggtcaaatttcaaacaaaaaaaaacatggtaaaatgggggtccggcggtgcatttaagcacttcaggaaaattcttggaaatttagttaagaaaattcttaaaattttcaaaaaattgccaattggacacttggattctaattgcagcgcgaacgtctcatcccaaaccaattatttatttccatttaatactaaatacgggtgcacttcattttctaagttagcaaattttttaaaaaaaatttctcggggccggcggggggggggggggggaaacgagctgctcccactaaataatacatcattaaattaatattgcattttttacgaggatgt

SEQ ID NO: 33426 - DNA, 971 bp, Heterodera glycines
taaaaaataataataaataaaatcaaaaataatcaataataatttaggcggcaaattatggcattgtgttggactccctcccaccgctcgatgactactaccccggcggacacttccctgaggagctaaagaagccggagcagtggtacgaggagaaccgcaacacgccgtttgacctgcgcgaagtcattgcggattactgcaaagcaggtaaaaattgggcatcaaaaaaaaatatgcaaattttcttcagatgtccaaattttggcccatggaatggtcaaaatgcggcagttgttcgccgctgcaactagccaggagctgaccgactccatcaccatcccgtcagcctgcatgaagttcttcgtggtcttgtcgcacgtcggaaaagagagggtggccatcatcccccatcttgggtacgagaagcgcgggaagcagagtgccatcgctcgcaagtacctcaagtggcgtgccgaggaagagatgcgcgacaacggatggactcttcgccacgtggaaagccctggcggcgaatacaatcacggcaacttcctgctggacggcatgctggaggagcggatcggcgaagacaagaatttggcgatcgaagtgaatgggtaaggaaacacctgccaaacttatgctaattttctcccattcagatgctattggcacgcgtgcccgcactgcttccccgaggacgacgcaattgttggcggtggagagacggccggtgccattcgagcgagggatgagaagaggatccggcagattgcgcgggacttcgaggtggagatcgtgtgggagtgccagctcggacgaatgctggaagtggacccgcagatgaaggcattcttcgacaacacgcccgattccggcccgattgacttccatgacgcctttttcggaggtcattttttcccaatttttggttaaaatatgtaaattttgtttacaggtcggactgg

SEQ ID NO: 33427 - DNA, 1315 bp, Heterodera glycines
ttcttctcgtcatcaattcgttcgcccaatgtgctccttctgctcagattatatccattaaaattaattcgttgaaatgggagtggttttggtctcgctcaattagtcacttttttttgtttttttttttttttgctcttttcccccccttttttgatcattagggaaaagcggttatggtaggggggggggcatttgtacatcatcatgataaaatagtgtacgtaaggatgatgacatttagtcggctaattgcatggtaattagtgggaagagtgggctgctggtagggagggggctggaagtgcacatttgaaatcattggttccgtccgttcatttgcaatttgcacacaaaaccgaagcatcgcattattttgataacgacgcaatgcacttacattaattagtcgaattttttgtctgtttatcttaattgtcccctacaaaaccattcatttcatttttcatctttctatctatcttattctccacattctgttgtttgttggatgtgtgtggagtgattttaaagaaatgattttttaaattatcattaatcacttttctccgattggtccccgttcttcattaattaatgatcaattaatgaccgtaaagttgtcatccccttacaattaccgtaacaattttccatgtaaaactattaagttgctcatcagaaaattcatacattatgaatagtgtaataggggggcctagccaaccaacccatgagtcgagaaaatttttctggaccgggatttggtatcgagatggtacaaaaacaaaaattcgggtcgggattcgatacgaaaatgcgtcgggattcgtgcgacaaaccctgttaaccaagtgaacactacttcttcctcgtcccattaaaatccgaaaattgaagaagaaaaaattcccggactgcgaaaattcgtcgttttctgattttccgccgggtacggcatttttggtcgatttgtgccgcctgttttctgtgtgttcaaatagtgtatggactgtctgacttttcccctctctttctctgcgctcttcccattcaaaaacaaaatgccaagaaaagagacagttggccatatggactgtctaacattctctctttcgctctctctttcactctctctctcgctctctctctctctctacactccctcccatttcaaacaaaatgccaaaaacaaaaatggtggcgccacattgtttttttcaattaactgttaacttcactatattcgtttgtccccctcctcagtgatcgtcacgatcacccgttcctcccgaccaatcagcagttgaccaag

SEQ ID NO: 33428 - DNA, 149 bp, Heterodera glycines
acatgcgtagggcgtcttcgtcgcgggtcatggcgggctcctgactttctgtgtgggaaagtcataaggcgctgctttccgaattggcaagtgaaaactttctatgatggaaagtgacgagtccgcgcctagcgcccgagcctctaacc

SEQ ID NO: 33429 - DNA, 663 bp, Heterodera glycines
caaaaaatggcgcaaaaagttgttacatttgaataaatggagtcgttataatgttaataaatttttttgttcgaacaaattaaaaaaaaatttatttgaggcaattttaaaaattttttctgatttcgcaccctaaaatcatttttttttatttcaagtttctgcctactaaatttttctgtatatttttattcaacaaaaggttttgtccttcaaatttgcgcattaaaattttttttgtgagtttttaattaaattatcgaattactcccgctcccgcccgggactcccgttaaaaatggacgggattttaaatatttacataaaaaaagaagccctacaaataagcacgcccccgagaatcacccaccatttcaggaaacgttgctccccttagggggggggggggggtatttgttgttgttgttggacaaaaaattgtttggaaaactttttggtccctcttcgcgatttcgtcatagatgtcggcactttccgaaaatcttgaaaaaggcgccaaaaatggcgatataggcacaaaaataggcattataaaagtcatcgtagacaccccaaaccaagcggaaaaggcgtttttcgtgcttatctgtgcgtattaagttcgcaaaaattttaggcatttgcctaaaaatggagtcccta

SEQ ID NO: 33430 - DNA, 97 bp, Heterodera glycines
cgtctgcttgaacaggtgcgagacgcgatccgtgttcgccattacagctacaagaccgaagagtcctatctgggctggattcgccgctacatcctgt

SEQ ID NO: 33431 - DNA, 1450 bp, Heterodera glycines
  misc_feature (1366)..(1366): n is a, c, g, or t
tgaaaaagcgatggaaaatcagtcgaaagaaaaaaaggaggggggggggggtaaaaatataggcccgagttcattatgagcgttcggactaatttgaacaaattcagaaaggtatgggcaaaaaaatctgaaaaactcgaggccctcactaacaataaaaatgtattaaaggattaaaaatgatgaataatgtcattaaaaaaatgatcacctcaaaaaaaggctcgtcaattgggctattgaaataggcactttcgtcgttcggaatgcaactcgttgtgaagttttccaacagcgtaccgataattgggtggaccggaacgcggcactctttgagctgtgctttaatccattcctaaagaacgcaaattggcattgtcggataattatttaaatggcgattgattcaatgaaatccttcaaatgaaaaatttgaaacttatggcacaaattcccaatagttttttttcgcgaaaaacctggataaatgctttcccccataggcaatgcaaaattacactgtataatgttttggtgacaaaaacatacatgcaaaaaaggcgaggaaatgatttgccaaaagaaacaattggtaaaccgaaggatgtgccaaaatccaaaattgaaaaaccattcaatatgccaaaaacaataattgccaaaccgaatgatgtgccaaaacagaaaaatgccaaaaagaaagcatcgaaaaatgatggggggcaaaagaaagaaaaacttgttgttagccgaccatcatcacccaatggagtgccaattgagtttgaattggaaatcaatgaatacactaatggacaattgatcaacaaaaacactatttctggacaatgggacaaaaggaatgagaaaatcattgatgaaatgttaaaaaataaaaaagttggtgtcacacaattggggcccattcagtcaaaagcaggtatattagcacaaagatgaaattcagaaaagccgcgtatctcaggcaatatcatataaccagatctaggattttgccgcttaaatggcaatctttgaaagttttttataaatttttatttaagccacaaatgagggtaaaacctcttatattggggcaaaggtaattaccgaaaaataatatttatatttccatgtttcacgggaaaaattattttttaaattataactgattgataaactttttagacattttgccattaaaaccaggacagttcgaaactgaattccattttttctctgataaccatgcaaacagtcagcaatcaactgttgcatcaacatcgaaaaatcaagtcagaaatttttaattaattaaaaaaataattattttagaaatctaaaaaagtgcctgagcgtctattanaacattccaagtcaatggccgaatttagaaacacgcaaaactcaaatgagtcaataaatgtatctgtaggaccaataaatataa

SEQ ID NO: 33432 - DNA, 969 bp, Heterodera glycines
caggaaaatcgaaaattttcagcaaaaatactttttccttggttttgtgaaaataatgggccaaaaagaagttggggatcgggggtctatttggatcagggtcccactctaaaaaaatatacgttttcgaagaatgccaatgttcacttcctcccccaccaatggcgatttcctttttgggtatactgttccacttttgtaaatacagtaaccgcccagcaaattcatgcccctcgctaccgtattacctggcgagaagaaggtggacgtgaagtggtcagccattgcggacaaaaagtgctgcggatggatgacaggaggaagaggtggaggagcgggaggaagaagtgccgttggtgaagcggaagaaatgatgccgtcgccgacaacggcggtgccggaagatgaaacggatttttgtggttggagaggtgaagcggctgcggatgaatagtggggcggacggggaggagacactgtggcggaagaggaggaggaggagggacagcatgaagaggctaccaagtcagcggaggacatggcatgccaaacaaaaagtgaatgaaaaagtcaggcaaattgtactaaatggcacaaaaaagtcagtcagtctcgagccgaaactctcgaaccccgccccggccctccttactctcgacaaacgacggggacaaaaaacggggcaaataaatcagatttggcaaattcaaatttatggcattaagcactaaattgtgccggggactttataagcagctaacacaagcaaattttgatgagaggaggggggggggcacggcatttttgccatgcaaattttttggcacacacaatgtttttaggccgccgctaggaaaagcggacaaattgacgcggtgaccacccccacgcaatcatcatcatcatcatcagcgctaatccaaaaattgtcggcttttcctctgagatggggggggggggggggggggg

SEQ ID NO: 33433 - DNA, 1038 bp, Heterodera glycines
agtagaaaataaaggggagagagagagggtaagggtgacagtgagggggaggagagaagcgatgggaatagagagaagggagagaaggagagtggggagagacagagagacagagagacagagagacgaataaaaacggtggaaagataatggagggacacaaatggggcgatgatgagacggacaagcagcagcagacactgtctgatgagagagcagtgaagaaagcgttgttttgtgttgattgtgccatcacaaaaacatagataaacactgtttgtgcttttaattcacctcatggcacaaacaaaacaatggtaccaaggagggaggggaagaggaaccatgccaatggggacgttccaaggatggagggaggagaagaggaaccatgccaatggggacgttccaaggatggagggaggggaagaggaaccatgccaatggggacgtaccaaggatggagggaggggaagaggaaccatgccaatggggacgtaccaaggatggagggaggggaagaggaaccatgccaatggggacgttccaaggatggagggaggagaagaggaaccatgccaatggggacgttccaaggatggagggaggggaagaggaaccatgccaatggggacgttccaaggatggagggaggggaagaggaaccatgccaatggggacgtaccaaagactttggtcgcttgtcactcatcaattagggaatcccccccccccccccgccggggagtgggcacagagctaagtaaagtgaaagtgattccgcccaaatgattagaccaatgggagagcagtcattttctcaagtgataatgtttgcctccgtttaagcaatgtttggggattcccctgggggtgcctttccctcccccaccaaaccgataacagtggacgacagaattgcgtgatgtgatgaattttagtaaaaagtcacaagggacttactgaaaaatacgaaaatttccaatttattttttggaaaaagaaagtaaaaatcaaagtaaaagagggggggggggg

SEQ ID NO: 33434 - DNA, 875 bp, Heterodera glycines
  misc_feature (787)..(788): n is a, c, g, or t
  misc_feature (797)..(797): n is a, c, g, or t
  misc_feature (803)..(804): n is a, c, g, or t
  misc_feature (833)..(833): n is a, c, g, or t
caggttcgaatcctctacatgtttgtccattttagacttttgttttttgttttttatgcaaggtcaattataaaaaaaaatttttaatgaaataaaatttttattaatttttttaattaaaaaattcattaaagataatggtacaataaatatcctttcatttaaaaacaaattaatttttgtctaaaactttatgagtaatttatttgttaaaatggtaaaaaaaaataatttgtgataatggtaattgactttggcataaaaatcaaaaattaaaattaaaaagaggtatccaaacaattatttaatttatttattcaactaaaaaagtttggcacgttataactcgccactcgggctcattcagcaaaaaataaaaacatttggaaatccggcaacattttactattttttttttctttgcataagtttttattagaattttctaacgacacgaatttgcctacgcaatgtaattgaaaacgaagaatcgtttgtcgatcaagctgactgtaatacgggtacggctgccgacgactgggttcgtgatccgattagtgctaactgtcgaaatcgtccacagtcgaattctttgatagtaaatacataggtgtttaaccatcattgacctcttgaaaagcagctaaatgatgataataagcatagttgggagctctggattttctatttaaataaactaaaatacgtaaaatataatcaagtataacttaaaaataaaattaaaaagccataaaaacaaattaaaatatataaaaaattaattaannctgaaattnatatcnnataaaaactattcattaataatagaatanaaaaaaacaattatttattgcttgaaaaaaaatattttaaag

SEQ ID NO: 33435 - DNA, 314 bp, Heterodera glycines
tcttaagcccaaataatttctctccatcacaaatttttattttctacccaaattataccccaaccccttaatttgatggtttttgaacaattaccatcccccataaatgattagaaaattaattcccgcattttcgcttgatcaaatcgctttccccagcgggcacaggtctgtctcctccgtcaattgatcatccaccccaccacacacagttaaaacaacaacaaaaccataataaccggtttttgatgatagatgccgcccgctgggggttggagggccaaccgtaggccccgaggggccaattcttcccc

SEQ ID NO: 33436 - DNA, 660 bp, Heterodera glycines
  misc_feature (572)..(572): n is a, c, g, or t
tagagtgccacgggaccggcacctggaagcggacaactgagtacaactgagtaccaaggtcccagtttgaccgggactagtccggttttttccctgtttttgaaaccgaaaaggtcgcggtcgcgggtttgcccaaaattcccggtcccgtggcactttaatttaaaggatagaaaatatatcttttagattaaaaggtttggacctaaattttacatgtatgagagtgttttaatttttattatattttccattaattttgaaataaaataataatttatatattagtccaatttggggatttaatttttatattatagcaatgggtcatgaataattttcaaaaaaattgatttattgaaaaaattcggaagtagggatttccgagacacaaaatttttaggtattacgcccataaaaatgttgaatatgataattttgaatttattaatttttaagttcgtaatcaaaattaaaaaatataaaattttgattataatttaaatttataaaactatttttaagttgtttgtgatctaatggatatgttcaaccatacttttgcttgctanagaattttactagtaaattatacctttttatttattattttttgaaatttatgtgtcctcttttttgttaagattttaaaaatatttc

SEQ ID NO: 33437 - DNA, 1086 bp, Heterodera glycines
tattttgaagtgttttcattgccaaaagaaattcttttttctgtcaaagtcagggctcggaccaaaactttttcaaaatcagaacatcaggcccaaaaaatcagattttgaggtcgaaaatcagaatattttgcaaaattgctttaaatcgacttggggaacaatttaatcaatttatatagcatcaaatttgtatttttcacctgaccaagtaagaaaaagttaaggcctcaaaaagtgagaatgttcactgattggacgcgtaaactggaatattgaccaaacttcttcttcctctgacttgacagctccctttctaacggctaatttaaatattcatttattaattatgtaaatttagataatacttttagcttttgcctatttttatttgttttttgattaccaattcaaaaaaatgtcggacaatccgaaggacgtggagaaggaaatggaaaaagcgatgtaataattcaaattatttaaatttccatgctaatcattttgctttcccttttcagcttcatcgctgccgactgttggctcaaagtgttcgatttgcttccacgctctcagcttggcctcggaattgcgctgatcagccgccgatttgactatttcgttgaagaacacttcaaaacgcgcaaatggaaattgggcgaaacaatttatgctatggaaattgggcaaaaaatttagctttccgtgcgccgttttgtcaaattttttttaaattattaagtgtaggaacaaaaccgaaaagtacctgatttatgcccgaccgtaaacactttctaaccatttctttctttgcttcctttggattgtgcgacatttttttttttgctggtaattaacgggaatcccgccgggaacgggaaaaaattttttacgaaaaaatcatgttttttttctaaaattttactttattttattttttcaagtgaaaatactaattttttaaacattaaaaaaatttgtctttacgtaaatgattaaatattgaattttattaatggacaaaaaataacaacatacggtagtcaaacacatcacgtgcaacactgaaaagttgctcgcttccga

SEQ ID NO: 33438 - DNA, 933 bp, Heterodera glycines
  misc_feature (883)..(883): n is a, c, g, or t
  misc_feature (894)..(894): n is a, c, g, or t
caaatcctaaaaacgaattttaattctatttttaaatgattccactcacaatttgtcgcaaaatgacatttttgttcagatagtgtcgcgaagtgtccagcagaatgcccctgaccggatattctggccaatcatggacagtagcagtgcgaagcataaactaaaatgggtaaaataaactaaaataggtaaaattataattttatataaattttaaaaaaatttaattttatgatagtgcattttgaaaccaacgctttcccctcaaaaatttcaaaaactcgacccaaaaatcctcaactgattatttcctcgattttgttccattttgaacttttcgcaaaatggcctaacaccgttattttaaatttacccttttttaagtgagtggggacaggaaaaatacaacctattgaaaacttggtttagagctttttggcccaatttttaatataatacagtcatggccatacatttatacagtgaaatatttgtcacataattttatcattaattagccaagtaatccaaatgatttgtatgaaaaataacttgatcgaaaaaaaatcttagtttacctatttcggcattttttggaaaattcaattaccaaaaccggtttcgcttcatgtgcctaaaggaaaatttttgggatatggaaaaacatatgattctacactaaattctctagaagatgcaaaaaatcgcgtcaaaatgggctcagtttaggagaaaattttttaatttgataggcaaaatggcataatttttaaaccccatgaaaaccgtctgaacgtgaatttttccaaaaaatgccgaaataggtcaactgagactccagctattttttggtgccaatcattcagattggctaagactgatnaagttatgtgnaaaatattttactgcataaatatctgaccatgactgtac

SEQ ID NO: 33439 - DNA, 538 bp, Heterodera glycines
catctgtcgccgtggcccaccaccaatttgagtgccgtcatggatttgtggggcggcggtggcactcggacggaccaccgacgccggcggtggcaacagttggaggtcataatactggaaaaaacaagttgtcaagtcaatcaaaaaacaatgatggcgaaaattgattggtatttggcaccacaaaaataatttgacacattaaaagtagcaaaattaaaaaaaaaatttcatggcgtgaaaggccctgccacaggaacaccaaatttcctcaaaattttcgactcaaaaccatgaaacctcaatttttttaatcattcagcaattgttaagtgccaagttaattgttggtggcaaaaccaaacaataagaaccaccgattggttctgaaaaattgacagttctggatgattaatattattcaacgtttatagttttcgtctaaaaaaaattttttttttttttttcgcttagtttttatgggatttgtgtccctttttgccaccgaccgacctattggtcatagtccgttgttgtt

SEQ ID NO: 33440 - DNA, 1437 bp, Heterodera glycines
  misc_feature (1391)..(1391): n is a, c, g, or t
tttcgtttaccggcagaagaaacgaagcgctttttcagcggaaacaacagtccccggaggggcccgtgccgggcggggggtgcaaatggtgtgggtggtgccctttctgttggatgaatttctgtggcattgccggcgaggcgggttcagagatcctaaaatttatgaattttttggccaagcaaaatgccaagacacctcggcaccggactgtcacacgccgccgcgaaacgccctcctcctccgccgcccctttgctgatgctgaagtggcgccgccgcaccgttaccgtaccctgctgctacggttggttcatcgcaaattgcttgcggtggcgcatggtacggtaattgctgccgatggtactgttgtgtgtggtgccttgtggagtttggactttgcccgtcggtgacaatcacaaattgaggcggtgtttggccgtgctggtgaaaatggtcggcatttggatagtggtaaaagtgttggttgtgcggaggcggcggcggcgccgccgacaaaggcaccgattgggagccctggggaaggaaaagcgatcaacacggggctcaaagactgatcgaaccagtcccgcgtgtttgacgctgatcactcgtgcgggcaccacctcgccccctccggcgccggcccgtcgttgcgccggctttggcgcactgttttgcgccgtcgctgcgtttggcgccggcacgtgttgttgctcatcgtccgttcggtctgccgtttgcccattcagcggggctattccgtttgaatgcgcttaattcgttttgtgctaattaagtcatgccaatgtgctcgattttactgccattgctgcctgcactgcactgcgccagcctttccttcaactcgttcagttcgccgttgaccatctaagggttgttgattggtttaattagaccaattaattaaatgttcctaattaatttgccattcgctttgacctgtgccctctgttgtgccaatccgtccattttgtgctccaattcgtcaattcggcctctgagctgtgccaccaaatcgccgtattcgcgttccttcgccttcatttgctccacgtgactctcctcccttttgatcatttccaattcgcttaattaccatttatttcattttgatttttgatttttccttttttggcaccgttcgcgaaaactcttcacaatggtcgtcgcctgagtgtaacggttttccaactgtgaataatgcgtccgcatgttgtccaactcggcagtcatttccaacgcttttcgctgcgattcggccttttccattggacaattggggcaattaatcgcaattaactgttttgtaaataccaaatccgactcgagggcacggattttgcttcggatggacagtgtttcctccgnattcttaaaccatttccgtctgctgtctgctgacaaatgccaaagt

SEQ ID NO: 33441 - DNA, 965 bp, Heterodera glycines
  misc_feature (922)..(922): n is a, c, g, or t
tatgaaaatttattcattagaacgttataatttaaaaatcaatatctatttaagcagcaaaaaaagatgcaaaattgaaaaaatgtttattagtgtgagcaaattaactttaaattaattaataagctttaaaatttattggaagaaaaaataattcgtaacacgtataatcaaatattgcagctacaatcttaataaaatcgtatacatctttaaagttttattttattaaagctaatttatttatattttaaaataatcaaataccaaattaaattaaataaatcaaaattatgaacaactttgatgcttcttcattaacattttcataagaaatttaaaaaattataaatagtaaataaacaatttatttagattgaaaaataaaaaaatcaccacaaagaataaacaaacttaaaattaattataaaagacagatggttgaaagataaaatattttattttatggaaatatgaaaaggataaaaaattcaattataaaattatattgaatacattaataaattgaaaaaaattaataaaaatgaatcaaacatttttgtattttatcagcgattttcacgcaaatttgaatcaatgcgataagaaaattgtggcttaaaaattgaatttaatatataaaaatctaattcagaaataaatatcggtatgaaagctattctatttaagaatagattttatgctacaatataattttgagatgcgcaaaaagataactagatatttttatataattttaattaattaccaaaattagaatattttgatataattttaaacaataaccaaaacttcttgaaaaattatcaaataagagcatgatgaatacatgaaaaattataaacttaaatcaaatttaaaattatatctaaaatgcattcttgctcacaaaattctcttncccattatattgctggaccattgtattacatgagcatctgaaa

SEQ ID NO: 33442 - DNA, 706 bp, Heterodera glycines
cttattgtgtagacggccagaaacctctagaattatatgaaaccgtgaccggaagaattctgtttttcctttacgatcggaatttttctgaaaatggcaggtgtgtccagaattcttttccgtgaaccttgaccagagttccaattttggaaaatcgtgaccgggttttatgctacttattttgaaaagggccttaaatctccagaattattggaaaccgtgaccggaagaattctgtttttcctttacgatcggaatttttctgagaatggtcaggagtgtccagaattttttccggaaaccttgaccggagttccaattttggaaaatcgtgaccgggttttatgctacttattctgaaaacggccagaaacctccagaattattggaaaccgtgaccggaagaattctgtttttcctttacgatcggaatttttctgaaaatggccaggtgtgtccggaattcttttccggaaaccttgaccggagttccaattttggaaaatcgtgaccgggttttatgctacttattctgaaaacggccagaaacctctagaattatatgaaaccgtgaccggaagaattctgtttttcctttacgatcggaatttttctgaaaatggccaggtgtgtccagaattcttttccgtgaaccttgaccagagttccaattttggaaaatcgtgaccgggttttatgctactta

SEQ ID NO: 33443 - DNA, 970 bp, Heterodera glycines
  misc_feature (12)..(13): n is a, c, g, or t
tgcaggtccacnnggatcgagaaccgggataagaccattgggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaaacaaacgaaatcgttttaaaatattcctttctggacttgacttggtttcttgatatcgaagctgttttctacgctatttc

SEQ ID NO: 33444 - DNA, 952 bp, Heterodera glycines
actcgcaatctctgaacactgcctccccatttggtcatccgcagcgcttttctcagagggcgccttctccgttgttacttcaccagggacgaagtttcagcgatttctgtaagttacggaggaatttgaatcattaaattattagccaacattttcggagtgaaaacgttttcaaattctgatcacctaatccatgtcttcagttgatccaatgtccgccgtttggcccccgccactcctcgccgcttcttccgctgatccccacgaaatgtgtagaggtcgaatagagttggcgctgctttacctgcgacaaaagcgcgaattgatcatctcattgagcggagctttcgatttgttcccccggacgaatggcactccccgaaatgcttatgtgaaactgttccttcttcccgatcgaaggtgtttttaatatactttaaaattgaaccatccaaaaatatagtgaaaatagtcgacggcaaagcaaagtcatagcggacactttggcacccgtgtggaatgagcacttcttttacgaagcattggacgagcgggcgattgcagaaagggttttggaggtgcgacctttgaaagtccaactgatcgatgccttttctgatggggatatcctaatttgtgcccacttaaggtcactttatgggatttcgatgctttcggttcgcattcgtttctcggcgaaacactcatcgaattgtccaaagcccccctcaacaaccgaactttggtctatccgatcactgatttggacgacgacgatctcatccgattggtttcttagttgtcttttttatttcattcaccagtcaatcgcttagcaacttcgccagaggcgcttttcttcgatgactccgccgatgggacagcgaagtcggtcccattggcccggaggggcgacggagcacaacagcagagggggggggggggggggggg

SEQ ID NO: 33445 - DNA, 1231 bp, Heterodera glycines
aaaacgacgcaaaaaccatttacattgacattgacagccacgtgcactatggtctcgggaaaaacaggggatggacggactaattagacgaaattaggctaattaatggacttttccatgggatggacggactaattaggcgaaattaggctaattaatggacttacaaaaaaattccagcggatggacgaactaattaggtaaaattaagctaattaatggacttacaaaaaaaaatccagaaaattacgctttttacaaattagaaaacataaaaaagggtgatttgctcgggaatattgcatcatgctgagtttcggccgaatatttttaaaaattaggtgaaatttggctaattaaatgatttacaagaaaaaaaaaattcagaaaattaaactttttacaaattaatgatccgaagttaaatttcaaaatccatttttaaacaaatccatagatgccttctatgatgattttggcccattgaatttggctgtgctttaccggttctgtcagttccttcacacattggtgctgcaacagaacaatgctcagcaacagcagcagaagaagcggatttttctctacacaagtgccgagtaaaaatggcaccccaaaaattggtttttcaaatttaaaaattctcgtcattaacataatattttttaattcggcattaaagtatctgttaaaggcatgtgccttagagcttgatccgaacctgggtaaaggcctggatccttcctgggtccaggcccaggccaaactcatggatgtcctggataatattaagggtctggattccaggtccaggccaaactcatggatgtcccaggccaaacatggatttcctggataatattaagggcctggattttcctaaatccagttccagtcaaaatatggatttcaggataatattttagaacttgacttgttatttctcaagtgaccattttttatttcaagatacttgtcaaaaaatgattaaatattttattattgtcaattagataatttaagtttttcctaaacaattaattgtttttttttctcaaacatttgtttgttttttttaaaacaaagcaatccaggccaggacatgacgagcatgggttttcttggacctggatttttctgagtttttgtaccgaaaatccagggccaggtcaaataggaatccaggatccagaattttttcaaaatgtcgagctcaaatatgtatataagc

SEQ ID NO: 33446 - DNA, 1103 bp, Heterodera glycines
aaacaatgtttcgttggcatttgaattttttgtaaattatagaaaaattaatcaaacaaaaagcattatgccaatttgtgctaaaaaaaatccacttcccccccccaaaaaaaattgtcaccatttcaatggccattataattttttgaacatttcttttgtcccccgggggcactcaccgccgaccaatccatccaaatttggcgaggggcacaaggccaaaccaattttcctctttcttttttttttttgcttttttggggcgattggtgggacgaaggtgagaaaatgatggaaaataatgtgatggtaatttcagtgatgtgagcagaggggaggacacaccgcgaataattcaaaatggaacaaataaatacacacaaaaatatgaattaaagcagaaaaaaattcaacggatggggggggaattaaaaatatatatatataatttttatatttttggcatttttaatggagaaagcatatttttaaaggcacctaaaataggcacgaaaagggtgaacaaaggcattttaaaaatgtacaaaaacgaatggcacaaaaattaaattttttcgttacattttcgttttcgaaaatattttttttattttcgcacacccctgttaggaagcctatcaacttttaaatcgaattaattttattttatttagtgttagtaattacaaaatctcttcaaaagattaataagttttgagcaggggagcggggggggggggggtcaaaaaccgcgtgccaaccaaaagtatggcataattttgtaatatcaccgaccgacgagggatttgctcattttattaattttaaaagaaaaaaaggcgagaataaaagtgtcagaaacacaaaaaacgggcaaattgacaatgtaatggacagaaagcagcagaaaaagggcgaaaaatattaattaaaaattcaaaatttatattaatttttggaattgaaacaattttcatgaaaataaatttgaaattagattggaaaattctaatagaggggggcctaaattaatattttatggctctgattttagtataaaattttatttttaaataaaaaaaaattttcgagtggaaaattta

SEQ ID NO: 33447 - DNA, 1463 bp, Heterodera glycines
  misc_feature (1413)..(1413): n is a, c, g, or t
tgctgcccgacaaaatcgaccgagcaaatatcttcgatttcttcatcatatgtgtttttgcacttgaaatttttgtatttgaataaaaagaaatcttaaaaataatcaaaaggttcgtttgccgaaattttttttcagaatttttctatttttcaattaattaacgatttcttttcaacttttttttcgcggcgtgttcttttcaatcaaaaaacttttaggggaaggaaagagtccggcggtgccgatctgccggtaggcgccgccgtggaaattttcggaaatttaattgaaatttgtgaacagattttatcctgaaattgactttggtttgcatttgcggcagtttcattatacatgattgaagtaaattcggcgcttttagaattttcgcggatttattaaattttttaaaaattagggaagataattaagaaggaagcgcgggtcgaaaattgcttaacctttgattcgtctcctaactatggaaacgcaatttttattcttttctctgttttttaagatggaaagaatttcattaaatttttgttttaagatttcatttttacatatttaagaaagacgcaaatttttttccaccgggttaccctaatatcttattggtatgaaatttaggatttttagcaggaaatagactttttaaacaaagctgtactgagcagggatggcaccgaattccgatttccgtaaaaaatttggatgtcggaattccggaatttttggtaaaagtcggaattttcggacaaattttattttttagttttttttttgccaattcaaaatgattatttatttaaagtgtaaaataacttagtctttggtgttttctgctttattttgacttccaaatgaaactaaaagaaaattcttaatttttccttaaaaaattagtccaaaatcgtaaaattaccaattttgtgcaaattctgttaacaattgccacttatattttcaaaattttccagcggcgttaacgacaaccgccggactctccccaaatgttcccaaaaaaacatatttgaaatttcgtctttcattatttattttagaaatatttagaaaattctactattttttccgaattttcagacttttccgattttcgtgtcggatttacgttttcccaaaaatttttggggcctcaaatgcatccctggtactgactgaatgtttttaattaatttaaaaaaatgaaaaattgcattatatttttaataataaaatttttttagaaaaaaatataaataaagttgaagaaaattgagtagaaaatccaaaatttttattttggacttatttggcaaaaattccgaatttttcgaaagttatatttcttattaatattatcgattccaaaaattaattttttgaaaaattttcggaccttaagtnaaaaggcgctttacagagtctttttgaaaaaatgctaatatccacataaa

SEQ ID NO: 33448 - DNA, 909 bp, Heterodera glycines
ttttaatttttaaaatttttacgaatttcctacccataacggacaccggccaaaaacaggaggcccaacgcggtgccgcacgccatgaatgggcacacgcatgccatcagcgcaagtgccaacttttgcacgtgccattggcgccaataaacagccgagagcagcacggacacagaagtgcaggtggccatgatggcaaaaccgaccttggaaattcaattaattagtataattaatgaatgaattggcccattacggtcaattagcagggagtgtaaagagtaatgatgtgaagggaaagaaatagtggggaaaattggagagactaatggggaaaagaagcgagagatggatgaaaagagaggtgcagagaaaagcgagtgcgagagcacaaaaatggagaaaagtggaaaaaaatacaaaaattaacaaaaaaaaaatgtttctaggcagggttaggcacgccgaaagtcaaaagttcccggaatttaagtcacaaatttttgaatcctgaattttttcaattttttttccagtactcactgaccatcagaaatggcagcatggaaaggccggcacggaccacctccacctcgacgtaagtggtcgaaaaggtcatcacgcggaccaaggaactgttgaactccctgaagaggctcaattaggcacgcacacataacccaaatgtgaattggatgatcagagagcgatcttgtaaacaaaaatagcattttggatcaaaaactttttagaaaccttgaaaagtttggatcaaaaactttttggaaatccttaaagaaaaatttgttttgtacccccccccccccaccttgggccttaggggtggggttatggatttagttgagcttctcgagagcctgcttcttgcttaggcaccgagatatacta

SEQ ID NO: 33449 - DNA, 611 bp, Heterodera glycines
cctgcaagtgaatagcccaatttgaggccctcacgcaacaatttgatgaagcggtcaaccggcgcctttcccttttcttttcgcttccgttgcaaaaagttgtgcagctttttcgggtcgccaattacgtcgtttagctgtgtcaattagttaattagtcatcatcaaatgagcagcatcccctgggggcgttctttcattgtccaattttccattatgaaaatgacttcctttctctgttcactcacattgtcttcaattgcgccctgccttttcagtccccggtaggtcaattggtccagcgattccaccgattcctcctccaaattccatttgatttcctttcgtcttttttcagtgttgccaatcttttgcacagttttctgccatctgaaagcagtgaatgttccgtcagcaaaagtgccgagacaattcccaaataaaaattcaaaatcagaatcctaattcaaaatgaaactccaaatgctcttcgcccacccgtccttcccccggccccttcattttttatgcttacggaatgacgtccttctcctgcttgccctttgccttcagcacttgcttcatcatcattttgggcgatctgtccccat

SEQ ID NO: 33450 - DNA, 1001 bp, Heterodera glycines
tttattatttgttcttatttcactgactgactcactgagcaagaaagtgccgaatcggcgaaataaaattccaaagaacacttcggcactttttgttccaattttttcaacgggactttacgagcccggaaggacatacggtgaacttaacaaataaacagaaattatgcaatttaatggacccaagaagagtgttttgacaaacgttcagttattccatagccaagtgcgtaaattttactgtcggagtcacttttattggaccattcgctctctgtgaattttgtgaatttggcagtgccaaaaattccagtcacttttgggggcaaaaaaatctgaaaaatatttaaattaaattaaatttataaaaacatcgtttgcttatggtgaccaaagttttataaattaaatggaataaatttaaaaatattttttaaccaaagcaatgtccgcgcaaattgaatcttccaaatcgagaaaaatctgaggagaaaacagattttatttgaaatttttgagaatttttattatggaatagacggattaaatcaaaaaatgtcttacaaaatccgttcgaattacgaattcggtggagtgggcattccatccgaatcccttcacgtggatgtaatcggccaaacttaactcatcacacagaaagtgaatcttattcttttttattggtatttttcaataattgataaaataatacccaaattcgtcgctcaaaatgcaatgggcagcggtcagaacaatgttttctttcaaattatttgcattttaattttttattggacacaaatgcttttcggatttaatttttcattattttcacctgtgagtaacactccgctgcaaaattggacaattttgcttaattttgcaatttgttttgtttttttataatttaatgaagcgaacctagagtacgaattcagtgatacgactgatcgaatttcttagcagtgcaatggaaatttcgccgagtaaagcgaccgttt

SEQ ID NO: 33451 - DNA, 898 bp, Heterodera glycines
tcacaattttggagaaatacaattacgtaaatacgagggcccttattttccagacgacaaaaccgtgggtgaatgcggcattgatggaagtcatccaatttatcgcgagcttacgtctatctgctcgctcgataaagaataggaacgaaaaaactttgaaacaaaatgtccgagaaagccttacctatatatatttttttattttttatatttttttccttttggtaaacgactcgtcatttgtagggcttatatttttaggcctaaaagctaccaagatagttagtttttaggttaaaaaacccaaaatagtttctaaaacgaaaaaaataggtactaaaaatttaaaatttaggggggggggtgtaaaatgacaaataattttattcaaaaagcaacaaaattaagctaaatttccgcatggtaattaatttattcaattatgcctttttcactttggttgccggcttttatccgtgtatcacagaaacattggaatatgattagggcccggaatttcaaatttgcggatcccattctctaagcaattcctggttattgttcgaaaaaaacaataaaatcctaaaaaaattttaatgaatttaaagtcaaaatttaaatataatatttattcgctgatcgttttttcactgggaaaaatctaaatacctatattcatttaatataaaaaattctttttatgtattttacatttctttgccaataatttgctcacaaattgtggacttaagtttccggctttgttttcataaaatgttactgattatggtaatgaaccagcaaatgagggaaaagtcacaaacgcaaatcactcttttttgatgaagaaaacataatttacggtcaatttttttttaccgaattagcagctagcggt

SEQ ID NO: 33452 - DNA, 869 bp, Heterodera glycines
caaacatttcaagaacaaatcaacccatgtgctcaatcagttgagcaaggaagtgcgtatgctggacactaatgtgggaaaggctttctccccctttcagttgggcctaatcaattggagcgctttgccttcgatgttcaagcgcaacagtgcgtgccgttcgcttatcgcgggctgaagggcaaccgaaacaattttctgagccaagaggagtgtgaggtggcatgcctgccaaattcctgcccttccggtgagactgcaggaccaaaacaacagtgcctttacgctgatcctttcccatttatgcactgtgaatcctatccatttggtcggttttaggaagtccttttgtgggggccgatggacgggcccaaagctgcgcagtaagcacggcgatgagcacatgtcccaacggttattggtgccacgttggggcgaatgctgccacgacaatgtgttgccctgagggtatcggccgtttgaagtgccgccaccccaaagtgttttgtttagcaaatgccagtccctgccaattgccaatgtccacgggggagggaccgttccgattggatcgcttttacttcgatttgggctccaaaagttgcaaatcgttcatttacaagggactgaagggcaaccagaacaacttcctctctttggtgctttgctcctttcgttcgttttcgcttttccattttctgctttagcgcgcgtgtcagctcagctgtctccccctcgacagttcgtccgtccaattggcattgccaaatggcatttgccaatgctttgctttccttcagatccgtgcattggtcagccggccaaatcgaccagtgggccaagtgtttttctgctcggcttccatcgcg

SEQ ID NO: 33453 - DNA, 855 bp, Heterodera glycines
  misc_feature (18)..(19): n is a, c, g, or t
tgaatgttatttttatgnnaattctgaaccgttttgagtagattagactagaaaaaatgaaaaatttggaaatcatgtttcccactcccttctcccaggggtattattttgtaaagtctttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaacaccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcaaataaacttttcaaaccccatttttcgcaccgtgaatgttatttttattgaattctgaaaccggtttgagtagattagactagaaaaaat

SEQ ID NO: 33454 - DNA, 941 bp, Heterodera glycines
  misc_feature (17)..(17): n is a, c, g, or t
aattaatataaaacacnttagggctatcgaataatagcaagattataaaaattgtttcatttgggggaagttatgaataattttctgtcaaatttttccattttggatggtttttgagtaacgactgggcaccgaattttttgacaaaaatgaagtcctgaaaaactagcgaaaaatgatttgctaaaaaaataattttggggtgctaaacttaaaaaaacttataaattttctcaggtaatgaaaactataaaattaactacaacaaaaaaattcggtaaagcgacctgaaaatgatttatatgtgttttttttatttttcatcaattcttttcattaggttttgtggaaccaaaacttatgttaatttcatttttgtcaaaaaaaattctttatgattcataatttacctgtcaagaggaattgtttgatataaatcatttttaattgagttaaccaaagattatccatccatcttttgccctaattaatcaatttttgtctggaggcaaataaaagagagaataaatatgggaataaattcaaatttttgccaatttaacacacttttaggtcatcattttgcgtctattttttaaaattatcgataaaaaggcacagaatcagcggaatattcatttttaacaattaaataaaagtaaaaatcattgcagcctttttttagaattaattcaaaatgtcatttacaccaaattcaacaaacaacggcgatttcacttctgatcaaggtgtaaataatgaataatttttttactaaaaattcgaacagaatggaaacggttggatttcctattaaaaaaatagaattttttcattgatttcttttatttatatttttaaaagaaatttaaaatgtgtatttttaaatgaaaattttaatttttgcaatattttagaagcaattttaattaaactctaga

SEQ ID NO: 33455 - DNA, 714 bp, Heterodera glycines
ctttttgaagagaaactcaaaaggactccaattagcgtgtgtttcagtgaatataacggtgagtcagtcaattgccaagtgaattaattaattaatgatttataattttccaatcaatcgcttttttttgccaggtccccaaacctacgaacattcaatagaatatatcaaaaaaagttttgtggaacagaacgtaaattcgaagaaaatgatttatgtgcacgaaacatgcgcgacggacactgaccaggcaaacgaacgaattgaagaagaaacaatcaaatcattcatattttgttacaggtgcaattaattctcgattcggttgcctccatcataattcaaacttcgttgggaaagtccgggctttactgacagagttgtgacaaaaaaagcagaaatatgcgaatgccatgcgtgtaatgaataaaagcaattaatgaatgaagaaagaaagttaacaatatttcttatttattgtgtaaacttaaagggactcccaattttccattttttgggagttcgatcattttcggggactgatcgagttaaatattaagacctagcaagtgaaaaagctgtattatgctgagataggcaccaattcccggggactaatggagtttgtatccccagttttgggtcaaaatttttcaaatattttttttcttttttattgtcgcaattggtttaaataccaaataaaaggagatt

SEQ ID NO: 33456 - DNA, 1509 bp, Heterodera glycines
ggggtttttcaatttttccctagttccaaatagtcaaaaaattttttattattttttcggaaataatatctattaatttccataataatattaggtactgtttttctattgttctagttcgttcgtatcagaaattttgtattagaattaattatttcttcttgaaatcttaacaactttttattaccttttagttttccaaaacatcttttttcacgtcgctcttttataaagacttaaggagaaagggtacggcgtccggcggttccgatagtcgccgccgggaaaatttgaaaatttggttagatctgttaacagattttgtccaaaatatgctaaatttttgcgattttgagccaatttttttaataaggtttatgactttttgggccctgtgatgccgataggcagcgctaaattttggaattaagctctatttctaagatttttcatcaaaaaaatttatgaatttcggtaaatttttgtttttcttcgatatgtattttgtcaaaatatgccaagattggtcgatttctatgtgtatttaatttaaaaaaaaacaatttgtcacaaagaaaataattaaagaagaaaacatcaaacggtatcgaactcacgacagaaagtaatgtcaatggcactaacctctacaccacattccaaatgtccgaaattgagcaaatcttctttatttaataaaaatttggcaaatggttaaaaaaaaattcaaatttcgtctaacttttttgcattttctcccacgaaaatgccattcttaggggtgtatatttaaccccgaccccgatcgggagggtcggggttcggggttgtcggggtatgaagcgtcggggttcggggtcggggttttccccgaaaatggccaaaaatgtcggggttcggggtcggggcggggtcggggttgcaaccctagattaaattaccagattttaattttgtaaattaaaaattgttttaaaaggttttaaatttaaatgttgagagagacagaggaacagaaaatggagaaagatgaagagaaagaagaatataaagaagaaaataaagaggaagggaagagaaagatgaagaaaaatagtgaggaagagggacagaaaggggaagagagagagaggggggaagagaacgaggaaaagagagggagagaagaacaaaataatgatgaagagagagaggaacagaaagaaacgggaagaggaaaaggggatgatggaagaaaaaagaggaagaggaaagaaagggaagggggaacagaaagtgacaaacagaagaagagggcacaactaaattattctcctaatttccttcctattagtagaatagattaggaaaatctttcccaggcacttgaaaagggcaatcaattacacgccctccctcttttttgtattttaatcaaaatcttatagataaatttgaagtctataaaatttatatttagttatattttagcttttatttgttctatttgttgccttcacctttgcctat

SEQ ID NO: 33457 - DNA, 918 bp, Heterodera glycines
cggaattcagggccaaaatggtcggaaatcgctaatcgaaattccgtgccatccctaggtaaaaaccgttaattggcgcattattaaatcgattagaaaatataattcaaaaacttaccaaaaaaataagtccaaacaatagaatgagcaaaatgatcaaactgttgcgccaaaattccattcttttccaccacggaatggcacttttttccaccaaatcgccgcccccaatgctgcctggccacacttaattaggcaattaattaattaagcaattaattaattagataaatgaattaatttatttaattgtgtgatttttacttgtgtcgttgaaagattcgtgcgcattaaaatgatcagcatcagacattttgcaggaaaattacgtaaaaagagataatcgaggaaaattcttaaaattataaataattaggggcaattaatttggaaagtttagccaatttttcgcaattacggccatttaagtgaccactgatcaaaggggcagcgagcgaatcattaataagcaattgaattacacccattaaacaaatgaaaaaaagcagaaatgttgcaggaaaatgattgaatgagagtgactaatgggcggcgactggtcattagtgaggatgggcgtgtaattggggaaggataaatggcgcaattaggccaattagtgaccagtgatcaaagtgcattcaaaacgacgccattagaagggaacggcacggaacagatgaccaaagggcaattaaaattagtgcaatggcattcattaattgagaataatgaaaagggcgactcagaaatcacattttcgttttgttgtgataatttgtagttaattaaaataataattacatttattttcaataactttgtttcaagtgcgataagaaaatcgcggcgccgttt

SEQ ID NO: 33458 - DNA, 962 bp, Heterodera glycines
aaatatgcacaaaaaaacttgaacattaggggtgcaaattaattttaaaaaaaaaatttttttctcatagagtttatcggttgtttttgcaactacagatcaaaaatttctcgattttcggcagtgaggcttcgtgtttacccactcgcgcatctattcagatttgatttaattttaggcataataaaaatttttttcctaagagatattaaaatcggaaaatatttgacgaaaaatggcaaaatatgcatgaaatatgcagaaaaagccaaaataagcaaatatgcacaaaaaccttgaaatatgcaaaaatatgcaaataaaagtcccgatttttatacgcaaacacaaaaaagaaaggctttttcctgctatttagagcatggagaagccaggaaaaaaatatgcatttgcatgtttttgcatccctgattattaaaatgaaaattttggaaatcaatggagaattgttatttaaaaataatgtttatttttataaaataataaataaaaaccgaaatgaattttttcaacaacttttttttcaaattttttattaacattcaacaaggacatttaaatcattgttcacttgttcccgccatatccagcccaattaaattttccaattttttcttcctttcgatttgctttttctttgctgccgccatttcctctcttatcttgtaccattgcttgtcttgcgactccttggtccgtcgctgtttgctcgagagcgtggacgaggcgtttgattgctcatccaatgcccgcgtcttggcattggattggcgattgtttcttctccctcctcctcctgttgctggtgctgctcattgagctgtggtgtcgtcgcaccgtccctcgcccgactttgcgcttcttcctcgttcctcctcttttgtctctttatctgtcctcctccttttttgcgcctcttttttgcgctctcaccgtcctca

SEQ ID NO: 33459 - DNA, 118 bp, Heterodera glycines
ctgaacggtctgagcatcaagccgccggcctacttccaaggcaagttcgacatcagcgttaccgcgaccgcgaccgagaaggccaacaacgactccgcctccaccccgggcaagatta

SEQ ID NO: 33460 - DNA, 446 bp, Heterodera glycines
gcatggaaatgattgaaaatggcaaatggctgagaaaggatgacagattttggaagtaaaattagaataaattatcttttttaccctctttttcaatggcattaataaaatattttgaaattcaaaatctttctctttttaccatttgtgtgcagcagcaaaaaacgactcacaaaaatggatttattctcgtcgaaggtcaaccgctcaatctcttcaatttccttcacttggcttatcaaagaaatctcttccgtttttctcttcgcatatttacttttgtaaatgttcacgaccattcgttgttttgtcattgggtcataaaaaagggaaaatggcaattaaaaaatgtaattaattataaaaatgtgcaaatgaagcaattaacatacgtaaaacccctttattttcaacgcgttttttgcaaaaagttcagagttgaagcg

SEQ ID NO: 33461 - DNA, 1678 bp, Heterodera glycines
  misc_feature (66)..(66): n is a, c, g, or t
attttttaaaaattcaaaaatatttggcaattttttgaccctcaggattttgggctaaaattgaanaattcataactcaatggaggaccggtcaatttaagtgaattaaagctttaaaaatagcaaaaaatcgggagaattttataggatttatttgggatttctatcttctaaagaaaaaaagttattccagaaattctggaaattttagatttttcagaaaaaaattcagaactcggttctgaaaagtcactcttgaaaagtaaaatactacaaaaatccgcattttttttctctattaaataaactttgttttacatttttatctcttttttgcgaattgttataaaaataaaagtgatttttggtttcgggaccataggggggtgaccaggatttttgggtggaaaaattttttcaccgaaaatattccaaaaacatgtctttaggggttatttgggccgctgatcacgaatatgcaatcagattttacttttgagatcattaagccctcagaatccctgtgtgattggggattctgagtcatcttctgggggggggggggggcggcaggttcgaatccggccggtgtacattatttttctatgcatttttgggttattttgactttttttaattaatttgaagatttcttttaaattatttaaatttattttttttaaattaaagaatttcattattttttttgaatttgtaaaaaaattaatttaatttcaaattaaataaatattcaattaataatttccaacgttgtttttaattaataaaagagtattttattataaaaaaatttttaaattaaaatgcattcgatttttataaaaacgtttccttatttatttaattttaaacaatattgtacctctcctaacaatgttgtaccacttctaatcacagttgtaccacttctaatcacagttgcacctcttctaatcactgctgtacctcttctaatcacagttgtatctcttctaatcacttttgtacctcttctaatcacttttgtacctcttctaatcacttttgtacctcttctaatcagtgttgtacctcttctaatcactcttctaatcgctgttgtacctcttctatttactgttgtacctcttctaatcactgttgtacctcttctaatcacagttgtacctctttttatcacagttgtacctctttttatcacagttgtacctcttctaatcactgttgtacctcttctaattccagtgaatcccttcacagtctatgtagaaaatctcctaaagagtcaagtgctttttcccactaaatatccaacgactcacgcaccccctatatactatatatgacatattgacatggagtttcgattctcaaaataaaatctcccgaccgaatgtacgcatcgccctgaaactactgaaagggtcttacaactttttgatgacaatccgacaacactatataaaaaaatttacctgcgtcacgactgagccccaggcacttatttctcattttttcgtgtatttggggtaccgaaactttttttctaaaacccaaatcacaaaatgcctgctgtgaggcgactaatctgaagtgctttctataatatatataaaataccaagcctctatctgcaatacgaaaggctgtacgttcgtgcacattttcagtaccaact

SEQ ID NO: 33462 - DNA, 979 bp, Heterodera glycines
ctcaattttccttcgggcctcagaaaatgcctttctctttttcggccaattttgtaccgatcaaagtgaacatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagctttgcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagctttgcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttcccttcgggcctcagaaaaatggctatcctcttttttcggccatttttgtaccgatca

SEQ ID NO: 33463 - DNA, 870 bp, Heterodera glycines
aaaattttgaaaataattgttgctggggatgctgggagagcacataggaggaggcgcgcgtcggagccttacacgcaggccagctactttttcttttgattttcaatgtttatccgaaaaatgaccgaagaatttttggtttttcgtaagtttttgacttttgaaccgaaaaagatgaatccttcttgaaatgctacataatttttctttaccaattaatagagcccggacgggcccgggggcccgtccggcttttaccgggcggccctgtcccgtttttctggacaaaccaccgggaccgggacgcccggtaaaacgggcatttttgacctgggcggcccggtcccgagtcactctaaggaatggaaacttggcaaagcaaacaatcattaaaaatttattagttttatataagctaacaaataacaaatttttgtctaagattattttaaaaattattttccttacatatgacaaaatgtttgaatacagataattcagataatttcctaaaaatgagagataaaccaataaaaaaatcgaaataacaaaatatttttttctctaaaattttctctacttttgaagtactatctacgagcagcagttgggcggctgcttcgcggcgccaaccgctctgttttagtttaaatttattctgtctctcaatctcatttctatctttttttctttttctcttcctcatttttaattaattctctcttagatttccctcaatatagttttcagaccattctgaaggagtgatttgatcatgctggtacaattgacttttttgatcagtactgaaagttatactggcataaatttttccagatttttatgttgcgcagaaaaaaagaagtatgt

SEQ ID NO: 33464 - DNA, 744 bp, Heterodera glycines
ctctcgccgcactctttcggcctccgaaagcccatgacagacgatctttggcaccgatgaaataccgtaacccgcccattccgaaagaaactcacctttttgatggccactttttctcccgattccacgtcttccgccaagaatatttggctgaatccgctgaaacaaatcactctatttccgaatgtatttttgccacagtatttcattgccctccttacagtaccccaaccgacccacccgctagcaattttccttttcattctgtattggtgcccatccgtctcgacatccactcggctgttcacacatcccatcaaataaatactaaaacattttcttttttcggagatttttattttgtattttcaaggtttgatgaaactgaaatgaatgaaaccaatccaattgatgactgttttatatatcaaaaattaaacaaaagaatcggagtttgtgaattttgggaatggcacaataattaaaaagaaaggcacgcgtaaatggcattacaaaacgaaagttaaagcacttaaaaaatgttacgggtaatggcataaagtataaatcaattaaagctgcttacgtcaaaggaaatcaaaaagtcctctcctcttataactcttcttttgcttcaaatgcaattggtccctttcccctttctccgtccaaaatttgttgtcccatggcgtcgtgatcaagcagttgtcccaccacctccgatccctccgtgtcgcttatgta

SEQ ID NO: 33465 - DNA, 160 bp, Heterodera glycines
agggcttgaattcaatgggaaagtcttttgggcagggactgaacgcaatgatcggactgatcaaagaggtacaaaaataatgaaaaactatttaatttaaaaaataatttcttcgttttagcggtttgcagcagacttggaaagacgccattttatcgtg

SEQ ID NO: 33466 - DNA, 1350 bp, Heterodera glycines
  misc_feature (760)..(760): n is a, c, g, or t
  misc_feature (1343)..(1343): n is a, c, g, or t
gacgattgttttgatttaaatataggacttgcattttttgacatttaaattattttaaaaatctttttggttttaaaatttccaatgacaattaaatgtttaaatgcaaatatgcccgctttatatataattacttaattatcccaatcattattaataataggcatgaaatgatgcaatcaaaattacatcatttttatgcaataaaaagaataatgatgaaatgcattctcgaataattgataggtcgcattaatcggagctacaaacatctgggtcaaaccaaagactagaaaatatttaaataaatatttgaaagtgattttaaatgagttgacgagcagacttttttttagaaaatttctattatctgtttacgaatttttaagaaaatttcttcccaaacgagggtgctgcgccctgacatttcagtccaaaatgatttcaataaataaaatttattattttaattgataatttatttttccactgagctataaattaaatatagaaaataattattttttaatattcaaaaaaaaattattagaagagtaaggagtaagaaaatccaaaatcacgtttcatcattcaatcgatttgttattaattattttttgggactgaaatgtgccatcctcggctattccttgtcacatcgccatatccatataatttttcacttcgtctcgtcacctttttcgcggtccacgacttttctcttataaggaacatttttaatttgaaaaataaaaattanattttagatacatgaataaatttattaaattaaaatttatgcctttacatactagttattatttgattattacaattagtgaaagtttattcaaaataatgaaataaagtaaaggaaaagtttgactgattaaattagcattcattgatcacatatcatcttcaaagattaatgaattaactaccacaatttgaaaaaaatattaaaatttagatgcataaaaaataattgaaccaatattgggcgagtttttgaaattctttcatcaattaagaaaattgaagctcaattggttgatcatctgggctaaaattaaaaattattatgcaattagactaatttaaattatttttgtacctgtaaatgacaggttggtcgttttttgtttgttcatcaccattcccatcgttatcaacattggtcgcagaaggcacttcgggttcagcaatcatgtcctttaaaattaattaaatatttttaaaaatattttaaacaatttaatcaaattttaaaatttttgaactaaattcaaactttttcggaatttaatttatgaaatatacaatatattaattgaaccctnattataa

SEQ ID NO: 33467 - DNA, 107 bp, Heterodera glycines
cttccgatacggattatggaacgcgatgccccactccctgagttggtgcttcacgggatcgacgaagaacgaacagctcgccaggaacgccacgctcttgccggcgt

SEQ ID NO: 33468 - DNA, 778 bp, Heterodera glycines
  misc_feature (8)..(8): n is a, c, g, or t
tagcactnttggttggtctaaaatcaaacatacatataataaattatgagtagaaaagaatcattggattttttattacattcagcatcaattttaacaaaaaaaaaaaaaatggaaacagggccaaaaatcggggttggcaattcgtttttaacaaagaaacgaaattacattttcgtgcgccatttgtcatgaattgaagctcgtaatttgtttcatatgtaagtggcaaatattaatttttcttttcaaatgcccaaactcatttgtatgaacagcttcaaatttcattttcaaaattaattgcaaaaaggtgatcaaataaaataattttaattggaaattcatagaagaaaaaacacacagattaaatgaagtaattataagttgtttttcaggtaaagccggaataatcgtaaaaattttcttttaattttttcgtttgaaaataaaccgaaaaaccgtttggaatgcctgccgatactccgtactaaaattgaaaataaatatttaaatatttttttaaattttaaaaccttgtaaaatataaaattggtccatttgacgttgcgccaataatcccagaaaatgcggcaattgcatggccaaaccaagcagtgatcggagatgaaattgtggtaattaacatcaagtaggaaattgcagagaaccaattaccgccgacattcacagtaattatgaaaaaagtgcgcgaaaagtgcgacgattgatcgaatcagcggacggcaaacctaaaaaagagttaattaagtaaatt

SEQ ID NO: 33469 - DNA, 781 bp, Heterodera glycines
taattaatgaaaacataaattttatctatttttagtccctcttgcaaaatttagaagaaaaaggtaaataaataaattcttttttttgaaaactgggcctaggcttaggctaagcctagaatttgattttaatcataaaagaggcgtaggtttgagttagctaagcttagactatgattttcaataaattaaaaataaaataggcaaagactttgattttcaaaaattaaaaaaataaatatacatataatatcttttttattaattaattaattaattttttatttttgtttattttgccattcacccattttattggtcatttacccaaattccgttcggatattccagcctttggtgatcagtggcccagccgatcaggtcaaagtcgggcagctcaacccgttccatcatcttaataaaaaattattattttttatttacgtaaattatcatttataccagggatggcattccgaggccccaaaaacgtcggaaatcggaaatttttcaaaaatataaaatataataaaaaattttctaaacatgttaataggctaaattttttaattcttaaccaagtaaaaggcgatttcaatttttttggtatatttgaatattttgcttgaaaaattattcaatgattttatctaaatctttttttatgtcattttgcataattttagaacattttttggaaaaggagtgagtatttacacgttttttaaggcgcgcttttttcaaaaactttttgggaacatggaggagggtccgggaaaat

SEQ ID NO: 33470 - DNA, 686 bp, Heterodera glycines
  misc_feature (9)..(9): n is a, c, g, or t
cttgaaaanggcgcttcccggaacaattgcacatcggtcagtcacattggcactgtattttaaatactgtaaatatgaagattgactgactgacaatggtgtaattttaggcatttttcatctttttttcatataaagattttttaacgataacttgttgttaaacttagactaacaaaaacttttaaagatatttctatttagttttattttggttttgtgaattgtttttttctaaaattttcccaagcaaaaaaaaaatttttatttaaaatttttcaaattttgactccatttttgactccatttttaactaatttttttattatttttaattttgcaaaaaataattttaaattatttgtacactggtggaaaaaagtctttactcagaacatgaaaaaccaccttaaaattcatttaaaaacctgaaataattcatgctagcttatcttttgatactgatcaaaaaagtctcttacatcaacttgatcagatcactttttcatggtgaccaggaaagtcaaaaatggcttgaaattgtggaaattttagaaaaaaattcctagggggttaggaaaatttttttggaaattttgaataggctcattggatagagcacaaaattcactacagaattgccttttggatggttaggctacgatttatactcgctgagataggtt

SEQ ID NO: 33471 - DNA, 693 bp, Heterodera glycines
cggccaccggttggcggatttccgtttccgtctgctcgtccggtggagcaaaaagaagggatttgaacagattgacggagaagcagatggatgaataaatagttgttgtgttttttggttggatcaatccacaatttttctttttttaaattttttttaaaatttaaattgatttcatgtgatttaaatttaaaattaaacagttggtgattttagaccgacttctgttcattaaactttggtctctttggatgattgtatgaaaacactatttatttattttttgaacaaatccattcttgttctcactgttttctcattagttttccaaaacattagaaatggttgttttaattgtgtacaaaatggtaatttaataaattgaaaaaataaatttttatggctgatcatgtggggtcgggaaaaaaaatatggatataaaattcagaaatattacaccaaatgtggaccaataaaatccctaatttatggataaatttctcaaaacttcttaaaaataattaattttagttaaaagtctataaatgataaaatttttaaattgaaattttcttatgaaaagaaagacaaattgattccggttttgtaacagaaatgacaattgttttccggtttaaaaagaaaagacaattgttttccagtttaatataagtaaatacatttcttttccgg

SEQ ID NO: 33472 - DNA, 1378 bp, Heterodera glycines
agatttttagctttaattagtgagtttgacgaaatttcctttaagttcgaaaagaatatacagatgcttatgttcaatcttatgtgaatgttctatggtcttatgtgcctataatttagaaaaatattttcatttgtctcattccccaaaaaattaattaattaacccaaagttaattaggagtcctctccaccggtcgccccattcattttcccaaattcatggccaatttgcaccaccccattcggtcatcaaaaaaaagaagcaattaaccaatattgacgcaatgggacaaaaggagcccgcgggggcgagagtagtcaatacaataatgtgtgggtaatgggacaataatgtgctgatgaatacataatgggtcgaggatgagggaatgaatggcgatgatgatcggttgacttgaccggagagtgatcaaaattttttgccccttctccttttccgctgatcacttgttgctgaggacacacaaatctgatcagtaggacactgcgatgaataacagggggcgtgtggttgggaacggaccagaatatgtttgttggacgactcttagctgatcagcatgggggacgggcattgtcattgtatgggtaaaatgactgatcaatccccgcacaaactctatttaaccgccaagcagaggctgttctggtctccttcggatttgggttaaatatgatccaaactgatcatttttggaccaattgatcagtcattggtcattacttgggctaatcactctctgtttattgttttaatcaaattttctcagtctgtgattaccagttttaatcaaattgatcatcacgctctggtcaccatttgaccaacttgtgaccatttttggtttctgttagtcagcaatgaatgatcacacagatatggcaaataatttgttgtttttaaaaaagcgggcgagaatatgccgaaaaaggttggttagcaaattttatatattttcttatcatttcattgaaatttccaaacattttcgccggcggcccaaatcagcaccgtaccttattttagcattattttttgaaaatttgaacctaaaatggcaaaaaatttataatgtttggcgcaaaaccggtacttgaaaaataacactgggtaaaaaaaagttgtccgaagagcaaaaaacaaagttctttgggtttatccctcttgaaattttttttctggctacgggcctgcaccaaactacgacaatccaagtccaataagcattgatcaagcataacccattcaaaaatataatcagcaacctttgatcacttcaagactaataagcattggttcaaatcgcacatataagcacggaaacccgatcacttcacaactctcagcacattaa

SEQ ID NO: 33473 - DNA, 850 bp, Heterodera glycines
ttttaaatgttatgcattggacatacccgacccattcggtccgataatagcggaaaatcgtttaaaaggcccgatgtaatgcttgcctttgaaggatttaaaattttcgatttccagcgaatagaggaatccgtgaccttccattacctaaattagataaaatacattctcgaacaataattaggtactagggccgcaacttttagtgaaaaaacttttttttttgctcaattgttttgaagaaaggagctcaaaaaacgcatttctgcattaaaattttttcatttggacgtcacttttcgtcactataaatcactattttggggttttgtcactaaacacagcggcccaattttgggctccaagtacaattatgctggatttttatttaataatcagaacgccaaaactttgcaaaacttaaaatttttttgggattttcccttgtaaaattagaagagccgatctcgagttaaaaacataacttcgaaaaaataaacagggattcgatggagggggtcaaaatattggcctatgcaaaatttcaagaaaagtacccacaggaaacatttttttcccaggacaaagttttttctttttctctcatttgggcgtactatttccatgtctctaacatataaaataacacatgaatcatttatttgccaataaacaattttttaaacttttgactaaattagaaatattcttcagaattttcccttcaaaatgagcataaaatggttttatttggtctattattgacaaagttataagctaaaaaaatttaataaaatcaagggtaaaatatagtgtgtaccttttactatttgtatttgttcttttggcg

SEQ ID NO: 33474 - DNA, 1524 bp, Heterodera glycines
atatttttaacaaattgccgcccttttcgcctaccctgttaagagaaatcttaatttcactaataatttctaattttcttctataacagattaactcttctatggtgagtttttcaatttctatgtactttattaagtaaacaataattatcaaacatttttctatgattgcaaagcatttaaaaaatcataggcttgtttattttcattatgttttggaaaggtcaattaaataaacaatttttttttgtaattttattaattgtataaatcttatgcaattttctataagcaatcgatagtgtaacaaatagagaagataaagtctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccacattatacgataagcatttcctcgcacaccgctctatttgctctgttttaaacaacaaaattttcccaagcattcatactgttcggatgagcctatttgaattatattggcgatctgtctattcaaatccccgccattttgttgttgtcactcgcccataaatagacggtcattccctccctcctggtctttcccctcattcattttattttgttattttcctccgaccaaattatcttcgctttttatttattgttcgtcaataaacatttatttattgattgtcttccttaaaccctcggaccgaacaattggcgcagtcacaaaaatttggactttgctcacatcttcgggtaagaacaattgagagcattgatctttttaggattaaaagcaaaagccgagacggcacaacaaattcaccgaaaagccgggattggctgtgaattttgattttaaagctgagttggcaaaattcttcaacaaagcagtcaaagaaactgctcagtcgtcaaaagcctggtcggcaaattcttcaatttaagcagtcaaagaaactgctcttctaaagccgggacggctcgacatttcttctaaagccgagtcggcacgccaaattcgtcaaaagccgggttggctaaatattaaattgacacctattggtgcaatacttcaacgtttattgatttcgggtcgaaacaataatcgtctacaatgacgcaacccgccgcggttcagccaaatctgcagcaattaatcgacgtaattgctcagcaacagacgcaaatcaaccagctgataaatgttcaaagaaacaatcagccaaatccagcaatcatccaaacaataccgtcaatgccggacgtcgcaattttcgaacaatgcgacgaaaagcatcgcatcaccgaatggctggagcgtttcactttgccattgactcgtgcgcaccgaacgcggccgatgacataaaa

SEQ ID NO: 33475 - DNA, 311 bp, Heterodera glycines
ttcgtcgtccaatttgcaattatataaccaaacaaatcatataaaggttacaattttcgatagtttttttgcgataaaataacgaaaaaattgccaaaaaataccgaaaaatggtcgatacatttttcctgccggtttctagtatttttagattgttagtaactcgctctaattcgaagaatctaggtttattttagaattttatggcgaaacttacaaaatgacttagagcccgaactgagcatctgctaatgggttttttgggttctttttttaaaaatttagcaatttttatggggatgtgctaaaca

SEQ ID NO: 33476 - DNA, 962 bp, Heterodera glycines
ctagagtcatggcgctaaccataaaaaagatgaatcattttttgaaaaatttatatagttcgactaaatttgaaaatcgatttatggtgtacaggatgtttgtcgaaacataactcgtcaggcctttaagatagacctgccattgctattcctgcaaatattgagtctagtcagcccaatcgattgctattcgaatggtttggggtcgttggcccaaacaaaagttgtgctgcttcttgcaaagaagactaagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcagaataataatctatagaaattctcaaaaaagtagttcctcgcagattcggggaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcgttggcccaaacaaaagttgtgctgcttcttgcaaagaagactaagccaactgtaaacagcaagccatccaaatgcttcaatgtaaaaaaaaattacatttggatgcaacctttatttttcctcgcctctcttttcgaaaagaaagctattagcaagcgtgtttggaccattctaaaacaaatcgagtaattaatttaatctgactttatgagataaatgggaatttaagcg

SEQ ID NO: 33477 - DNA, 931 bp, Heterodera glycines
gtacacatttaagtaataatgtacatatacatttttaagcttagaactgcgagagtataaaaataaatatatttaatttgaatctgtactgttatttacttgttgacaaaagtcccgaaaaatcataaaaaacccagccaaaaaatagtacgtcaatgataagcatcataagcccttgcctaatcgtccaactcctgaagccatttttcagaatcgctcagcaactgatcaacatcatctatgccttcaaaggacgcttctttattgttcattacgaggctaacaaattgtcgaagcacaaagacgtgccagtcagttgaaggatcgtaaccatagtgcttctatttatatttaattgtgtttattaattctattcagaaaaacactgcataccagcattcttccaagacagcttaacttaatcggcactattgccctcggagtctttcatggcatgttgtgaaatattggcttgagaaagttttgctcctgctcctgccatagtcaatatggcgcgtattatgccgattaaaaattctgggcgcaaatgcagaagttttgtaaccgaaaagcgccgccgcggtgtagtagaactgctaccgccgctgcttctgctgcgatcaccacacatactatttctgacacttccatgaggagtttcacaacgaacaggtcgtgaaaatggtgctaaagacggaaagcaacaaatcttgcgcaaacagatgcaatgaaaagtaagatcacgaattataaacaagttctttaaattttaataatatttacgaaaaatgaacaagaattactctgcgacgatgattgatgccgtcacagattttgtggcgcaacaaacacatctgcatcagcccctgccaatgatgtggatgacgacttctcaattcgtctgttcatcatttgcacgcacgcatttaat

SEQ ID NO: 33478 - DNA, 1015 bp, Heterodera glycines
acagcctatgataagcaaatgaaattattttatacacccatttaaattaatattttgcaaaatttaatattataattatctactttttggttttaaaaatgaatttctctaaatttaaattttaatgctttttttagaaaatatgtgcttttttaaaaatatcaattttatatgccgctaatatatatgcaaaatagaaatttccatttttgaaaatggaattgattttagttaaataaattaatttggattttttaattttttagccgggggataattaaagtagttaattttctttggtatgcccacctttgtatattgggcaatttcgttgttcttggccgcatttcttagtgccaacttttcatgctttttgtccaccatttcatgtttggcgccgtttttgcgccgttcgttgcgaaatgcgcggcgtaagccccattcgtccaccactgctctgctgtagtgccgttcgacccctctctcgtcaatttcaacaaatggcaaatccattcgttgctcaacgttcgagtaccacgtgttcggttttatttgctgatcatattcattatgcaaatcctcttcaatcttttcgatatcatctgcgcaaagaagaaaggaggatttaaaaaatatattattgttaaatgaaaaaaatataattgattgaatctacattatgattagagaccgcattttgaggcataagcctttttttctgctcactagtttcgatatattaagcataactaacacattttccacttgctttgaggcttctacgttgacttttattatgccttttttttgtctttttcgggattttcgtgccttaaatgcctttttaggcgtttttttttcgattttggtgccttttttggcatttttttccggaaaattccattaaaaatggaataaaatcgggaaaatacacacctaagaaataacctggaaaattttcaaaaaaaacatccctaagaattgaaaaaatttctgaaaatacaccattaagaat

SEQ ID NO: 33479 - DNA, 594 bp, Heterodera glycines
aatatttttctattcttaccaaaaaccctctttattgaccttttgtggctaaatttgcaataatcggatttattaaattctgtccgtccttttgttacattttggcctttgccccccccccccccttaagacaatgtcctcgtgttggtcagcggttgcgtcgtctgtccctcggggttcaaccaaagtgtaattaacatgcaattggtgcaattgcaccctgaagggtccatgctcacctcgtgctaccaagagtgggaaagtgtgaggtcagtgagagaaggaatgccaacgacggattaaacattcgcaattgcccattctaagcattggcctaagcattgccactcttttttttactgaattttttaaagtgccatcgaaattcggacgcccattggctccaccacgccaattccttttatcatcggcgccgttttctcggagcgtcgctgccccgggctgttcagcaaggatgcgcttcgcatggagttcttctcccattatcttttgctcgaaaatgtccaatgcgtttcgtttaaccaaaaacggtacggtaaagaacgattatactgtacaaaagtacggtgcttt

SEQ ID NO: 33480 - DNA, 874 bp, Heterodera glycines
  misc_feature (758)..(758): n is a, c, g, or t
attagcgatgaatttttgaacaaatagtcaactgaaaacacagtaaaaaaatttaaattcgatactgtcggttcccttttatttatttgatttcaatttttctcacgagagtgtggtgcgcccgtgccgcaaattccccggcggtcatcgatttggccaataggtgttggttgaaccatctgattaagtcctgcattgctgccggcacttcctcaggtggcatcggctcgaagtctccgatcgtcatgttgaaggtacgcaatcagctcgcccgggtgtcgcgtcggtccatcacttccaagtgaagttcgaagaaggtctgcaaaacgaagttgtattttcacggtacggcatgtgaagccagttgattcacctgcagcgtgaacttcgcgacttggaaggcggacttcagcagggctgacagcagcttggcgtcgtcttcgaacagcgaataatggctgtcgttgccctcctcctccgcttcagcttttaatagccattaaattctctatcgtcatggaaaattcaaaatgtcctcccgtggcagttgtagaacggatggatgcacaccttagcttttaacaaatcttattttttagatacggtatgctttgttccaaaatttaaactcaaaattcatattgtcatgtaggaatgatctggtcaccttaatgccattgacttatttgatcagcatcgacagttataatagcgtgactttttgatgttttcgccaaaattggggggccattttttanataaacattaataccgatagcatcgattctcgaatttttttagtgatttaatggtcaaaacttaattagcgatgaatttttgaacaaaatagtcactgaaaacacagtaaaaaaat

SEQ ID NO: 33481 - DNA, 1375 bp, Heterodera glycines
aattttcttaaaaattaataaatttatgtcaaaaataccctaaaaagctaaaatttcgcttttttggtagtttttctctagaaattgcttgttttcttctaaaaacgagttcttataccgtatttagccattttagatgtattttactagaatttaatgaatttgaaaatttttttttgaaaatttacccataaattcggaaaatttatgtccatattcttgccattttctgtccatattttgcgatttttggtccatattttatggccatatttcgcgtttttatatccatataattacaaaccctaattattaataaattgctcaacaaaaaagcatatttttatataattggaacgaaacaattaaaaaagcatttctgagagaaaataagcacaacaaattgagatcgatcatttctcaaatacaattaattattctttcccgtacacttaatcagatgacatttccgttgctttgatccgcttcttctttttcttcttccgttggtggcgacaatggcctaaaattaattaaatattttatttttcgataaaattcaaatgctattgctgctgctcacccaatggatttatcgaaactccacagatcaaaagtgacattgttcaaattggcactcggatttacgctgtctttccatttaattgctggcaccgtcgccgtctccccaattgggcaccgttgcaacagccaattacacacatttacgtcgaattcgtcgatctccttcgtcagtgtcagcttttctttcgtccgtttgttcaccaattcaaatggttcaattggcattggttccaaatataaattaaatcgaattttgtaactgatagaagtggtggcacgacggaatgcctaaacacaaaaattggtaaaacaaaaacaaattgacgaaaattctggcgagacgacctctttgaagctgttgacccatccgagattccgtggagaattaaagtaatacaatcgcttcggttgaccatttttgctcggagtgtgcaaccatttggtcaacgcttgggcagcagttggattcagcacatcaaaatcggcaattccttctgggaatagaaaaccggaatcaattgcattcaattgatcaagatcagtgagaattgttggtgaagtgcgacgacgcaatttgtccaaataatcgccatcgtgaaagcccaaatgacgaatgtttggtgcaaaaattggccaaatttcgcgaacaaaaacatcccaaattgactgatctttctcggttctgtatggccacaatgtcaatttggtgcccattctgtcccaaattggcttgttggaacggagaaatgcgagcacagagtagtcaatgtagctgaagaaatattaaaat

SEQ ID NO: 33482 - DNA, 906 bp, Heterodera glycines
  misc_feature (9)..(10): n is a, c, g, or t
aaagacatnnagaatttatcgtcaacaacaacaacaacaacctttgaataggcatgtattaaggatcataatcactttggcgcgggacattttgatgttaaatttacagggtaataattcttgaatattgaaaaatgcattaacgtttggcgccaaagtgtcccgtcctgatcgaacaaatcaacaatactatccgaacaaattttcatctgctcaacttactatacagtatctctttcggtttttcgctctacgggagtacaaaaagtgcaccattgccatcaatgaaacataattgaccaaattcattacgaaaataatgacgcactccttccgaaaagtccaattcagcgccatttccagcaacttcacgcaacagctgtactgttgcagaaccaaaataaaccttaaaaatttgtctattcatttacctttttatgattttgaatataatttcaatttttattaagaaatactaaaagctagccttttttataccaacagttattgagtctttaaaccattattcggagacatcaattttattggcaagagacttttttttatcaatttcactgttggtgaaaatacatgggaatttaaatttttatccaaatggaaactggttccgagccgggaaatttgagaatccgatttgaacagcatcggagagactcggaaccgattgcttttaaagggatcagcccgtctcgacccgcccaatttcaaaattgcagtttctagaaatttcatattgaaaaatttttaatttttcatttatttttcttacttgtactcctctgcattttttgaaagtaatcacagcatgatcgctcaatattcccagattgaaggatcaaatttcaaaccatatttgccctctcttctgtattcttgtactcttgc

SEQ ID NO: 33483 - DNA, 892 bp, Heterodera glycines
ttgttggtgttggaaatgctgttgtaccgatctctgaaccatctcgtcatggagcaaccggtgacgcgatctctccatatggcgctcaattgttggcccaaaagaaggcactaaaatttaatattattaaaataatttatataatttaatttattaaataaattcaccattttcgccttctaacagctgaggctgctgcacagcctgaccagcgacaacattacctatttttttgggggggggggggggataaaaattgaaatgtgattattttaatacctatggccgacaaaggcacgcgtgaagtgcgcggagttgactgttctatatattattttgttttatgcacaattttaaaactcaccgttctggttttgtgcgctacttccctcgccatgctcgcccccgttggcttcgttcacagttgatgctgacgtcgatgcgcctatggccacccggtgtctacgagccctgtcctcaagacgattcccgagcagggtcagttcaacagccgccattgggttataccgcagacgaaagttaccacgaccaccgcggttctggaaaaaatagttttaattttaacaatgttgaattattatattaaaataaaattataaaatttaaaaaaatccaataaataaatttaaattacgttcgaagcgaaacattccaatctctcaatccgtgataaattctgcaaaatgactgctctttggtctatcatctgggagcgcaagttgaaaatgatccggttttggtcgctgaccatccgcccttaactcctggatcgaattcgagacgttgtcggacatttattcgtcgctgattgaaaatgaatttttattaaattgatacctaaaaaaaattttaaaaagaaaatagaaaaagt

SEQ ID NO: 33484 - DNA, 900 bp, Heterodera glycines
  misc_feature (300)..(300): n is a, c, g, or t
  misc_feature (349)..(349): n is a, c, g, or t
aaaaaatacaaaattttttccggcggcgcctatcggcaccgccggcccaccttgttccccaaaagttttttttgaaaaaagcgccgcaaaaaaatcaacttcggtttttcatgcttagaatttcacaaaatgtttatttcgaacaaaaaattgctcaaattgatcatggacaatcaaaaataaatcatttgaaaattttaagcgtgttttaataaactttataaaaatgaggctttttgacacaaaatgaggctttttcgcctgccaaatgaggcttttgaaatttttgatctgggaacnctggttataaataatttttcatcaaatcataatgatggtttttaagtancgacttccgcgcccactcagtggccagcaaaaccttgtcctttttggggaaattgcccgtatttcctgactcaattagtcatgaaatccttttcctgtgcccctgttttcaattttgattgcaatttgccttggcaaagttgaagcatccgcctcaaagcttaacacttcgtcccacaccggctccatcgtgcgtttgcgtgccgcgcttttgcgccgtttcaacacctgaaattcaattacaataaaacatgggcaatttaattaaattaattttaatgaaaagaattttgttttatttggctattttaaatcttttggacaaattttcaaaatatttattttattttataattgcattttttatttccattgccttatcatccggtccgatcagctgtgcccgtacaaacacatctgatggaaggccatttccgcgcgcagtgccgccatttgccaagcgcaaattcgatgcctttgaaattcaaaatttaaattaattatatttgcatttgaatttgcttccccacctgatgaacgcttagcgtcaaa

SEQ ID NO: 33485 - DNA, 1014 bp, Heterodera glycines
aaagatgatcacccgattagcagacacctgtaaatgagaatatggattaatttaaaaaagaaattagggtataaataaaactcgccaaattaacgcccaatccgccggcgcgagtggaaatgagaaaaagcaaaaaggcggaattctgattaaatctgacaaaaagaaggaataaaatttagcaaaatacaaaacagggttatcacttgttgatcagcttttcgcggtccgaactcgacgtggacccatccaaacgacagtacgtttcgttccgcacaaagtgcaccggcgcaccatcgggcccaatcggctcaccgctgtgcttcttcagaaattgctcaatcaaattgagcgtgacgacactttggctgaaaacgtcatctccaattaaacaaaaatctcagtaaaatttcgatcaacctgaacagcaaaattttttctccccgtctaatggtctccgaaatgatggccatggaaacaaacattttcgaactgtgctcaaccaaacccgtcacatggtcacgcaaaattgattcagcctgacaaattgagaccttctcataagggttgatgatggttcctccctcacccattccaagtcgatggaattgccattctcaaagaggaattcgtcggacaacaaatcgcactcctcccccttggccatttgttgcggctttcgttttatcgtttgctttggccgttcactgccattgctttgtcctcccttttcatttacacacggaagttcaatcgcttcattacaattctgctgctgttgctcatttggtgtctccatttctctttttgtctgaattggcattgcaaattcggtctgcagataaaaggaattgttgataagattatttggctgctgcagcagttgttgttggtatccatttgctaccattgaattgcaattcccggcaccgttcgacggataataccaacgaggttgctgctgattgaacggccaaaggtcgagtaatcgtagtccatggtgaagaactgatg

SEQ ID NO: 33486 - DNA, 758 bp, Heterodera glycines
tatgttgggccgttctggcgaggctttgaccaaaacgctgcggacggaggcatttcggaatttgatgcgccaagacatcgctttctttgacgacgaacggcacagcacgggcaaattgtgcacgcgcttcgccaccgacacgcccaacgtgcgctacgttttcacccgtctaatggtggtcatttcgtcggtggtcactttgctgggtgccattgccattggattcgtcaatgggtggcaattggctctgattttgttggcgataattccgctgattttggctagcggatattttgagatgcaacagcaggtgactgaccaacaacagaaaatcaaaattacggagttggggagttacaaatgttcagtttggcaagaaaatgcgtgacaccgaactgctcgaagacgccgggaaagtggcatcggaggtgccattgggagggcgtaattgggaacggaattgatttgtgagtggtcatttgaggcggttgaaaacatacgaacggtgcaaagcctgaataagcagctgttcttccaccgcaaatacgcctctcttttgtctgccccccataggttccccccccctttttttggcattttccattgctcattcagtgccaatatgcaccaagtgcacatctacgggttcgtgttcgctttctcccagtcgttgatcttcttcatgtacgctcttgccttttgggtcggctcccttttcgttttgaatggcattatgcgcccggcatcagtttttcggt

SEQ ID NO: 33487 - DNA, 913 bp, Heterodera glycines
  misc_feature (575)..(575): n is a, c, g, or t
  misc_feature (678)..(678): n is a, c, g, or t
gtggccagttgttcactgtgcgaattgaatgaatcaggcaaattgaacgccgccgggagagtcccgaaaggaatttctgctcaaagggcatgagacacagaacaatgctcgtcaaatgaaccggtcggattttcccggtcgtacaatgggcactcgtctcccaccatggcccaacattcatttctaattcgtccgtccgtccttttccctctcacctctgctcctcctctctgaacatgcgcacacacgcgccccgaccgaaccgagcgtccatcagaatgcgttggatgttcattttggtgaccactttcttaattgaatgtccataattaaggcaaatgcttttctaggggaaaatttttcttaaaaaaacgaaagctataaaaaattcaaagaaagagagagagaacattttcaaaaaatcctaacaaattaaattttaactaaaaaaatgttgtctaaaaaattcaagtaattataaataattttgattgcacaaatgcacctcgtcgtcgttgaggttgcccaagtggcggacgagcaggtcgatgatttccgactcgacttcgtacaantggttgttgttgctgctgctgttgctgttggtgtggtgggtgttgcaattgctgcagttggtgctgctgttgctgatgaactgcttgctgctgttgttgttgngaaatggtgttgtgctgctgcggccgtagcagtggacagaatgtactgcggcaggggctgttgttgtgccgatgccatcatcagcgaggaggaagacgaggaggacggagtgccgacgccgaccatttgatgttgccgaaaggacgctgaagtgccgctccgatttgtgccgctggtggacgccgaattgacgacatgtagaccctttggagaatgtgataagaatcagtctcaa

SEQ ID NO: 33488 - DNA, 611 bp, Heterodera glycines
caccaaaaatcgtgaaatatgcacataaaaagtgaaaaatatgcacataaaattttccaattgagggtgtaatttctcaaaatttctttaaatttgttaaacataaagtaaaatcttcaaaaaatgctaaatgtggtattaaaaagcattttaggagaaaaaaacacgatacagcttaaaatttactcattttagcgaaaaatcaacctgaaaagcaaaattttgcttatttttgacataaattaaccattttttgagaaaatttatttattcaatatttgtcgtgaaaattttgctaaaaaattatttttttggaaaattttccggtttttgaggtcaaaaaggccaatttgtctgttgagggccgatctattagaggttttttggaaaaacgccaaaatatgcacataaaatatgcacgaaatgccaaaatatgcacaaatatgcaaatatgcacataaatcgcgaaatatgcacaaatatgcaaaatatgcatatggaaagtcatcctagaagcttcaaaacaagctaaaaacatggttttcgtgcgtttcaggcctcccacagtccaggaaaaaaatatgcatgtgcatatttttgccagccctatt

SEQ ID NO: 33489 - DNA, 447 bp, Heterodera glycines
  misc_feature (442)..(442): n is a, c, g, or t
atttgttgtttgtgaattaacagaaaacaatggacaaatgttgctgaacagggggagaattgttgcacaaaaatcaaaaagagcaataagcaccaaaacggataattaataggcaaaaaagacggctaatatgtttatttatgattactattttattattattttgattcacttttcggctgtcggagcgaatgcttttgctatgtcaaaatttgccgccgctctctttttggcccaatttgttttgaagaacattgcttttttctgccgcatttgctttttttccacaatcgaatggtcgtgaaaaccgcgaacgaaaacggcaccacggtcgaccacataaacggcacggaaagggcatttaacactgaaaaaatgacacaaataaattaaggaatacggtcgtactatgatcatacattttaaaatggtgggaggaggnggggg

SEQ ID NO: 33490 - DNA, 832 bp, Heterodera glycines
cccccccatttgtttctccctcctcctcatccccttcctctctcttttgtccaatctctcctcccttctcttccttccctctttttctttgtctctctcccaccttttcgttggtggcattttgttgcatttctccgctcgttgtcggctcctcttccgccgccgtttctgctgccaccgccgctgtccccccgtgccctccgaaaatgtctttgagcagcacttcgattgggtcttcttcgcctccgttccctcttcctccttcctcttcttcctcccctttctcccaattgttttccgccatttcgtcgtccttttcctcttctctttgctgctgttctccactgttctgagtgtcttcttcgttttgctcttttttctgaatgctttcattcgtccaattaattcgcttggccatcattaaatggttattattatatgcatatacaaatatgctcattagcttataaatgccataaatattctggcgaaaaaaccctccccttctcacctcctccacattttcaagctgtactccctccgtgccattagcagaataatcgatgttttcctgaagaaaaaagtaatgacatcattaaatgccataattggatttgctattataaaatagtaaacaaatgatcgatcgattgtttgtctttggtttttgttttcttcgccattcgtcccactcactcaccaataaccaaacgtgcattttgttgtgaatgttcggcgcaagcaatgactcagcaacgaatttcgaatgttccttaaaattaattaatttattagtcttttgcatttccatttgaatattatttccctcctc

SEQ ID NO: 33491 - DNA, 877 bp, Heterodera glycines
ttcaaatttttcattggaattgaattggttttgtccctattttcccgatttctgtccgttcgcccacttgtgagtgccatgcgagcagtgaagcgcaattctgtccgtccggcagcagttccatgcctttgtaaatgtacttcatcagcaaatccatttcttcggctgacaacgattttaatgccgcttcaatatccgcacttttgaagctggtcaacacacggacaacaagtgaagtcgttttgtctttgagcgcctaaaatgtaaaaagaatgacggaagtctcaaagaaaatctaacgaattgacaaatgaaaagtaataaaaggcaaaggcacaatcaatgaccaacaaattcggcattccctgccatttcttgggatttcatttgccaatctgtccattcggctgtctcgtgatgcccttttcggacctgattcttcgttctcagtggggcattggaaagagccgccttcaacgcttcgacgttttggttggcttgaagaaattgacggacttgtccctcgtccggcccttgtccgaccggcgtctcagcctcatcgccgtcaataaatttgtcggggtcaaaggcgtccacgtcgagtttcctgtaggcagtgtttgaaagaacatttttagtcattttgagaagcaaaatctaaaaattaaatggtcagattagtgcaaataaacaataaaaagaagcataaattcataggaaaatacttaagcaaattcaaattctaaaaaacataattttttgtttatactaaaaaaatttcttttgttcattttttgcgtacctattctctttagtgtttattttcccgattttattgcattttttattgaatttttcggaaaaaacgccaaaaaat

SEQ ID NO: 33492 - DNA, 1009 bp, Heterodera glycines
  misc_feature (937)..(937): n is a, c, g, or t
taaccaagtcagcctaaaattatcatcaacaatagtttatgattggatgtacttcttttgatgtgagccgtcttatttcaatcttcattattatttacatggatttgattttaggcaaataaatgcccatggtattttcgtgataatgtttaagcaactatttttgggcctattttggcaatttatacccattttcgggttagaaggaatccaaaaataaaaatgcactaatttcagcaaaattcatctatatttttttttactatgggatttttgtgaaaaatccgcttcgattgttttttgctttctgcaaattttgaaactttaagacctgtgcctgtttggcacggccgatcataatggcttttataaaactttcaatactttacatttctaaattgattgatgggatttgaaataacaaacttttcttggctatttggtattaaattatatttatttttcattataatttaaatatttagtcgcttaatatgctaagtattgtgtgatacacaatttaccgttttgcgtttcaccagtttgtgcttctccggataagcacaacattgttgtacgtatccgggttcacagcaaaagcttcctttttcaccgggcgacttcacacacttggcccaaccacatgggcatgaccatcccgcctctctgcacgccttttcttgcagctgttccgggagcaatgtcttaacgtagagtcagcagtgcaacgctgaatagtgaaaaatacactcttaatgatttaacattttgaaaaatatggtgtaagttgtatatttttaatatatagttccaaagttaacactgtttcacctctaacgcctaaaacccgcaatttttcttaaaaataggcttaaaatcacaaaatttttctttttgcttaattctgttaacaaacgcgctgaaaattttcaaaggngggggggcaaaaaaggtaaagaaagtgatcgatatactattggcatgaatttgttggaatggacgtaatgac

SEQ ID NO: 33493 - DNA, 741 bp, Heterodera glycines
ccgaattttaatgtattgggtgtttctcttagagtagttaccctgtcccccgtcgtatccttcaaggaaatttaaaaaaataccaaaactaacaataagatttttttaaacaaatttatttctttttaaattttcaaaaaattggagatttcaagattagctaattaatcgtcttaagagaaccaattgggtgtttcaaacaatgcgcatttccactcgccatgtgtctcaatgaatccgttgacattttccaacacatcgcaaaatcagcaaagacagcagcaacaacagtcggccaacatttcggacggcgcttccgtcaccaccggtttcgcgtctaaagtgacgcctgtccggcgctattacacgcgttccattgcagcggcagaacggacggctttcgcggtcaattccaacactttcagcgccgtctcatcatatccttcgactgtggaaaagtctccgcttttgaggtgaacaatatatttgttgtcgttttagtaagactttttcatttaggtcattggaacacagcgcaactttaaatcggatgaaattgaaaaagaaattggcaatggtcacgagtggcagcagtctcttcgcgcctcgtcaaattgacatgagcgacttgttgagttttggtggtgacagagacgacgcctcggatgaccctccgacgtcgttggacatggcggtggagttttgattgcattggctctgggccgagagtccggacgacgc

SEQ ID NO: 33494 - DNA, 805 bp, Heterodera glycines
acacaacataaggaggacttgaacctgagacccctttttgttgactaactcacagaccactaagacgaaaaaaccaacttaattgtacttggagcagggttcgaatctgttcttatttataagaaatgttctgatttggagggttcaaatcttacaaaataaaaatgttcttatttgtaagaaatgttctgatttcgggctattgttcttactttgttcttatttgtcgcttctcagaaaaatctgtcaaatttctttaaaaatttctgattggcgtactgtttaagaaaaatattttcaattttggcattataatttctttcttgctgttatttttggctaattattttagtttttattgctttattgtctttctcttttgtttttaatttagcacctgcactacatattactaacaaatggcaccgcctaagcgcaaaagcttttttaaaagtgaatattccaatgaatttcaggggatcacaaaaagcaaaacaggaggtgaatttgcgcattacgtcccatgcaattttgacatttctttgttgtccattgaaaaagcagccattcctcaccatctgaagacggaaaaacacaaaaaagcagcgaaagctgcaaattccgctttggcaatcacggcattcatgccaagcaaatcggcacccacggaggaaggttgaattacaaataaaaccagaaataaactttatttgtttacgcgcttgggcatatcacaccgcgcgccatgcgcaaagctttaatcggccgattgtgtctcaaatttgttgacaaaaattcttcctga

SEQ ID NO: 33495 - DNA, 736 bp, Heterodera glycines
catatcaaaaacaaaaagttgtattgactcaatttggttcattctaaatagattaagctttcgaatgataccaagattgttggatttggttaacaacaaaaaagttatagtccgaaaacttgggctggcgccaaaacgatacagacccccggtacggatggtcaaaagcaccgtcgagaaaatttttacaaatttggatgaaatttgcgatgaaaatatttattgaatgaggatatataattcgagaaaataaatttgcggatcccacgcgggattggaattggaactaaaattttttctgcattttccaaaaaatttggaattgcggaatgggacccctcataggacccttcccccggtctttgccgggaaaaaatctaaaattttttaatgaaatttgttaacagattatgtccaaaaaatcaactatcattggttaatttgtgaatttatggctgttttaaaaataaagaaaaataatttttaaagttttgccactaatttttcactcaaacccccattcttaccaggggtggggcgcgcacagaaaaatcccgcggtcgcggattcaatttgccgcggtcgcagatcgcgcaaaaaaaaaatcgcggtcgcgcatgttttccaattttttaaaccatttttaccgttttttaaaattttttcttatataaaaaattaattaaaatcccgatgcatacaaatttgggaagggactgaatgggtgtaggggggg

SEQ ID NO: 33496 - DNA, 999 bp, Heterodera glycines
ctagagtctttgaatcatgggttgcactttttcgaaattaacacaaaacgaagacaaagcttgtaaatttctataaaataaaatttatacttatttttcgcagaaactttttccgataatttttcccagagggatggaggatgtttggcggtttcgaccaaaattttttgtagttcgtaagaaaaaatttgagcttatgtacaaaatgaaatgacccataataaaaaaaatgtttggcttggtgtttttgtgtattcttttttaaatgaacgcggatcgctttgtcctccacaaaattaaattcaaaattaaacctcagacaaaaatatacatttagagcacttggtagtgccattcttagcgtgcgtacaaatcggcagttttgtcctcccacccagcagggctggagcgcgaccgtgatgcgcgatccgcgattcgcggcattttttccgcgatccgcgatgcgcggaatttgtgactgcgcggcaattttggataaatttttaaaaggaaaatatttattgaagcgattgttttatatgaaaattatttaaaaataagtttttgtttgtgaaaaagcaagagatttatggagaattgggtaattcttcccaaaaaattcatttagaaattccacatttttccctagtcggagctgactaaaatctttaattttctttagaaaaaatttgttcaaaataacaaaataggtcattttttagacaaacttttttagcaagttgcacccaaattttcaaaatttttcccgacggcgcctatcgacccccccgccaccccccccccccccccccccaaaaaaaaacttaaaggaatttttttggcggaaatctcatataaaaaatatttaaaaggcttacgggatttcagacaaaattggaaagtttttgaaaaaaaatatgaaatttttgcccaaaaaattggcctaaatttgctgttttaaaattataaagtactgatttttttaggacatattttttt

SEQ ID NO: 33497 - DNA, 873 bp, Heterodera glycines
taaattatttaatgcaatttatgtaaggtaatgaacctttaaggggcattttcgaataatttcaggaaaaacgaaaaatatttctttgaaaagtttaaaaactaacaaaacaaatttgtaaatttaaacaaagaataaaaataatttaacattttttggcttgctgtgaagcctcaacaacagctatttacaattcaaaaataaattggagttgaaattatgtaattccattttttgaagagctctgccgattactttactttcatattttttcaatttaaaaaaaaaatatactgaaatttttacaatgtctgtaaactaaaaaaagagtaatgataataatttgcaaaaacgtaacaaagtctcagatttggtaaatttttcttcaaagtggtcagaaatttggcccaaagtatgcccaaaggaaattaaattacggccaaatgatgacgcaaaatgggaggtgtaaatattttgtttaaataattaatgttttcttcgctttaattgaacaaaatgatgccctatataaatgatggagaaatgagactaaagttcataaaataaagataaaagagctttaacgaaaatgtgtaaaatacaaaaaatgacaatctaaagaaaaataaaaattggctaaaaaatcattatggatagcttctagcattagtccattttactggcaataagatgaatatgagatagagaagaagaagcttcctcgagaggaagattaatggatcaattgagcaataattgatcctatatgatcgagcaaagtgaggagctggagagagcaggcttttcacctagacaccaaccttcaccctctaaaggagagcccccccccctcccaaacataacccccccccc

SEQ ID NO: 33498 - DNA, 930 bp, Heterodera glycines
  misc_feature (828)..(828): n is a, c, g, or t
  misc_feature (835)..(835): n is a, c, g, or t
  misc_feature (856)..(856): n is a, c, g, or t
aaatattttgaattttttttatttacaataatttataaatatattttttcttttttttaaataaatattttagttatttttcggtcggatgaggaaaaaattgaaattgtgagaaattttctgaaaatgaaaaaagaactcagtgtgaatggggataagcgaccgtatggcgagaaatataaagaaatatgcgcgaaacttggcgcaagttcacgttcaatttataaatggaaaaggaaatttggctttagtaagttgaaaaattagggccttaattttagtaaataaaaagtcataaaaatgcgtataaaataggaaaatcttatgaattttaatttgaattcaaatcatgcagaggaaccaacaaaattaattcactgaccagtcatttttcattcctacacatcagggatgtgccgagccagacaaaatccgattccgattaaatcgccgattccgattatggccaaaaatccgatacggttttaaaaccgattacgattatggcccaaaatccgattaattgcgattccgattacgattccgatttttttaaaataattttttcccaaaaattttattcataatcaaaatcataaattttaagattgtgatgcaaaaataaaagtttgtccacattctgaggcaataaacgttttctcagatctgtcacaatcaacccagcggtggagaaaagccgttcgctttcagtcgatgtagctggggctgagaaatatttttttgatagcttagattcggaaacgaaatgtcttctgcatacagaagcccaacaaactggttttgttttgcaaaaacgatcaagcattntggaaanggtggatgaccaacgcacctngataggaaaattgcaacttagtaataattcatttcatggttcttttctgctttatgtcccaacaaattttttct

SEQ ID NO: 33499 - DNA, 1487 bp, Heterodera glycines
gcaagagctgcggaaattgtgaattaattctcagaaaaatggctatctctttttaggacaatattctatctcgtaaccccgatgctaatctgttccgcagagcctcttcaaaattttttccattaccgcaagagctgcgggtaattgtgaattaattctcaggaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctacggtaattgtgaattaattctcagaaaaatggctatctctttttaggacaatattctatctcgtaaccccgatactaatccgttccgcagagcctcttcaaaattttttccatttccgcaagacgttcggtaatcgtcctttcagtctctggtacccggatcgggggagtgctgtttcactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgta

SEQ ID NO: 33500 - DNA, 487 bp, Heterodera glycines
ttttttcaggaagagattttcgtgacaccctttatatctaacattcgaggcttcggtcatttcctttttcttttgcgcatataatttaggctatttgattttatcagcaaattccgaaattagcttgggaatgggcccttttgaggccaacctttttttatgaatgttgtcccattttacgttgtggtctgcggcctatggatgcttcagagccatttacgccttcttttcaataatcgtatgtaaaaacgactatctctttttttcgaacacttttttgaaaattttttccggaagaaattttgggacacgcagctataactaacattccaggcttctggcatttcctttttataatgccgatataatttaaggtatttgattttatcagcaaattcccaaattaacttgggaatgggcccctttgagggccacctttttttatgaatgacgtcccattttaatttgtggactgcggcctatggac

SEQ ID NO: 33501 - DNA, 1000 bp, Heterodera glycines
tcaattcgacccgaatttcatcacttgaaatgccattgataaacaaggcacaaagacacatgtcaatgctgtcgcggctccattctgcctttgctatcaaacttcgcaatagcaccgaatagtcccttatcgattgccctgtctgctgcttggctgaaaacaattcatgcctacaagcggcaatcgattttgcttcgccaaatctttccaccatcagttgttcaatttcggcaaggtccatggttcggacatcctcaggctgtgccattcgccgaagctcttcgtacacctgacccatttcagtgaacaggagcagacgctttgttgcgacatcggtcacgcctttaagctggatgaagaattcgaaacgttcccaccatgtcgcccagcacatctctggcaaaaacggtccggggccttttccagcctttattaccgctgccatagttggacttttcttaatttgtcccactcggatcaaattcaagatgctgatcaactgtaatccgacttggatttacagtgattcaattgttatccgtcccggattaacaatgaaaattggtgctgctcaactgctattcaacccgaattaacagtgagaataaattgttatccgtcccggattaacaatcaaaatcgatgaggcaatgttatccaatcggattaacaatgccactcagctttcagccttgcttttcagcaaattttcctcttgctctgttcggcctcgataagtgattgcaattgttatccttcccggattaacaattcaattcctccaaattcggcgattcgtcgctggctgttatccgtcccggattaacaccagtaattgagagtgccaccacctgggtgaactattccaactcggaattagcttactctccttcgacgatttttggaaaattgctattccgtcccggaattagcaatccaaatttggtgctttttcagcccgatcgccgctcagcttctcttcagttcgcctttgctctgc

SEQ ID NO: 33502 - DNA, 927 bp, Heterodera glycines
  misc_feature (853)..(853): n is a, c, g, or t
tggactcttcaaagggaagcaaaccagctcagtaacaaattgttttgcgcaaccagcaacactgttcgtcaaatggcacagtctccaactactgtcgccaatccatcgcgcagaccactgcaattacgcttccgagtattgccagctgcaagacaacagttcactcatctggacttcagcatgtccaaacgacaattgtttcatgtgcgatttccaagaagccgaagaaatccacggagaattcaccaagctcaacggtcaaacaacagcattttggatctcggatgatcgacaaaaggcactgaccttcaccgagacgcatgccgtgcaagcatgcgacgggagacaaatcgtcttatcagagcagaacttcggcattccaaaagagcaattcgacatcatcatgagcgaccacacaagagcgaaacgcataaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctntaatataaactgtttaagtggtgcagacggatcaggttgataagcgccaataacctcagatttactattttcgc

SEQ ID NO: 33503 - DNA, 932 bp, Heterodera glycines
ttttttgagtttattatttttataaaatactttttcagaaccgagttctgaattttattctgaaaaatcgaaaatttccagaatttctggaataacttttattgtttgcaagatagaaatcccaaataaatctcataaaattctcccgattttttgctatttttcaaactttattccactaaatttgatcaaaaacgaagagagttatgaattttcgaaatttcactggattttccagggctctaattttgacgatttttcaaaaatttgtaaccaccttccaaaaagtctgaaacgcaaaataaagcatatattcatgttcagcaccttaaattatgccataaaaatgcattttggcaaacatatgagcaaaaaatattttcatgaaatgcaaaaccatggggtcccccctatggttttgagtttcaaaatcacaattaattttataactttttttaaactcatgctataaacatgagataaagcacattagattgggcttaaaattctctacaaaaaagctcttagacgattttttgataaaatcaactcctgacgagttattgagccaaaactgaaattgaggcctagcaaccaaaattttctatttccaaaaaaattttaaaaattttttctgaaaatgacaccaatcgatagagcatgaaaaacggttgcttgaaagtggtctccgttttccccggaaaaatctgtaaaaaatcataaaattcaaaaacggaaaattttcgagggggcctagctcgaaaatttctgaaaatttctgaaatcaaaaaacatggttggatagagctcgtcgagctctacaaaaaagccgcttacaccgacctcctcccatcaaaagccggggagttattccaccggcgctgaaatggcccaaaaaagtatgccattttttagtcagttttttcggaaaa

SEQ ID NO: 33504 - DNA, 962 bp, Heterodera glycines
cgaaaataggattcctccctaattcacactataggctgtttataaaccgataaattaattttcttccccgacactctgtccccgattgtcggggaacaatccaagcttaaaattaaaagaaagatactaaattactttttttttttacaatagatggcttgacatagatcctcctccggcctcagcctattattacgcatttggcggcggtcctcgcatttgcattggcatgcgatttgcacttttggaggagaaaatggcacttgtgcgactgttgcggcgctattcactggccaaaaatgagcaaacggaggtggcgaaaagggcaaattgaaaatttaattataattaaaaatatttaataattttttgttatttttagaaatttctaaaggtcaattcgcaagttgtgcttaatcctggcgcagtgatggtacaattgaatttgagagaagagaatttttaagaaaatcaaattgactgaatttgaggaaaatttgtaacaaatttattaaaatatttcacccaaatatgttttatgtaaaagatatttataaaaataattagtgaattctttaaattttaatacttttccgacaataatcgcaagaaataatagtaaaaaatttgatataaagcaaccaactaaattttgctttattaatatcattcgatagctcaaattttctctgttaattttaagatttgaaaaagaaaagttatgaaattatatggatttttttatattgattttttaagcttgccttttaggcacaaaaaaataaataattaattatgcaaatgcagtgaagatttaataattctgccaagaatttgccaacaaaatttcttccacaacgcaacaaaaaaaaaagaaaattaaagaaattttaattaattaaaaaaaacacccgttcagcagggggaattgaaatcccaaaatgggagggaagtttcctaaa

SEQ ID NO: 33505 - DNA, 199 bp, Heterodera glycines
gccttatgagtaaaatgttacaatcacattccctttgatttttaacatttattttcataattttttttttgtcgaatttgtgcattagtcagaagtagggttcgagccccgcccccgcccccgtgactctgacccccgcaaccctcggccccgcgaccttcgcccccgcgggtggacggttttgaaaatcctcccctaa

SEQ ID NO: 33506 - DNA, 563 bp, Heterodera glycines
ttttccaaccaatttaattctcatttaattatttttcaaccaattgaaatgtcatttaattattttccaaccaatttaattctcatttaattatttttcaaccaattgaaatgtcatttaattattttccaaccaatttaattctcatttaattattttccaaccaattgaaattatttttcgctaattttctacagatttttttaggtttgaatttaaattgtcattgatgaatttaatgaaattgtgctaatattttatgctcattaaggcaatttttaaagccttagaaaattagcaaatttttacaccagttttaaaaaaattccacataaattattcagaaaacaatttaagattcggctcaaattgtcttttaccagtgaaaaattctccgaaaatttttcaaccgaagccatgatttgttgatatgtgtaaaaattgttaaccccgtattttttgaccggaaattattaatgattttctaacttttaaatttgttttgctatttatctcccaaatttccgaaattttctgaccgcacctggcattttggcgccacc

SEQ ID NO: 33507 - DNA, 936 bp, Heterodera glycines
atttaaaatattaataaaaataattaagcttatattttgcattttaaatttttttaacgaaattaatgcgaccattgcccgtccttgaacttaattttattccaaaaacgatagaattgtcctcgaaattcgagaccattttgaaaatgactacgataaaactatgactgtactggaatttaagtccaagttttaatgaacaaatatttatttgtttgtagattttcaaggactgtcaaaatttgtttttgatctaacggtcacaaaatctcacacattgtaaagtcgaatttaatagcaaaaattttaaaaaaagctaagagatagtttgaatttaatcaaattatttctataaaatcacaaaatattttaattaaaaaaagtctaaattccaaagaaaaagtttgcactaatatttaaatgaacaataactgtttgtgtgatagacattataaacaaaaaaggactgttgatgatatgtatagttggtgagcaagcacattagcattcaattttaatttgtttacattgggttggaaatgccgtctattggctcggcaaattgtttgaataataatgtggggcaccgtcaatgacgatggcaatgaataaatatgttgttggcatttggcatcgttgtgcctaccaaatttggaaaataaattattatcactttttttttgttcggtacggcacggcatcgacttctctgaatatatgtgccaataattcacttggttcaattcatataaatgcataaaaagagtgtaaattaaatttactaaaaggcaattaaattgcattgctaaaaacggtgacgtaaaaaaaagtacagaaatacgcaaatttttttattttccagaaattaatttaatttaaaagagatggttgcgcaatgcataaagtgccaaaaattcaaaaaaaaaatttttatca

SEQ ID NO: 33508 - DNA, 1131 bp, Heterodera glycines
  misc_feature (68)..(68): n is a, c, g, or t
  misc_feature (102)..(102): n is a, c, g, or t
  misc_feature (114)..(114): n is a, c, g, or t
tttctttttttatatgtctaattcagaaaaccaaagtttcgtcgaatggcaataattcatttctattntatattaccattccttagtgtttgaattttcctntaaacaatcatntaaatctgtctttctctaaaaaacataaacaaatctttactaatttttaaattactttgttcaatccttttaaatacttttctagctaaatatcaaaagttttaaaatttcccgacaagaaaattcaaattttcttgaaaatggctgaagcatcttcaaatgtcaccgaaatcagcggcactgtcattttcgctgcttatgccatggcatttttggaacttggcacactcattccgacaattcccatcctggcattctgctcttcaattgtttacaaaacttccattctgcaccggaaccttaagggcattctgttggcccaactttttggcatatttatgagtttgtggccacgtgtctttttgttggttgacaaaattttcgtgacaaaaaatttttttttgttggtgccaaattttattgctggagcatcaactgctgcattgacattcatcaacattgttggccatgtgctgattgtggagcgaatatgtgcaactgtttacgtggacacttacgagagataccgtagttgggcatttacggtggtttggctgtccattacggtaaaatattgtaccttttaaaaagcaataatgttttgttcattaatacataaaacagttttttttcaattaaacatcgcgtgaaaagtaaaattaaaaagtttttctttcattgagtaattatcggtgacattaattaatgaaataaatattcttaatttaatcagttgtccgctttaaagatcatcctttctttggggctaacaatttatcaaacgcttgttttggattcaatgttttcactaacaaatatttttgttggtatttacaacggagcaatgatcgccagtttaatagaaatttttgtaagctaaaaattaaaataatttgtttatattaatttttttagcttttttcaattatcacaaaatttaaccaaaaaatgtttgatttacgtcaaggcaattgtaaaaatcagcaattatctgttcggtatcaggtaaaacaaaat

SEQ ID NO: 33509 - DNA, 894 bp, Heterodera glycines
taacgacccagcaccaaaggcagtattaattaattgtttagttgccgatggtggccaatgcgaactcaaggactatcgggtcaaatttcgcataaaaagcgcaccaaatgcattaaattttgcaaatattgtattgtttcatttgacgggtcatttacgtaaaagtaaaaacattggtgctaatgacgctcttatacggacgatttatgtgcaaacaattcccgaaaaagtgtgggccgaggacaaaaacattcgatttgacgtggttttgaaggcgtacagctgcaaaatatgctggtgggcggagcagaagcagcagcgaatggtggcaattgcattaaatttgttaattttggacgagacggtaatcaaaaaaaagtcattgaaaaataaataattatatgaaatgattttataatttaattttggcctatgcatgtaagcagggatggtgttccaaggccccagtcttttgagaatcggaattccaaccccataaatcggaaatcggaatccgcgccatctctgcatgtaattgagtaccagacatgagacttaattttatagtttctctgaaaatctttaaatttttttttttgttttttttctaaatcatttatgatttttcaaattttgttacccctatccaacggtttgctctttaaaaagccaggccgttgtgccagatttagcctggtgcaaattgatattcgtcgattattattttctggcattcccatcttcagactaagaacctattacgtttaaagaatgtgtgccattctcaccgcatcagttcatatggaccaattaatcttgaccaattgactgatcacattgtggaaatggaaatcaatgaactcaatggctgtgttcctgtggatcttgattgaa

SEQ ID NO: 33510 - DNA, 876 bp, Heterodera glycines
attaattatttttcaaggagaattaatgtaatgggaaaataaaaataatattaaaagcaatgcttccaagtgtcccggttcttcagatttgtcctgattttagaaaggcaattttagaaatttcagatttccccaaaaatatttcacgcaaaattttttaatcagtttttagcaccaccaggtaaaaagtaccaaaaaaacggaatttttttttcgcattttgccaggacacagactttggcttgaccaccttcgttggtgggcctggcattctgggaggtggcgaatgcaatatgaaaaacgggaaattgaagtacatgttcaagttggctgacggtgtgacgattaaaaatgccattattgacacgccgggcatgggcattttctgcagaggcagttgcacgctggagaacatttagtaaaaatttttttttaattttcaatcatcctattaaaaggcatagctagctatacatcttctttcagtgggaggcggggcctttggcaaattttgttgatagatttgcacataaactgctgaattgtggctttttggaaaaattagtgaaattttctattgagaaatttggatgggggggggggataaggtaggggttaattccgtcccgccagttccgtcccaggcatgtttaaaacagcataacttttttcagttggccaaatgttataaatttggcttcattcgaaagctctacatgtttagaagctgttaataaactaatttctaagcgattgaacaatttataaaaaagttgcaccatgaaaactgcaaaaaagtgcgaatttttgcatgtttatatttataactttttacattccggcctttcttttgggaaatttgggtgaggggggggg

SEQ ID NO: 33511 - DNA, 810 bp, Heterodera glycines
  misc_feature (5)..(5): n is a, c, g, or t
  misc_feature (111)..(111): n is a, c, g, or t
gaagnattgacccttgaaaggttgaatcgtgtgtaaaagtaaagtaatgagttggaagtggtgttggattgggttgtggaggtaaatgatttggaaggggatgaagtaagngagataattgggggtaaaattgttaggataaaggtgggggggggtaataataaataaattaatatttttgggattttttatgtaaaattcatacattaaaaaggggggtgggtcggtaaattttttgcgaaggggggtcggacgccgatgaccttttttttgcttttcaaaaaccgtttgtttttcggcgcgttttttccaaaaaacttttcgggaacaggggggccggctggaagctatttttaaagagctttgaataattccaatttctaaaatttgatcgattttggaaaaaaattatgtgttgaaaaaagttgacaaaattcagtatttaaaatatttatttttaaaaataaatgctttccgacgaagttattgttccccgacactttttaaatttctcctgggtaattagctaattagtttctggtctttttataaatcccatatcctgcaaatgtaaattcgatattttttcaaattccgaattgaaaaaaaatttttttaggaaaatgcttccgcctcggcactgcgcgctgagcgcatgatggatttgattggtcagatggacaagcggttgaacgacgcgtacatcaagctgggcactgtgcgtgccgacgggcaacagatggtggagcagaatcggctggctgtggaaaacattggcgatttgaagcgacgcttcgagacacaggtggg

SEQ ID NO: 33512 - DNA, 949 bp, Heterodera glycines
ttcaataaaaaaataaggacagctcttaaattccgataatataaacacatgctatttcagacacacctaatctactcgtttgttatctaatgatctgctgttctgtccttattaattgaatcgatcaaattgtgtcaattatttaaaaaaaatctaatctactgaaaattcgaaatgattacattttgtttctgatttgatcaggttcagtgactgatcttattgatataattgcgcaaaaataccaggaaacgactcaagacaaaacactttttaataattttaaaaaatttaaaattgaaaattgtaataaaataaattttcacaaaaatgcccaccaaattttggtcatgcaccgtcgttgtggccgcagatgccaacgccgtccgtttagtggccattgtctaaaaattaaaaaaaaattaattttaaattaaataaacaaaaaaggggcaaaacaaaaaagccactatattcatagttctatatttcgcgatttgtttcatattttgtcattatgtccatttttaatgtttttctatagttttacatttttccaaaaaaaaacctctattagtacggcaccacactcagctaaattggcctttttgaccccctaaagaccgggaaatttccaaaaaaaaaaaaaatttttttcgtaatttatttgagaatgttgaataaaattttcttaaaaatatacaaatttacaaaaataagcaaaaaagcgaaatttcgctttttgggttgatttttcgctaaaaaatttttcgaataaaatgattttaaccatatctagcgccatttttgaaagttttactttacatttagagattttgaagaaatttctgaaaattttaccattttatttggaaatttatgtccatactttgcaattttatgtccatgtttctagatttgcgattttttgggccatattttatgacta

SEQ ID NO: 33513 - DNA, 75 bp, Heterodera glycines
actcgcgtggcatggatacgaaccctgctcgctgagttcagcagaatcacctcacacttcacatttttgtcatgg

SEQ ID NO: 33514 - DNA, 370 bp, Heterodera glycines
gattgttgaattgagattaattttcaaaaaattttctgttttcacttagcacgtgtgccacctttccctctggactggatacgtgttgtccttgtgcgcccaactcagtccctattgttgctgcttccagcagaggcaaaaatatatacactcactcactcacactgcctaagggcacccactcactcactcagtttatgtgttattattattccctgctattgttgcctgaggcaaaattagacccccccccacccctcacgaacttcaattgtacacgcgccagcacttcacgctctgctcctcccccatttccactacgccgtccccccccattcccctagcgcaggggagaaggggggggggggat

SEQ ID NO: 33515 - DNA, 1153 bp, Heterodera glycines
  misc_feature (238)..(238): n is a, c, g, or t
gaaaaactcaaaaaaaaaaaaatttttatcaaataaaaatccaaggaaaatttcttgaaattttagaaaaattttaattttttttttgcggcgacgttttgtcccggcgacggttttggggtgtaccccgtttgcgcccgccggttcaccgcccatcccgtatcgtcctccccagaaattttaaaacttattaatatttcaaaaaatcttacattagtattttttaataagaaaactntaagaaaaaaatcgaaatttcagcaatttattgtaaaaataattttgcccaccttttgttcctcattctttttcttctgctcctcctcactttttgggttttcttccttttcttgccccattttccgttcctttttctcttccttcttccccttctgctgctcttcttcctcttcctttttccgtttttcttccacttcctttcgtcgaaatgcattttcttcggttttcgttttaaacaccggcggcttttctatatcgaattcggttgtggcttttttgttattgctgtaattatttgtcgaattcgtcgttacatttccatcggccgcagaaaactgaattttttagaaaataataaattgtcaaaaatgttaaaagtcacacaatacatttgtcttgtactgttcataagtgttgttgttcaggttgagttccaaaaagcttggtatatttttgtttgtttcactgtcagcgcggcgatgtcgccgttcaattttagctaaatgaaagcaatgctccattggtagttagaaattctaaccctgcacaggttcgtggccagaaaaaaaattcggaaggggaaccccgaagggtgtgctcaaaaaattttaactagaaaatttaatgagaaaaattgcaagtaaaaaaccggttaaaacttttataattctttatggtaaaatttaaaaaaaaaatttaagaattcttaaaaatttgaaaaaatcattgaataaattttaatttttttcttgaaatttcttataaaagttttttgcggggtaaggggaagtaaattcaaataatatgtcataggcatcgccagagaaaaattttcaacgaatttttactaaaaaaccgttttccgtaattctttaaagagttggtaaaatttcttaaaaaacaacagaagcat

SEQ ID NO: 33516 - DNA, 1018 bp, Heterodera glycines
caaaggaagaagcaaatgcagaaaagcaaaggcaacccctactagggggaggaggagcacttgtatactctgtccggtacttactttttacatttccacgggggtccaatttatattgcaaaaaattcataaaatgaaaactttcaccgaagtattattttttttggttgatttggggcaaaaattgtccaaaaatacatcattaatattaattatttaaatggagtaaaattgtaatttttcgttttccaacagcagcagcagcactacagccaacaacaatagcatcagcaaaaaacccccgaacaaaaagaagcaaaatgtcgctgatcgaactgctcgcaaaaacaacatcggcggcgcgggcggtgaagaagcgccagcggttacaaaaacggccaaaaccttggctgaactgcttcaatactcaaacgtcgttgcagcaaatctggaaaataaacgtaagagcgccgccattgctcactattttttattattattgtaaggttcaaaaaggatgaatcaatcaacaaaaataaattcagtcacttcaccgacgacttccaagaatgatggtcctccgacggcggatggtttcacatttacagcagcagctcaggaagaatgtccgtcctcgtcatcgtccaaatcaattgccacgctcatcaccgaccggttcaggccaaacagaggcactttttaccgttatacaccagcgccagtggttacaccggcggtcgtgcacaaactcttactcaacggtaatggcacacaccgttcttatgttgttttcataacaatatgtcatcctcaaccccatcccaacccccatatatgtgcatatcctcaaggggagtagtttccccacccgaaaatttaaaaaaattgtcaaacagaatttttgaaaatctgaaaaaaaaattttttttaaaatttcaagaaaattttaaaaaaattcagagatttttttgggaaaacgagtatttttgaaaaaaaaaagttgctgaaagaatgcggg

SEQ ID NO: 33517 - DNA, 1027 bp, Heterodera glycines
agaaaataaatcatccaccttattcaaagtttttctccttaaattctttcgggttcgataaggcactttcttgaactcgcttaggttggcccttggaaatgccattttgaccatatttgcctctgcagctgcgatcgtctttcctttcatttggccgattttcttgatgtggcccatcgttgtcacttttccagtgacacaaacgcccgcctgcactggtcttcccgtcgccaatgagagaattgcgagtgcagcagcggcagatgccgatgagtccactatcgtttggtactcagcaaaattttggccgggacaaacaacgccgaatctttttgaaaaaaaatcaaaaaatttttcatgaaaatcttaaaaaatttttcgcgagttttagaataaaatttactaatgcatcataaaatttcaaaaaaagcccggtaccgattttttaacggtatgcagtgaaaaagagcaaaaaaaaaattcaaaatactcgtaaaaacattctttactattttaaaaagaagccgaaaatttggtcacctttagaataaaaccgtaaattttcagcatcttttatttgtaattaaaaaagaaaattttttcaaaacaaaaattttttcaaaataaaaaattttttttcaaggggtgcctaaagaataggcaacaataaacaattttttgtattggaatttttttcaaattataaatttggaatttaccttcaatacggggtcgacatttccatatatgagcaggggatgcattctttggctgaccactgcttcaacacggattctgattattttgccttgaaaatggaaaaaaaagaaatgaaaaacactttttttcggtcgacactgtaaattttgtccgggacgtaacgcgtacaaaaacaaaaattttttgtaccgtgactgatcgtacccctcccccttccccatctcctcccaacacagcccaccgatttgtttttcaaaaaaaacgaggagggagcaaacggcactttgttcgttttgccccccccccc

SEQ ID NO: 33518 - DNA, 874 bp, Heterodera glycines
  misc_feature (639)..(639): n is a, c, g, or t
  misc_feature (863)..(863): n is a, c, g, or t
gcttgttcgccggcaccagtcatgtctaagccctaaaaatcgcattagattcaatataatctttgattgaaaaactcaatcctcattatttgtaaaatgaagacttcccaatcttccagctttttattctcatttgttcttcattttaatggcctttccattcaccatcattcttccgcttcaggaaaaccttgtatgtttaaattgtctgcgttaattaaacaatcaatttaaagtcgtgggagttccttttttgaaataatttattttcagaaacccaattggtcccttttttcgacttttgtcggaattgtcccattattaacacttttttgttccctactaatgaaattcatcaaaattaacaccaaacttccccctgaactgaacaacgaattgctccattttgttcccgagtttttctatcgaagggttttgatgagctcaaattttttggtttattacttttttcgaaacggaaaaagagaaaaacaatggaaatacaaagtaagcccaaatcaaaactgaacaaaaaattacaaattgttaaatcaattttctatcaaatttaattgtttttgatttttattgtgtgatttttgaggctttggcagcgagagaggcaggcaccctgtacangtttcggagggccaagtcgcaccattcgtgcgtttattcccactgaggaagaccaccgccgcgccaactttttgtcgcaacaaatttttgcatcgcccaattttgcttgttcggtggatgagggctttttcgcacttttggtttcactgcgaaccactgggccggaacaggtgaaaaatcagtacttagttcgtttttagagacctgactggtcgcgcccagcncgggtcgattt

SEQ ID NO: 33519 - DNA, 1398 bp, Heterodera glycines
  misc_feature (135)..(135): n is a, c, g, or t
  misc_feature (237)..(237): n is a, c, g, or t
gaaaaatgtaaatctaaatcataaaactaattatgacaaaaacatattcaaaaataacctttgttgatgaattattttcgctacaaaacattaatgcgcaatagttaattatattaaatgaaaaaccaaattacnccattatcaaaacgcatttaaattcaaatttattatcatataatttttaatatattaaaattatttgaaatcgaaaaatatgaaatatgcccaccatcattnatttataattatattttggttgccaaatttgatcaaattgaaacggtcaagaaaaaagtacaacaaaaatcttttgttgaaatatttggagaaaagttgggacaaaaagaagaacacgaagaaaatctggaagaaaaaagagaaataattggcaaatattataaaataaaagagaaaattaaacaaaaaaggaagattatcgaaatctgtgaatttatttttttaacgtatttatcacgaaacaaattagtctttgtacaaaatccataccctaatttgttaatttgtttattcagtaaaattgagacggtaagattccatattgagaaaaaatatagctaatattgataaaattagagtcgctcgggacaggggatttttgggaaaaccgggaaggggactgactaaacatcaggtacacatgagtagttagagtctacaaatccgccggattacggtagcctcccatacctatgggaggggtgcaaggccaactgagcgccagccacctaaccaaaagcttatttcagattctttatcagcgccctaaaatacagctaaagacatatttttggaggattttgggtaaaaaaatgtacactcaaaaaacatatgcaacctcccccccaccccattggtcccgaatcacaaaaagagtttttaatgttaaaactttctttaaaaaagagataaaaatataaaataatatacctcttgttagagatcggaccggtcggtttttttcggtatttttcgattttcggtttcggtttttaaccgaaaaaaccgaccgagaaatttttgagtttttcggtctttttcggtttcggttttttttcggtttttaaccgaaaaaaccgaccgagaaatttttgagtttttcggtttttttcggtttcggttttttttcggtttttaaccgaaaaaaccgaccgagaaatttttgagtttttcggtttttttcggtttcggttttttttcggtttttaaccgaaaccgaccgaccgaccctcttgtccggtctctatctcttgtaatgcaaaaaattacagatttttctttattttttaagctagctttatccactaatattgtccaaccctgaaagcgagttattaatttctaaaaattagcgtaaatttccctggctcaaaaaatgaa

SEQ ID NO: 33520 - DNA, 939 bp, Heterodera glycines
agacgaaagtggaggaaaaagagaggaatcagcatccaacatgagatggcacggtccattagctgacgccattgttgatggtggttgagcacggtaatgaggggcaggaaaagagtgacgatgtaattgcctacggaagtgaagggacggagtgatcggaagaaaggaaggcaatgaaaagctttaccgaaaacggatgtggcaaaaacgatgagagcgaatagaaagcccctgagggcactgagcacattggggacgaagcggacgaggaaaagcttaagcagagagagcggaagacggacagacatagccgggggcgatgaaatggacgcattgatcggagggaggggtggggggacggacagtccgaccggcggaaggagtcgggcaaacgacgggcaaaccatagccagtggaatgcccccttgctattttctcgtaacgccaaacgatagcggtaaaattgcctctcggaaatattttcctctgaaccggttttcttgataccaagttctcgcttctttgtctgcacaccaaaaacaggttcaaaaacagagtcattttgagcaaccaccaccttaatatgtactataatcaaagaacatgtaaaaaagtttgtacatcattctccacttgccgcccctgcgcactctcaggttcaggcacgttgtcaaattcggtctcgaaatcgttaatgtgttcagactcatcattaaccgttgatgcattattttgacttgaatttaaatcagcacttatctaagaagcaaaggaagaattaaaaagttggattgcgagtaattaataaaaaacctacattgcgcccttgcaaaaatgccttcttcatgaaccaacgccacccagcagtgcccttttggatgaatccgtggggaacaaacaggggtcctagctgggggattcccccttttcacctccctc

SEQ ID NO: 33521 - DNA, 939 bp, Heterodera glycines
cttccgtttgagctttcagatgaattcgatttggagcgttgcaccattcattcgttccaaaaagtttatgggctccctttttgctcgattttatcgcttttaccgctcaaaagaattgctcccgtcccgccgcccattttgacgggagagagaaggtcactcactttttggcgattaatttggacgataaaaacaaatcccaattcttcaaatagagatggaatgttgttttaaattaatgtaaattaaaaaaaatgttaaaataaaaaacttttaaatgttttatcaatttaatttattaatgaaaaattaaattccaggattaagtagataatcaattgtttttctacaattttgatttttaaagaaaaataaagataattaaaatttagatgaactaataaaataatttaaatttagcaaatgcaaaaatcatttatcagtgatttatttttttacaaaattttaggtttttaaaagtcggtaaaaaaaaagtaaaccaatgaatttccaaataatacacgcaaaaataaaatgcttcaaaaatttataagtttctctgaaaatgtaaacaaataataatcttttctcaaatcttcgggtcaaaaattttgcctaaaaatgagacaataaaattttttagcgatggcataggatggagtcaaaggtcgcgatgatggtgaaaaaggagaagaaaattataggaaggcgagcggcgaatggacgacgaattggcagaagaaaagggggggggggagaaatgcgcatttaaatgcacaatttttttattggaaaccaaaaaaaacaattaatgccaaggccataattatatatttagagaagcttttattattattattattttttattagaaatccaaaaaacaattaatgccaggccataattataatatttttgacaacattttactgttatttt

SEQ ID NO: 33522 - DNA, 938 bp, Heterodera glycines
  misc_feature (864)..(864): n is a, c, g, or t
  misc_feature (884)..(884): n is a, c, g, or t
tataaaaatattttaatacaaagaaataaagaaacgccgtgatagtattaggcttttctctgcacagtggagttgacccatagtgtctcatgtctatttaaatgctgtctttccctcttccccggcagtcttcattcaatcatattcttttgttttcttcatcatctccacctttgacccctccgtatttattttgtttaaatttcactaaatgatgactaaaactcagaattaggtttaagaatgcctgctgaaacagctaattctaattcgaacgttaattcatctgcaacagcaaataataacgcaatttcaactcatatgcttcgcgagaaaaacagcgacgaggcaatggtaagtgaaattgtctaattggacaaatggtattctcccacccctcttctgatttaaaggaagttgaccagaaaatcgtgactgatactgccgacattttgcagtctgtgctcgaattcgcttttggcgtttcaatcgacgacaacaatggcattgcacaggaattctcctcatctcccgaattgcttttacaactgcaggattctgtgcgcacaattcttacgtctttgtgcctaaaaagtgtttcgccattgaaacaaataattttagtttctttttaagctgacgaagtcagtcaatcgcttctgttggatgaactgatatttacggcggtcaatctgataaagccgagcaatgggttcagctcctcaaattccatcccaaattccgacgactctttggccgtggtttttccccaacgcaatttgccgaattcattcatcgcctcttcagcctttgattatctcattggaacacggaaacgatgcaaatgtctgctcgaccaatcgntaaaataaattgtgatttangattacttgggctgtttagaaacacatcgccagcacagcacttttaattttgct

SEQ ID NO: 33523 - DNA, 1598 bp, Heterodera glycines
  misc_feature (127)..(127): n is a, c, g, or t
  misc_feature (250)..(250): n is a, c, g, or t
  misc_feature (318)..(319): n is a, c, g, or t
  misc_feature (1455)..(1455): n is a, c, g, or t
  misc_feature (1459)..(1459): n is a, c, g, or t
  misc_feature (1467)..(1467): n is a, c, g, or t
  misc_feature (1495)..(1495): n is a, c, g, or t
  misc_feature (1522)..(1522): n is a, c, g, or t
cagtcataatttgaaaaaagcgaaatttttcacaactatgggaatgatgtttaattttaaattttttaagttaaatgaacacgaagaatttctaaaataattgcaatgatccaaattttgttgcttntaaaggacacaaaaaaggttatgaaccggacacagggacccttcccctttttcattgatactcacatcccattgcccttttcccgattcttccgacgaattatggctgtaaaaaaataaaatnaatattaagtgggcaaaaaaatccatttttaaatttctatggcttaatgattgcaaattccgccctcnncagtgtgagaaaaagtccccaaccgatgttttgaagccgtttagttgagagaacagtgttttttccgcaatttacggtcgcatttggtgacggctgtccacggggtttgaccgctgcgtttgcgtccacattttgctgttgcgattcagacgacggcttcttctcgtccagactaaacattgcttcctgaattcatattttgcatagaaaatggtaaaaataaaaattgaaaattattgaccaatttgctcaggtcaagctcttcagccaattttctgaaaaaaggaaaaaatacatgttatatgtacggtttgatcacccactcgtcattcatgttgttaaacacggtgcccttcacttggttcgggttcagcgccgtccaattgatcattggcattttgctgccaattttcgcaattttcttcttcggcaccgcttcagcggttgagacgaataagccaagcggaggcggcggtggcggcattcctcccgctgctttagggccattttgcacaacttttttaggctgtacaaacaatggtggcggcggaggaggaggcggtgggggaggtgccaccgcttttttcggaggtgcttaattgtaagcaatttttttgaagttttagacctttaaatgttgttttgttaccctgctgctgtgacggatttgtacgtggtgcggaattgacagaagcggagtcaacggaatcctgtaaaggcaacaaatcatatttggtaatataagactatttaaaacaattctccaacaattcaaatactttcttttgtttgccaagtgtcccttttccgtgctttaatgcttttccgtaacaaatcgtgcattaattaatttacctaattattacaacattttccccattcaccgtaccatttccttgtcagtctgttgcgttgtccgctgtttgctgctgtcccgttgttccctcactttttccttcccaactttcgctgctgttaccgttggagttgtttgtgttgtcggagttgttttttgtgtgctgttggccgtttgtcgctgctgttcggctagtttggcttgtgccgctgcgttctgtgccactttcaaaccctcttaatatgagaattttcattttacataataactttttttattntcanattacgcnttatctcctgcttggccctctccagcantttcatccgtttttcgtactcaattcngtcccgcctcaactttcgctccttctcgcgccaatcccgcgtcagtgtggtgatctttttcacattttgcctctcc

SEQ ID NO: 33524 - DNA, 576 bp, Heterodera glycines
ttttaggggtacttgtgcagtttatgccccataaaaattttttttatataaattttaaaaccaacaaagctttgtgtggttaaattgttcaattcgtgatcagtagggctgggaattttatgtaaatacattttttttttcctggattctccatagcctaattagtaggaaaaacaccttctttttggtgtttgcgaacaaaagttgagacttttatttacatatttgagttttttctatattatatgtacatattttcatacatattttatttacatatttcgcgatttttttacataaaattcccagccctagtgatcagtgaccccgacaacgtataaaaattggttttaaaaatttatattaaaaaaattttttgtggggcgtaagctgcacaagtactggttttcggttctaaaaccccaaaaattgggaattgacccccgagaatcgagacagagacgcacgccaaaaaaaccccgacaaatttctcgacacgagaaccaagaccgagaatctcgagcagaatattaatattataatattaggttattcatttctttttttgttttcgaa

SEQ ID NO: 33525 - DNA, 297 bp, Heterodera glycines
accatttgaattatgccgtgttcgattcgtctccatttggcttatttgttcattttgcttccacttgccttctctcaattccttttcggcccttcgggcgccgtccgccaatcgctgcaccgcgcccaaaatgcgttggtctctgcccagccaactgagcagcacctcctccaaaaggtgctttgccagtcgcgtttgccccgtgtaaatcattgccaaacgattggccatttcatttcgaagatcatttccaacgggcaccgttcgccattggcactgtctttctcccccggggca

SEQ ID NO: 33526 - DNA, 778 bp, Heterodera glycines
  misc_feature (587)..(587): n is a, c, g, or t
  misc_feature (667)..(667): n is a, c, g, or t
gataccgatcgcgagactccggctgcgggagtgtgaggtgcttgaaattcgctgatgctccgggccaattcccggattctccaatgccaaaaggaaaggaattgggatcgggaggattgggggagaacgacgagggcgctgtcgggaaagggaggggtcaagacgggaatagacgggaatgggcgccttcgtttggccacacacgagaatttgccgaatgtgatggagtgtggagaaatttcattatctgaatattctaaagacagaaactggccaactgcaaacatagaaacttatgaaaggtatattttatttaagagtaaaatatttttattggttttaagcgaattctggaatcaacttgaaaatgcaaattcggaaacagttttcatatatgctcaagaacaagagccgaaacatattgataaaaactggaaggcgccgttaggggcggtactagaacatcaaattttggacccgccgcaaggatttggaattcctgtttcaggaataaccgatttctacgtatatcttaggcgttgtgcagcattttttcctgcccatacagcgaacgcagacctgttttncattaatattataatgccaaataatacagaaggattaacaatatggtaaattaagttttttttaatctttagatttcggntagatataaaaaagatacatattaaccatcttttgtctaaaatttatttataggtatagtatcccagctgctgattttcaaaaatttaaaagtctagcaagtacatatttt

SEQ ID NO: 33527 - DNA, 945 bp, Heterodera glycines
  misc_feature (877)..(877): n is a, c, g, or t
ttaacgttattcctttttggtaaacaaatttttgatggtttatgtcggagtaaggtgattttaaaatatgatccttttattttacagcacaagagccggaaaaacgatacattgaatggggctgtacgtccaatttaagccaaatttgtgccaagaaaattgacgaaatcgattttagctcaaataaacacttgtgcttttgcgagattctcaaaaatccaagcaattgatctaaaggagcattgaagttcctttgtctggttgtaggtgaatgttatcaaaaattataaataattaaataaaatataatacaaagatttatttttttacaaacttaacctatttttaggtgtgaatccaccaaatacatcaacaaaaaatatggaaactgagaaatttctattgtataaagaattttgtatttaatgatttttcaattgaatttaatttttttgattcattcaataagtaaactttgcaattaaataatgtttacaatttcaatcctgtccttttttaaaaggtacaggattggtttttattatcctttttgtaatcaacgaaaagcataacgcaaaaacaaattaattttttaatatatgttctaatttgttcatgtaaataaatgaatattaagaataaaatgttcgaatttcgatcgtttctgccggaagacagtaacggtagcaaagtcgattggacgcataaactggacttgagccgcaattttttgccgaatattttcaaaacaatttttagcagaaagaaagtgtggtccggcggtgcctataaacagcgcccggaaaattttaaataacttatggcccaatttgttactatatttattttatactattcagttgacttaatatatttntgtgaatattcaaacagaaacaagattagaccaaagttccaggacccatagaaaaaaaaatatcttta

SEQ ID NO: 33528 - DNA, 596 bp, Heterodera glycines
attttgcgactttaatgaatccattattgtaaaaatatttaattaaccaatttaaaagcttataataaaattaaaaaaattgttgcggaccaataaattttcgacaatattttgtccatattataacacattacccccatttttccatttatttctttctaacatttgtatgtatgtacgattttcttattttgcgatttatgtccgtattttgcagaattaaacgttaaagactaaaagaacttcatttgcacagctttgcttttccaacctgtccttttctccaaatgttgtttttatcgttgaaacattcataaaataacaaaacataacataaaatgacagcgcaaaatgcaataaattttctgtttcactcattggacaatttaatgccctttttgcttttagcattttttatttgtataagtacaaagtgtgtaaaacaaaataaaaatgttttatagaaaatattttcagatttattttttaattcgaaaaagttctttttatttggattaatcacatattttatctctcataatatcactggcaaaatcttttgggaaaaaacgtagggggggggggggggggggggg

SEQ ID NO: 33529 - DNA, 395 bp, Heterodera glycines
atgattcatcccataacattgtgccatttttccagcaattcttcttccaacgatctgatgcgtggcgtgtgcggactgcaaaatttaggcaacacatgctttatgaactcgtaaattaaaaattttatttttataatttttttgctcatttttcagtgccatccaatgcctcagcaatgtgcctgagctgaccacctatttcttggaggacaactatgtggacgaggtgaacacgtccaacccgttgggcaccggcggtcgtctggtgaagcagtacgcggacttgctcaaggacatgtggtcgggtcgtttttcgtccgtccggccctatgaattaaaggtttttttcaattgtcacccccccccccccactttatgcggtgggggtcgattgg

SEQ ID NO: 33530 - DNA, 738 bp, Heterodera glycines
ttttaagttatggccccccgaaaaccaaaggaggggccgttttgttttcaaaaaattttagtccgtaatttaattccaaattaaatattttggctttgtttttaaaataaaaataatatttaaaagtcataaaaatataatgttttgttcaataaggaacgtgaatcagtatgaagagggtttcgcccattccttgttcggaattgattgagctcggcctttgattcgtgatcgctgattaaccattccaaaatcccgggagtcgtgtgtttatgcccttaaaactaataataattttatgatatcatttatttcacccaacaattcagtactctagggaatttgtgccttacaactctaaccaacaattaatttggatgaattggcattatttcaaggagagagagaattttgggaaattttgacaattcgattaaaaaaaactactaaaattcttgacaaatttctgaccctaatccctatattcaaaccctctcccccggcttttccatccaaaacttttttggatttttctttgaaatcctctttttttacaaatctttctaactggcatatgcgtatgcatttgcattattgctcgacaaatgcgattttcccgcggacgggaaaaacccaacaatctcctgacgtgaaaattgtttgcctgacaaaaattggtgtaatgacgtatcgaattttacaaatgtgctcctctcattcctcccccaatttgctgcg

SEQ ID NO: 33531 - DNA, 932 bp, Heterodera glycines
agggggaattgaccgccagcaaaaggaattggcctttcgacgattcacacctatttaggtctcttcggacattctgaaagccagcgggtacactcaccagttcaaaaagctgctctcttccggcgctcggattcgccgcgagtcgtccacttgcgcacggctcccaatcggcagtgaagggatgtgcaagcagcaaagccttggtaagtgcggttaagcctcgcctccaccatttctctctctttcgctcaattaacttcgttaattgccttcgctttttccattttgtccttttgccgcccaaattcaaacacacggcacattcattctgcacctttctttacctttgttagttgtgccaatggcttcttccaccaaaatattcaaaggcactttctccgcctttggcgccgttgtggtgaaattggagaacagctgaaaataggcggcgttggaataaatggcgcggatttgcgttgccggggcattatttatttgagcaaagggagggagagacacgagctaatccaacgaaaatcgaagacgaagaaaatcgaaccgaggggaaaaagcctcattaagcagcggagagatattcgatgtaatcagtgaaagtgagaagaggcccattccgccgatgattatgctggccgagccttcgaccccatgccgccatcggagtgcttatccctgccgattctcccaatccgccgccgtggtcgccaaattgtcccccgatgcgttccccggtgcgtttgaggccgctactttacacgtgccgcttcgtcctctctctcccgctattcggcgctcctccgctcggcttctccgtccttacgactctttgctcctccgttctcatccgttgctgctctgcgcgtctctccgcaaatgtcctcacaattggcactgattcgtctctgctgcgcact

SEQ ID NO: 33532 - DNA, 887 bp, Heterodera glycines
ttgctgctggccaaacgtatttgatggtgcagaacattccggccgccgccggctgtttaaagtaattttttttcaatttttggccaaatgtaagagaccgaaccccacaaagacctaagattttactggtttttttggggggggggtaccacattagaaaaaaaactgggggttgttctattttgggaggtgtagaattcacctgtttttttcgaagaatttgataggaaattcaaaccaaaatgcattaagtccgtaaccagaaatgggagaaggaggccctaaaacttggagtcaaaatctcttaaaaaaatcggactgagcgccaaatttttggtaaatttttaactagtttttttccttcctccaaggcattgtctgacggcgaatcccttctgttccgaggccatccatttggcggtggactcgcgtctgatcactgcccgcgagttgcgtgccatcatcggcagccagtacaaccaacaaaagtcgggccaaaacagttccggtgcgcgggtcattgcgcatctgctcgaaatctacgacctcaatgttggtcgatttcgacccgattgttgttgtcaatgttcattgaattttaccattttatggatatttcaccattattttccagtataaatagagcctggacgggatcaggatcccgacaaaatcaggatttcattccgggaccgggcttcaaaactcgacaaactgaaactcaatcccggtaatcctatcccgatctgatgccaatcccgataccgatttttaaaaaattcccggtctaataataacaacaaaaatgtctcgcacaattttcaagcagttcgactatgtccatgtttcagaacgagttgtcgtcgtccgctccggtgccctcctcg

SEQ ID NO: 33533 - DNA, 923 bp, Heterodera glycines
tcattgtgtcacttatgcggtcactccactcggcgtcgtttcgggactgatcaaatgggtcgatggagcaattccactctttcaaatctaccgaaggtggcgcattcgacatgtaattttgggaatttacaatatgtttaaatgtttaaaataaataagctttttcagcttcaatttaatgcagaaaatgatgaaagtaaacagcagaaattgggttcaattggcaaaacaataccgacaaagcaacaaagacaaagtgcacaccttaaaaaaggtgttggtaaagaaagtggggaaacggcggacaatgcttccatcggtgggaaaaagaaagagggggacaaggagcccgagccagagcgaccgatggaacagttttacaacaaattgaaggcagtttttgcggcgaatgtttgttttttttctcaaagtttatgccgtaaatacaaaatttgttgttttttccagagagtgccgaaagaatgtttgaatgacagaaaacggtggcccaacgaagtgctcaaaatcgtactcaaagagctcggagatgaaacaccaaaagacattttggccaagtctgatgatttaaaataaaaaaagtattagtagtgaatgaaattaccaaggataattaagagaactatggatttatgcggccacttctgatgattggtggatgaacacacaaaattttgccaggacggccgccgttagttctatgctcggtgcgttaattgggctcggagatcgccatttggatgtaagttttagtggataaggggggagggaagtgtttgttttaagaatgttctggtggacctccattctggtcaaattgtgcacgtcgactacaacatttgcttcgggaagggccgaactcttcgcgttcccgaaacggtgccgtttcgtttgacggagaacat

SEQ ID NO: 33534 - DNA, 844 bp, Heterodera glycines
atatacacgtaaaaatggagttggggtaaaaacgactttggttttaccaagcaattaatgaggggggggcaaaccttcttaaattcaaaattaattgaagacacatcgcgcaacaccaatttgttctcggagcagatgaacccattggggtggttgaactgctcactttttttggtgaattccaaagtgatgttccttaaattataccattgaccaaaaattaaatgaagaattcaaatattaccattttttgcccttttctatggcaatgccctcaatgagaggcgcaaattggatggaaattcgctgaatggaagcatggcaactgctggcatttttgtcaaccgaagccgagctgtttgaaagcgaaaaagtggtcgtgttggatgaaacagtctaaaaaagaagcaaatacaaaatttgacaaaaaaaacaacaaaaaaccttttcatggtaacgaattgcgccagtgatttgtggagagtcgagaaagaagccatatttgcctttgacagcaaatttcatggcattgacaccaagcgaacaaaggccgatgaaaaaagccaaacgaagcaaagaacaattgagaggagagaaaacactgcaattcattgtgcgaagtaaatgtaattttccaaccttttaaacaaaaaaacaattaaaacaatttaaaataaaaataattaaataacataataaagcaatcgtatttaattgatttacaaccatcccctacggcaaacccttccccaaggctcgcgtccctcccacagagtatcaccacgaaaattcaaatttgaatttagcgccaaaaggggcgacaatcgtacaggggtcactactg

SEQ ID NO: 33535 - DNA, 1034 bp, Heterodera glycines
  misc_feature (14)..(14): n is a, c, g, or t
taaccaaaatatanaggaaaaattttttaaaaaaatttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaagattcggtctccccataaatctgggcgcatcgggtcgggggggactgccccgaaaacaaaaaaaacaatttttttaagtgtccgttttggggaactcaaacaatttatgggggagcaaaaatcc

SEQ ID NO: 33536 - DNA, 896 bp, Heterodera glycines
cgtcttccattgtattcgcatgcattcggaccaaacgcttaattcttaccttaaattcaaatgcatttaaatttaagaaatttacaaaattatatttaaaaaaagttcatgttgaacaatccgtactattatacatattgtattaactttgcgtccgtcccttgtcgcataaatagtgtcgcctttgaccagacgtccttgataaatccgaaaatacgtcaattgtccaaaatttcctgccttagatcactgaatgcatttaacaaaacgaatacaaaatcctacttccaatttaaacgcaagtcctataaatggcttttgtttttcggagtttgcggtcctcaaagggtccatcagcacgcgttctgcattgtcatttttgcttaaggaaagaattattaaaaaaagaataaatattgcacttactcatataaattcacaaaattgtcaacttcagaagggtttggcaaataatgtacaatagcatctaagggggagggggtccgttggagtgattaatgtccaagtaaaaaggcaccgatcatttgttggacccccttgttcttcagagcactgcccacgagcacggggacaaaggaccgtttgatggttgccctccgaattgcctcttttatctctttgacggacggcgtcacttcgttaaggtaacactcggcaataacatcgtcacaatttgcgaggttttctgtaaagggcaagttcagttaatacatgaccaaagctttaccgagaagttcttggcggagtatctttgcctcttcgcggtattcttgcggaatttcttcttttctcagaacggaaccatcttcgacctcattgaaaaaggccaactcctctaccaaatcatgataccctcaaacacgattcgatcccta

SEQ ID NO: 33537 - DNA, 741 bp, Heterodera glycines
ttttgtattcttccccaacaacgcatttcggttcttaattaaaaataaaataaaaattattttttaattattatttttcattttttcggttaccaaattccaatttgtgccgaatttcgtccgtttcgcatttaacccaaaaattgtccaccgtttcattgtttcccgcctcgattttgtgaacttttcctgatttggaattgactaaacagccttcgaaaatggaatttgacgcactgaaaaaataaaaaataattttgaataagtaaaataaacggcggcacccaatggcacatcgatacgcccaaatgccattgtccgtccaattttctcccaatcgacggcacccgccgtgccaatcgcgacaaggacaaacggctaaaaccaagccaataattatgacaaacggatcaaatcacaaatgatcgaaagttaattaggcattttattacatggcaaaatttcttttccgaacgaaagagaaaaagtgaagaaaaacagaagaagaacaatttgcatcagtggcagagttttgaagctgtgaccattgggagaaagttgaaaaaggggaaagaatgaaacgacggattcgtcaaagccgccccattcattcattagtcattgtaattacccccccccccccccccccaccaacgacacactcgtttatttatccattcgcccaagcactcataattaatgaataataattatgatcggggatcaattagcagatcaaat

SEQ ID NO: 33538 - DNA, 874 bp, Heterodera glycines
agccgtccatttaattgtgtccccaattttgcatttttgttttattatttgtatttttagtgttttaaataaattcaatttatttataaattaaaattattttattatttttttgtcggaatttcgggtcaaaagaaagcagtgaaaagatgaaaatgagtgaaatgtaatgaaaaagcgaggacaaatgcacaacagcggaagagaaagagcagcgaaaaaagggaaaacggaggaaaaaaacgacggggcgacgaactgagcaacgggggagaccagggatagtcattacagaggttgccgagacagcgacacaattcaatctgaagagagagagagacggagcagttcaaaggggaaagggggacagaccgtccgattggacgacttcacagccaaatgacgcggcagcaaagtgcgcattgggaaggtggaacagctcgtatctgtggggcaattcaatggaaaagcgattggcaatttattctattggaataaagccatgttggtcagtgagtgatcagcccttggaattttaaaagtcaaattgtataagaacttatttaaatgcgaaatgtaaaaaacaaacccaagcatttgtttgggcttggatttcaacattcactcgcttttcacgattcctcgagggcatccgagccaattaggcaaacaaagcccccccccccccctctcgcaatttcatgcttcaatagttacggacaatgtcggggacacatctgtcaacactttctaaccaatttattggtgccgacgggggaaggcccagaattgtaaaagtcactttggtcagattggaagccaaagccaaggaaaaaagacaaggagagagtgagacgaactcgagaatcatctg

SEQ ID NO: 33539 - DNA, 278 bp, Heterodera glycines
tataataacgctgcggacatctacatttttgaattgcccataattggtaattactctttctttttctccatattgaccatcatactcatactccccccaccctttctcctccttcatttttttcttcctttccttctccaaccctctcctccctctcttgataggttaaactgaaggcgggaaacgacaatctgatccccatcaagatagcttctgcaggtcctgctcgagcggccgcccggggatcgatccccgatctagtaacatagatgacaccg

SEQ ID NO: 33540 - DNA, 1009 bp, Heterodera glycines
  misc_feature (19)..(19): n is a, c, g, or t
ggggtactcaaacaattantggggagcaaaaatccaacgtagaattaaagtacaggctatagggaagctattcccgaaggatttggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaattttggtaagccaaaaaaatatccaaacatttaaaaatctataaaaaatttaaaaatgagaattcatgcgagattttctggaaataagcttaatagggcctaattaagctgtaaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatatggcatagttaagctgtaaaaaaaatttggggcgatttgaatgagaatagaaagagccaggttcgatgaagttttggtaggccaaaaaaaatcaaacatttaaaatctataaaaatttaaaatg

SEQ ID NO: 33541 - DNA, 702 bp, Heterodera glycines
gtcatgacaccttaggtttaacaaacctaaatatttagttaaaaaaattatcaggtcaaagagcatttcctcttagttattgggacggctaaacatggacatacatataaaatgagcaaggactcatataatgcatgtgacgcggaaactgtatgtgataggacgcgcttaaaaccgacaagaaccgcctttatttcttcaatattcaatgccgaccgtgacgtgagactgaattttgaggatttgaagccctacaaccaggaaaaactcagcttataaatagaaaatgatcattaatattgccaaaaacaaattaacccaattattgaaatgccattatggggatttatagcaattaccaaatgaatagatgatactttgttgtttcgtctattttatttttattttaaaaaattttttttgttaaaaattttgatatttaatcaatagggctgccaaaaatatgtacaaaaagtggtccaaatatgtacataaatatgtaagaaaaatcccaaaatatgtaaatatgtataaaaaccccgaaatatgtaaaagaaaaaaatatgtatttacataaaattggcagccctattaatcaactgagacgcagttgaccccagacttggctagacgcagttggcgagacgcagttgaccagacgcagttggccagacgcagttggccagacgcagttggtccgtt

SEQ ID NO: 33542 - DNA, 793 bp, Heterodera glycines
ctctctctctctctctcttgcttttcttctctcattttctcccacatctttcccacaccctctttctctctcccctctccttttaccactctatttctgccactcgcacatttgctcatgtgagtggaattagtcgtccgtcctccgtccgcccccttccacggcccctccctcccctttccgcccccaccaaaattctctcctcctccattttctgctgatcgcttcaattcaaaagcatggcttttccatagtcctctgttgcgatcagtgctttttcgagaattttttaagtgctatttttgattttcacgagtcacatttaattttaaattaaaaattttttttaaactcttgaaattgtcattttcattcggcgaattacttaaaatttcaaaaataatacctcttttttttgtatatgaattattattttttattaataaagaaattttcacatttgacactttttataaaattgttaaaaacattgaattaaaaaaaattagcatttaaatttaaatgtagaattttttcaatttattacatataaatattttataattttatgtaaatttattcatttttatagacacttaaacttttattacatcattaaaattatacttttttatataattaaaaataatattttaaaaaaatttggcaacatttttttcggtgttttatatttttattcattttatgatcatatgacatattgtcaggggctaaattaaattcgccttctcattcgtcatttcctggcatatggccaatttttattgcttct

SEQ ID NO: 33543 - DNA, 1676 bp, Heterodera glycines
  misc_feature (60)..(60): n is a, c, g, or t
taagcggcgatgtttttttgtaatggaaaaaatggggaaattatttaatgactcagattntaatgtaaaaaatgggtgattaaaaattaattttggaaaaatgctaagttttcagaagttgttgtaaaattgattattaatttatttaaccattttaataatctgtttgatagaatgatagagaaaataaattgcaaaaattggcaattaaaattagtgttgtataaaggttatgtttttataatttttaaaaaaaataataacattgttaaaatatattgaatcgcataaattatgatttgttttatgacacatattttaattgaaaaatgatttaattaattttgaataaaagtcatgtttttataagttaaaaaataattgttaatttttatttaaattattaataatttttcaattgtaaaaattattatttcttatttgctatttcgattcctcattaaaaattaaaaaaaagctttagaattcctcatttattaattagttaactcaattagcattcggaattcgcattaaaaataattggatgtagaagaattttagaacagttgaaattaaatattttttatttatttttttaattttgcgcgtaaaaaaggggggattgtaattagatatttcatccacccgccgatccaccaacattccatacaattttcaaaatggatttaattagccaaaacgaggtcataatataaatgaaattattataaaataaaaataaaaacgattttttaaaaattaatcataaaataaaacctatctttttaaaaaattgaaaatttatgccaaaaataatcccaaacatggaaaatttctatatctaataatttatattattttgtattttttttttcttcaaaatgattttcatactaaacatagctgatttcaagtttttttagcttaaatttagtgattagaagaaatttttgaaaatttgccccaatttgtaaaaatttatgtgcatattttccactttttatctgcatattttgcaatttttggtgaatgtttttcgactccataattatattttttatattttaatgccaataactcaagtacatttaaaatcgttaaatttgccaattatcccaaaaaacaaatcaatcacaaaatttctcgccatttaagtcaatatttggacaaaattcaccccctccctcctcgaaaaatgatctcggaagcgaacaaataccattttctgcccatcacagaacagagattaatccgcgcagagggcagaaaaagaatggcacagaaaaatcccaacaacaaccaactgaacccgtagtggaaaatattggacaaatgttttaggcaaacaatgaaaatgtgggtggactgctcgttcacccgtcccattaggggggcaggggaaagcaaaacacccatcaattcattcaacaaattctctcccatcaatgggtgggaggggacaaattcaaatattgggactttgcatatatgtatcatttactaattaatttgggtgtgcaggaaaatcagtgcagatcgagagtctcgaaacaaaaataaattttgtgaggaaaatattgaattgaattgtcgtgtcattaaaaaaagaaaattttggagaaaaacaattcgacaaaattggataaatttgcaaaaaaaatcagggttcatat

SEQ ID NO: 33544 - DNA, 885 bp, Heterodera glycines
  misc_feature (17)..(17): n is a, c, g, or t
gtggtctcgagtctccngggaataaaatgcaaaaaatccataccaattgatggcgaagcaaattccggatcaacattggccaatagctgacagacctacaatttgatagagatagattaataatagagaaccacgggaccaggacctggtagcggacaactgagtagaactgagtaccaaggtcccggttttgaccgggactagtcccggttttcccaaccaaaaattcccggtttttcaacccaaaaaggtcccggtcccgggtttgcccaaaattcccggtcccgtggcactctaattaatatagcaaccatcgataattaaaactgtctatggttcagtgcttcctttttcgatttgcaatattatatcacaagttcaaatcctacttagcgcacaaaaacattttttaaataaaatatcgtaggtgatccagtgtaaatagcctaatggaagcgaataatttcttggattaaaaaagtcctcattcatacgtacggtattccgcgtgctctcctccaccacagcaactgcagtactctgctcagaaatgcactcgttcagctgctcgttggcctcgcgcaatgcgccaatttcggcctccaaatgtccgttggcgttacactgtgccaagtgcgcgagttcttcttcttccaatttcaaggcttaaaatggaggaacaaatatgaaaagtcgaaaaattcttcaatcatttaaaccggttcaatttttttacaaaacgtcaaaacaatagttatgaataaggaatgatcaaagtatagtaggatcactcgcctgtttgggacagttcagcacggataacagtcagctcttgttcaagctgttcaattttagcctctaagcatcccacacgagtcccactct

SEQ ID NO: 33545 - DNA, 1038 bp, Heterodera glycines
  misc_feature (14)..(14): n is a, c, g, or t
ttcttactgtactncgttggcggaaccaccatataagccgggcgaaaatgagtggttctccaacgatgtaagttaagcatgaaagggggcggggaggggctgggccaaaatattgcgaaggatttatgggcaggactgggcaaaaaaaaagcacaaaattgacatttttggtgtaaatcaggcatgggtggccacagcctcaaaaaatttcggaaatcggaattccgacggctgaaaaaatttcggcaacagaaagaaagcccaaaaaagccggaaatcggctattttttccaccaaaattgcaagtttttgagtaggattattctggggatagaagggggccggcagtgacaaaaggcgaaaattttttgtaaaaaaatcccttaagcctctcacactgtactatcaaaaatgggcggggcaggcaccgggcaagccatgcaatgacaccaccaccaccaacaacaacaaccggtaaatgggttaaaatgacaaaaagtttcaaaaataggggcaaaaaatatatgccaaaaaatttttctccgcatttttcgtgctctaaagagtaaataaacagaattaatttttgttaaaagattttttgaaaaattaattgatgatcatttagggcatttattctttttatgtttttctaataatttttacaaaaaatcaacacaggtttttacatattcttacaataaagtttaaaaaaagccgaaaaattataagaaatcgatcattctcatcacaataaaagtgatttgagcggtgacagctcagaattttctccgggattgcgggatttatacctgcgggattccgtaccgcagaaattttgaattccaatcccgcagcgggattcgcaaatttgaaatttcccggttttcttttgatgtatttaatggtacagtggggggccggtgccgacccaaaacgggcccacgcaacagaaaaagctgaagccgaaaaacggaggaggaaaaaaaaagagggacagtgaaaaagagggggccggcggttgatgaaaaatgaacc

SEQ ID NO: 33546 - DNA, 785 bp, Heterodera glycines
tgtcaatttaccaccacgcgctgcacgaccgatggcataaggcgaagaatttgctgctgatgtcgcatttgcaagcactggtggaccattcggatgccagcactcaagtcaatttccaagaaaagacaccgacccaaaaacaatcgaattaagattttgtacaatcgcacaatttgccaactcggactttgtgcttttcgtcatggatttgttcgtgaagcgcatcagaatttgtctgagatccagaacacccaacgggccaaagacttgcttgctcaaggcattccgccgcgacaatcggaaaaaacggcagaacaggtggcccattttttttggaatataatgccgtggaagtggtgccctctccaattctgttttgtccgtttaggagttgaaggagcgctctctgcaagtgccctaccacatgcacatcaatttggagttgatggagtgcgtttacctcatctgctcaatgatgctcgagatcccaaacatcgcttgctacgagtacgacgtgcgtcgacggcttctctcccgttccttccattaccaactgaaattctccgagaaagcggcgctcatcggtcctccggagaacacccgcgaacacgtggttgccgcctcgagggcaatgctcaggggcgaatggatcaaatgtcgcaattacataattaacgacaaaatgaacgcaaaggtccgtggagaaattatgaaaaattaaaggaggaatgaaattgaatgtccggtcattaaaaaggtgtggaatttgtttcgcaattctgacg

SEQ ID NO: 33547 - DNA, 741 bp, Heterodera glycines
ttttcgcgccagcggattttttcaagtataacttttttcattgtaagccaaatccaagtttcttggtatcattcgatagccctatatgttctctattaacctgcaaaattgcgaaaaatttggtttaggttcagaaaagttatggccagaaaacttcaaaaagctgtttttctaaacatttctggcaataaatttagttggatttgggttacagtgaaaaaagttacagtccaaaaactccgctggcgcgaaaacccccgagtcatttttcttaccgtttttctcagaatgccaaaatttgtgctaaaaattcctaaattgactgtgatatgcttttatgatattatgcggacttttctattatgattttgcgtaaattaccaattttgtttaaagttacattttttataacatacctaaaaatgctatttttaaaattgttttcggcataaaaaaccacatgatatgctgagatacactttttatgcatatgtaaatacggcctacaaacttcaaaccaagcgaaacacatgttttttgtgtcgctcaggcctcacacagaccatgaaaaagaaatatgcctgtgcatataattacacgccctacccttaatccatgaagaaatgaattatatctgctttttgacatttgcaaggaaagtcaatcaatcaccgttctggtatcgttttcttctctcccccgcctacttcgctacattcacacattccatggaggaacagg

SEQ ID NO: 33548 - DNA, 822 bp, Heterodera glycines
aacaaatactaactgttcttttagaatttgcccaactttcttactcaatcgacctcacaaatggcgttctctgaagacccgttgatcaaaattgaagaggacaatcctcgagctgacgcgtcaactcacaatttgcctactaatgagaagctgttgccacaaaataatcattttgcaagcaatgttttgaaagcgcaaacggattggcactcacaaacggaacaacaacagtatcaaatcatcaattttgttgacaacaatgcaccaccacatagtgaattaacgtcgagctttaatgattttgctgatttgctgtcaaacacgaagacaaatgacgtggtgccggattttggaatgactcaaatgcgcaaaatcgagccaaaacattttaatgaaccaaaaatactgaacaatgttactcatttaaatcaaacagcggccagtcaagtctccaacaattcgaaacagttccatgaacttggttggttacaaaaaaaagttttctaattgtgttttatatagggatgtatgttgcaaagctactttctaagacacctcaaaacggaatcgcagaagctattcgcttgaaaggccagattttctcaatgtgcaccagcaagcaaattgatttgatgagtgaaagtatgtgagacccatccaattgtttcattggcttacacacacaaaaaattttcaatttggatttattcgaatcatgatcattcctttcttactttgaatctgcattacattcttctatctgatttggtgattcaccattaattaatattttactgtgctttttactttaccctaacgcgc

SEQ ID NO: 33549 - DNA, 710 bp, Heterodera glycines
ggggttcgaaataggccaaaataaatgctattttcgtgatcagcgaccccaaaaacccttagaagcatgttttcacggctttttaaagctgaaaatttctctgctaaaaaaggggggcaccatcggcagtattacccaaataatggacggattcgaaaaaaattgtggcgacaatttaatacctctgttgatctatttattggtaaagtccaaatcacttaaaatggtagcaggacaaaacatgattgggatattaagaaccaaaactacatataatattaaaatcatcggttgagaaacagtaacagtgccaatgcatttctcgacacacaaaaatgattggctaattactaccggctggcttctacccttgcttgataaagttgacacccttcgcaatttccttcttcagttcgggcaccgctttgctgatcagctccttttcgtaagcggtcaggtcacccaatggcagtattttttccttaaaataaacgattttggattacgtggttaaagcattccacataacggatattaattatagctgtggtagcaaaaacttaagaaaaaaccccattctgaaaaagtagtcataatttaataaaatgggacaacaaaccacgccgttgggtcccagctccaatggtccagcaaagtaatcaagggcttccaccacgtcggacttgacatacgcacactgcacactcttc

SEQ ID NO: 33550 - DNA, 1144 bp, Heterodera glycines
ataatatatatatatatacatcagcagggatttgtcggaataaacggatttataattgccgacacttttgtgtttctcgaaattccgattgccgaaaatttttggagggcgtcggcacatttatccctgctgctgatgtacaaattagtatatataatttattgttttttttaattgtgttttagtgttgtcccaatttcagtgtccgccccatcccctctattttttctgccactaaataatccaatttttttgccattttgtcattcgcctgctctcctcctcctcctccactgctcaatctcattatgttgtgtagcttttcactgttcagctttttgttacattgtttttgttcaacacatttcgggcccggaattttgaaaagtcgggaccggaattcgggattggcatcaggccgataaaggcaggcttgccagcaggatttaatctctaatattatattttcaaagcctgaaagtagtgataatgtccactgggaaaatttctaaaattggttttagcttaaattggatttgtccaaacaaaaaaaattggaagttaatagattgtgtccaaaaaataataatcaaaaatttgcgattatgagccaattcagtgtccattgcggagaatgtaattttacacgatttaaaaaaaattttgaaaatttgttgcaacgccaaaccgggattcttttgtcgtgagctgttcttatctcgcaccgcgcgtatcactgccacaattacccactctccagtgatggattatccctttttcttgtagaaaaattttggcttggcggtcacataatgggaaagtacccaactattaagctaggagatttgtcatccaaagaaaatgttgggaagactggaaattgtaaaatgttgaaatttttgcttctaaaattcacataaaatttaaaaaaaaagaaagctcataagctgtaaacttcgttgttttccatgaaaatattacgaaaataacaaaattccgggtcaatatgtcgaaatcggggttctggtctcaattgtccgggtgccggacttttttcaaaaaatgggatcgagaccctgggaaaaccccggcggtatattccgatcactcacggactctacacacatttcacatcataatcaaa

SEQ ID NO: 33551 - DNA, 912 bp, Heterodera glycines
  misc_feature (18)..(18): n is a, c, g, or t
tacaaaaatcttcaaaantttgaaaaaatcataaaatgaccccatacaaaaattttttcagaaaattttctttaccaaaatttcacctttttttgaaaaattatcacgtaaatacaatcagtttttaataataatcaaatttttttaaatatcaaatttttagccccgaattcggaatttttaaattatatcacaaaaaacaaataataaagattaattcatataatcagaaatctcaaaaaattatttcgccaaaattttgaatgtgccaatttccgaaaagacctcttattttccagaaattttcaggcgcttctcaacaaaatccaaaaacttggcctacatgaacagtgattttgatgattttgaaaatattgttatttccaaagaaaacattcattttacgtttatataaattcaattgaactttgaccatggaattttcatgttattttttaattaattaattacggcgatcgagttgtaaattgcgtgctgaattttgttctgcaagtgatgattaatttggatatacttctaattattaattaattaagcggtcatcgagttgaaagttgcgtgctcgtttcggtttaaagcattgaccagattgggtataataataaaaacatctttaagaattaatacagaaaatataattatgtcataatttccccttacttttaaaaagattaataaaagtaatttgttcattaacaaataagcataattatagattaattccccctaattttatttttttttcattttttttttgaatttgtaagaattcattttaaaatttataattctatagcaacggaaaaaaggtggctttttcacaattttcaaatgaaatggatgccagatttaatatttatcacattttgtgcgttcataccagacctgcca

SEQ ID NO: 33552 - DNA, 628 bp, Heterodera glycines
ttttgaatttatcaaaaagtaaaagcaaaaggggggacccttttgttttggaaaattttttaatatatagtcatgaaaatttattccctggggttcttgggggtccataacctcgaattaggtgtcagattcgtgatcagcggcctttaaaaccccgggtatcaaattttcatggttttttatcacaaaaaaattttgcaaaacaaaagggttcccccccccccttttgtttttgataaaattcaaaagggcctttccttaaactagcgccagatttatcataatttaatattttgtccatatttttgtttttttatccatataaacctggaccctaataataaggcaatttccaatacatatatgtagttcattttgcacaatatttgaacatcgatttttggtaaatttaattaagtgactttttgcttttgttttttatctacataataatgaatttttaaacaaaatttttctttaattataaatagaaatgccttctttacttggggcgtcgaatcattatgtagttttgcaaaataagtttggcagtaccggttattaggcaccgtcgagaaagttttaaaaaatttttaatttttatacatatttaccgaaacaaagtccc

SEQ ID NO: 33553 - DNA, 963 bp, Heterodera glycines
atatgcctattgcaactgaaatttattcaactttcccgacaaattgttgagataattattctagacgatttttttatatctcaaagcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcaaaaagttttttcccagaaaacggatgggtcaaataaaaaactaaacatctcacatgaccaatttaaattcccttacattttgggtttactttattatgctggtccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtatattttttacattatgttgttgaagaatttgaggctgcttctgatgcgattgaaattttttcagcttttccttgaaaaagttttttc

SEQ ID NO: 33554 - DNA, 946 bp, Heterodera glycines
taagcctaaagtttttcgctcgtttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaaatttggtgcgtttcagagcagtttgtgaaaaaatatttatgaattaattttgctaaaaaataaaatagtgaagctttaaaattaataaaaaattttaattcagaattactggagtagcatcatagcagtgcttttccttgtctttttgatgcctcgcaaaatctggttcgctcctgatcagtt

SEQ ID NO: 33555 - DNA, 939 bp, Heterodera glycines
  misc_feature (851)..(851): n is a, c, g, or t
  misc_feature (887)..(887): n is a, c, g, or t
gaaaattctggttgaaagaaaaggtttaaaaataatttatagatgaactcaaatcctcatgtccaacatattaaaaatattcataaataatgcttgttgaacgccaaaaataattactagagaagaaacggggtagccgacgcggcattaatctgcaattattaaaaaattttgaaatagcccaaaaccactcgtcttaataacgaaaatatttatcaattgcttttgtttaatattgacaataatatgaatgcaaataatgtaatcgtatatgtgaaaattctgttgaaagaaaaggtttaaaaataatttatagatgaactcaaatcctcatgtccaacatattaaaaatattcataaataatgcttgttgaacgccaaaaataattactagagaagaaacggggtagccgacgcggcattaatctgcaattattaaaaaattttgaaatagcccaaaaccactcgtcttaataacgaaaatatttatcaattgcttttgtttaaaattgacaataatatgaatgcaaataatgtagtcgtatatgcgaaaattctgtagaaagaaaaggtttaaaaataatttatagatgaactcaaatcctcatgtccaacatattaaaaatattcataaataatccttgttgaacgccaaaaataattactagagaagaaacagggtagccgacgcggcattaatctgcaattattaaaaaattttgaaatagcccaaaaccactcgtcttaataacgaaaatatttatcaattgcttttgtttaatattgacaataatatgaatgcaaataatgtaatcgtatatgtgaaaattctgtagaaagaaaaggtttanaaataatttatagatgaactcaaatcctcatgtccnacatattaaaatattcataaataatcctttgttgacgccaaaaataattact

SEQ ID NO: 33556 - DNA, 1045 bp, Heterodera glycines
  misc_feature (808)..(808): n is a, c, g, or t
  misc_feature (810)..(810): n is a, c, g, or t
  misc_feature (857)..(857): n is a, c, g, or t
  misc_feature (895)..(895): n is a, c, g, or t
  misc_feature (1014)..(1014): n is a, c, g, or t
atttgacaaatccaagacttaaaactggggagaagcaagggtctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctngnggtttggtataaccgttttagaaatagcgtagaaaacagcttcgatnatcagaaaccaagtcaagtccagaaaggaatattttanaacgatttcgtttttgtttggcattatgataccgaataactttcgggaaattatggaaacaaaattgggagaaaattcgaatatttttttgactgcaaattttttttctttttttgaanttgggtcaaaaaaattttaagaagaattttt

SEQ ID NO: 33557 - DNA, 973 bp, Heterodera glycines
  misc_feature (881)..(881): n is a, c, g, or t
tcgcgttggagaaagcaatgcgcagaataactggggagacttagggttagcgcatcaattatttttttcagaatgtgatcggggtacaaaaaatacgggtcaaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagatcggcatgaaaaaagacaaaaaggaggaaaatgaaacaaattcgctgctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcngtggagaaagcaatgcgcagaataactggggagactttagggtagcgcatcaattatttttttcagaatgtgatcggggtacaaaaatacgg

SEQ ID NO: 33558 - DNA, 880 bp, Heterodera glycines
  misc_feature (34)..(34): n is a, c, g, or t
ttaattgtcattcatcacaggcatttttaacaanttttttcccccaaaattaagacctaaattttgaagcaatgcttaaaattttttgaaaactaaaaagcatgataaagaatttaaggcttcaagatccaactttttatgcttaattattgctgaaattgggattttctacttaatgattagtagggttgctattgctgctaaaaaatggataaatatagaaataaagctgcattaaaaagagacaaaataaatgtacgaaattttttaaaattataaaatatgtaaaaaagtgaataagtttttataaatgtgattttcatgaaaatgttcttctttaaaaagcagaaaaagcacaaaaagacctaattagcattgatctcttttattttggtaaagtttataggaacggtgactgtgaatttatggaaaaaagctctgcatttttaaatttattttataaaaatttattttaaatttgtttacgattaaaatccttatatcccgaaacaattattttaaaatttaattattattacttttatagacattttactcaaaaaaaaaaaataaataatatattttcattttgaaaatttaaaattatcggttttatatgcctggatccaataaactaaataaaagaataaaaatagactaaacaataaaaatacaaaaatttaagctaccgacagaaaattcaaaattcactagtgacttcaaattttataaaaattttctgtctaaaattattatagcaattaaaaataacatttttaatataaaaaaaaaatcgaaaaataacagagctcgcacaaatttattcaaaaaattctctcaatcatttgcaagctattgaaaatgatcaccattcaggatt

SEQ ID NO: 33559 - DNA, 895 bp, Heterodera glycines
attgtaaagttcggacttcacaagcataaatttggcgaggcacaacagtgctgcttccaccgccacattgctccatttggtgtggtgttgcagcacggccataagcacgggcattgtgcggcctggtcagaaaatggcatgtcaaatggaaaaccaacaaattaaaataacaatcgaccgaccaatgattgtgtcattcgcaaaggtggacttgtcgagcacttgctgaaggcacatttggttcttctcctcctcagagatttcttaaaaaaaatgccgactaataacaaaaaggcatttatttaccttggcaaagttcgtcatcgtttccaccttcatccccattattgtttttgttggtgttttcaaaattcagctcgctatgacgtgatggaggccgtttggggttgggagtgttcagaccctaaaggcatttaaaatagtcaattaaaaacacccaaaggaaatgtaaaaccaaaatacgccgacccatttttacactattccaattaagccaaaaagcgatcttttttgttttccggagtcacttttcatgagaaatctttcgtcaacgcccacccgtctcagaatggtgtctttgatgtggacagaaaaagtgcactcggcgtaggagaggaacttgagcaccacttcgccgacaaagaacagcagtcggctgaccaccaactccaacacggcacgccgttgttcgacagtttgtgtatccaattgctcctcgagtgggtgggttggtcctgttggaagcgtgtgctcagaatcgtcagagccaataattccatcggcacaaactttgggtgccatcatcatcatcaccctgtaaaaagtgccataaattatgtaaaataatatttattttgtgctaaagccttcccta

SEQ ID NO: 33560 - DNA, 814 bp, Heterodera glycines
ttaaaaataatttaaaaatgagaaataaaaaacaagatccgctaataaaaaattgcaccacgacggaacgcataaagccgacaattaccgccctcgggggctttatttttcagcccccctcacaaggtgggctcgaatttagggggaggggggccggcaaatgtttatgcgcataaaggcacgctttatagacaatggaagcaccgactgcaattcgagcgcagaataaaaatctcttttttaactataagaaattcggcgccatccgcgtacattgattctctccgatgtttcacagaattatcatatgaatatgtatgaaaaaatgattttatgtttttaatagagttgcacgggactggcaaatcagctttggccccttgaatcagcaaaatgctgataagcagagttgggagcctttatatttgaatatattttggcattttgtttttactccagcgatttttttcagcttttttccttttttaccgtccatgcatggtgctgctgattgtgaggtgcaaaatggccaacaaagatgactctctgtttcggcaccctttcatgcccattttttgcctaattatcgtcgcagtaaaatgcttgttaattcgatgctaccattccactgattttgaggtggcatttaacattgaaaaagagtcaaaatgccgaagtttgaaggtccaccgcaattggatggcattggtctaccacttgccaatgtccgattggtatcgctccgatttgtcccaatggacgttggactatccgccattttttgcttatttggaatggatttttgcacaatttg

SEQ ID NO: 33561 - DNA, 894 bp, Heterodera glycines
  misc_feature (860)..(860): n is a, c, g, or t
gcgtactatctcttcggttttaatcatgtaaaaaaccctttcacttcgctctatagaacttttttttcgccttacagattttctttaaattttgcatatcgatagagaaaaggaaaatgagcaaactttcagtgttttgagtaaaaattttggcctagaacattacaaaaatgggatgaaaaaaatttgcatttctttttctctccttttggagtactattttcatgtctctaacacataaaaaacaccaaattcgctaattctaacaattttggtttataggctacaaaatcactttgaacacttagaatcaatagaaaatgattagttttcgcattttggttgaaatcagcagtttaggacttgagttataacgtgatagaaattttaaactctcacaacttttttcatatgagttaaattgcttagcatttgcttagaaaaagattctccttttcaaaatctttttttagataccaaatttgttcagtttagttgggaatgaagcgagttatggcagatcaaaataaaaaatacaaaaaaggcattttccagtgtaaattttgaaatagcgcgcaaaaatttacgccaaatgcgctatttggcgttatgagcaattttgtctaacactggcgcgtacccatagtgatatggctgatagaaataaaaaatacaaaaaaggcatttaccagtgtaaacgcgcacaaatttacgccaatttaaatatactatctcgtcgtttctctttttctttgtaatttctctctctttggtgtactatctcttcgattttaatgatgtaaaaagcaacatttacttttctatgtctaactttttttctttatgttaatccctaccanatttgcatagcgatagagaaaaaaattccgcatc

SEQ ID NO: 33562 - DNA, 843 bp, Heterodera glycines
gcctttcatcgccgctcttcgccagtccggatgggaactgtaggtcaattaatggcttatttaaactgtttatggagccaaatttaaaaaaaatccccttttggcacccttttcaaacattggcatccttttcaatgcgttctgtgctttttagacctgcacttcgtccgtctccggcgaagaaagtcgccagcggcggcccgccgttgtgttgctggacgggacgaatcagaacgaattgtgcaccatggtgaagtgagtggggaaaacgaattctcgggttcaaaattaaatggaattttaaatttttactcccccccccccaaattttctcccctttttaatttcctttccctattttcccactcaaatgtctttcccccctttagcgcagtccgtggcgacgacgaccattcagacgtgacggttactccgtatgcattcggtgccgacgacgttctgtacgccgtccttttcccaaaaatgccaaatgaacggaccgtccgtcggctggccaaacagttgcggattcaacaggtccctccctccctccccccccctctctctcttttctctctcccgttctctcttctatctctctccctctctctctcccctatttttttcttcccctcttattacccctctccccctccattttcagtttttcctccgctcctccttcgacatcgccctttgcgagcagttctcccgcctttcctcccgtctccgagctgtccccgctcttttcattgttgttgaagaggcacaacagcccatcaaaaatctgtgatgaacacaacattgccccagatgtgaacagagagtacgaattgttgacgg

SEQ ID NO: 33563 - DNA, 87 bp, Heterodera glycines
ttaacgaggcgctcggtgagcattttaaacgtaaggaaattgaaaataaagaagtttcagaagctgaaaaagggccgcaaaaacgag

SEQ ID NO: 33564 - DNA, 55 bp, Heterodera glycines
ccacgaggtgctggcgcacgccgccgcgaccctgggcggggcgctgttctacgtg

SEQ ID NO: 33565 - DNA, 1288 bp, Heterodera glycines
cttttttatagtcaaatgagtgtgtaatgtcaattgacaaacaatcaaacattgatattgatccatcaagcaatgaaattgttaaaatgtcaattgatgacgaggaaaatgatgtaaatcattaattaatttatgcattcaattttttaaatggatatgaaacttttaaattttaactcaattataaattaattttaaaatttcgccttattaaattcaattttaaatgaatttttaaataatattatgacgcatttaaaatatatttagattttaattcagagaaattaattaaaaaatatatttagccaagttcaagcaataaaagagccaaaaatgaacattatcaggaaaacgatgtaaaagcatattttgggctttcaatttttcaaacgatttaaaatttttaaattttaattctattaaaaatattatatatatatatataaattaatttttattttaattaaaattaaatatttatgtatttgataaaagaagaattatattttgggcttttcttttttaaatgattaaagaataattatatttaaatttaactgaaaacgagtaaaaagattattttaaattttattcaattaaaaataaattatttaaaaatatgtctagccaacttcaagctataaaagatcaaaaaatcaccaaacatcaaaaaatgaatttattcaacaaattgattcgctgctggaagcaaaagaaaatcttacacaaatttacatggacaattggtacgttgtggacgacatggccaaggaatatttttcaattgtcatcaaaatgcttggccaaatgccaccgaaaattaaaaatttgttcgaaaatgacattgaaattttgaatttcaaatttaaaaacaaatatcaacaaaacattggtggcggaggtggtggaacaattaatttggacaaaattttggtggaaaatgcgatggattatgatgaggacacacttcgccaaactcatcggagtttaattgaacgtttcgccataaaaattggcagaatgttggagattacgataaacaacgcttttgtgccgtcgaatggcataatggcaatcattgaactgcacatttatcaaacattttcggaaggactcaaaaagtaattttgttttttaatatttaaattctaaattaagaaagaattttagtattggctggaatttttagcacaagaaatctaggaaattttttttaaatccaaaatttggtaatggaaaaattaattaggaaattaaatttttaaaaaattcattcttaatgacg

SEQ ID NO: 33566 - DNA, 71 bp, Heterodera glycines
cagacgcacgttgcgcagaatgaacggcatcacggtggtcggcagctgataaccgcccgccaggccgcagg

SEQ ID NO: 33567 - DNA, 847 bp, Heterodera glycines
ccaattgccaatgcgggtgggccaaatgcgtgaatgggtggcgagtggctgctgtccggtcggtacagcttcaacaatgttgtgtcacgggtaaataaaattctattgaataaaagaaatatttaatttttaaaaatttttaaatgcaaaaaatcatttaaatttttttttgaaaggcgttgccaccgcctattcctggataaatgcaagaattccgggcaccccggatgatcggtcttcttgagccctttaacaaagcggaagtgccaactaaaacatattgatttaaattattattttttaaataaccatattgatttttctttatcaaccaacattctcacttacaaatttccttatttttggttttactaattaggaatatttaattattgttattcatttaattctcttaacctctacttcattttgactttttcctattttattgaattaattttagaaaaataaatgctggtgcagaaataattattggtttgagagagaattgctgttattgatgttactcaaaaaaatcaaatgaattttataaaagttttggatacaagtgttcgaaaaaccagatttattgagttcttcttggcataacttttttaacggtcaatgaaattttttgaaattttgcagttctaatagagaacatttagggcaatcgaatgatgtcatgaataaaaaaagttactttgaacaaaataacatacaattttctattaataatttcatttaatagtgttgattaatgacacagcaccgagataatcactgattcaaaagaaataacaatttggcatatgatctggcatatccgcgtcaaaatcaaaaaact

SEQ ID NO: 33568 - DNA, 1541 bp, Heterodera glycines
ttgggttgtctagatcactatgaaggagtgatctgatcaagttggtataaaagacttttttggtcaccatcaaaagttgggttatcatgaatcatttcagatttttctgtgctctaaaattccagattcaaaaagtggtcctaaagatgaccacccaaaaaatggagtgcagttggtaaaatggtttgtaatcaataataacaattatgaacgggttaatgattggcatcattaaaaaccccacaaaaaatgctacaagaaatgtaaaacatatatatacaatatacatcaaactgagattttgtaaacaatttaaaacaaattatacaaaatattaagtggtcctaaagatatgaccatgactgtacaagagactatgtttaaattaaattaataaatatatttttgaaattattacaaaataattaattgtaaataatgtatttataatgaaatagaaaacaattgtaaaatgacataatgctaacacatagaaaaatgaaaagacattaattatcaatatgcagaaattaaaaaaaaataaaattttcgcaattaaataaaaatataaatgataaaaaattaaacagaaaaaactttttataataattaaaaaaaggttaaatatttcaaaaattttttttaaatatattaattaggtgtaaaaaaaattaaaactcttacaatatatgacataaatgataattaatataaaataataaattcttaaagacgaaaataaaataaatgctatggtaataaatataagctaaaattaaaagaaattgattattatttttaaataacttttaattaataaattttaatttatgttataaagtaaatttgattatatgaaataattattaactttttttaacaataaatctaaggaaacaatgaaataagtactgcttttatttttaaactttattaaatattcattgattaaaagaaatggcagtcaatcgacctttacaaaaagaaaaaaataaataaagaaaaaataaaataaaagacaccgaggcaattaaccattggcaaatctcttacaataacattcattattcattaaaataagtagtataatttatatttcaagttaacattttggggttttgttttaaaataatctcattgacttcaactttttgttttttttttaataaaaatattttcaacctatgtgactaaaaaatcatttttcaacgaaaagaggaataaatgttcgtaattcaaaaaaaaaaaaattaaatttcattactaaaaatacattaaaaaatttcttaaattttaaatattttcatattatgaaaaaagtgactttgaaaaaataaaaggaaatcatttaaagattgaagaaccaaagttatttcagatttaaaaagataatcaagaataatttgaaaattatattataacaaatattatattatacaaaaaatattttaaatgtacggagcaagaaaatcatgggcgttcaacaatctacgaaaaaataatataaaaaagagcaaaataaataaatgttttatactaaa

SEQ ID NO: 33569 - DNA, 907 bp, Heterodera glycines
ttaaatattgataaagttcttcggtcagtattactttcatattttccaattttacctttaatgatacatattttacttatgccattatataaatatattttgatattatgtttataaaaattcttacattttttttaaacaggtttttatatttaaaaatttctatattatatattttcaagttatattttctagaatttcaaaatagttaactatttcataattattataaaatttcatgtatttttctttatttagaattaaaattttatttaattaattggtttaaaaatttaatttcgtttgtgactttggtaagcgcctttgagcatttattaaatgcaaacatataaagtcaactatgtttactataatttacatcagttttttttcaaacttcactgatttaatagtcatgttcttttaagaattctttagaaatttaaagaattttcaaaaaaaattatggctaaattataaaaacatttttcattttgaagaaatgtttttcttttcctgctttttctctgactccttttcctctttttccacttcatgtttctcctcgttcttcggcttttcctcctcttcctctccatcttttggctcgcacgtatacttaaccgaattgataaattcaacgctttaatcattctttatttgcctgcaaatttccaaaaaatttcgttaggtccccgtttgttataaagtggccggcttcatgtagcgctacccttcgacgaagctccatcttaatttaatagagatgtgttaacatttttaagtaagttgcatacattcaccaaagcatgtacagcatcttgttgagcagttgcatataaattcagcgcacttaataaattcattttatttaattaaataataatctttacataatcagaaaact

SEQ ID NO: 33570 - DNA, 1177 bp, Heterodera glycines
tcatagtaacttctatttcaaatggattgaattataaatttggatattgatcaaaatcctgattcaaactccaaatataaaaattccctttcattttttcacacaattttcgcctttttctaagtttacttttgccgtcgaacccttctcatgcggcgcatcacctcctccacaacgtacgaagcgttcagattggacagtgtcattttggtgggaagcaaagcgaagcgccgatttattcgctggcaaagaatttttaattaaattaattaaaagattttttggccaatttcatcctcacaccattagcttactttgcttcatctcccttaccccctctccctttccatcactccctccccattcgcttggattagcttcatccccctttacccttggctttatcccccccccctttgttagctcccttccgtccctttgtttctgttgtgccacctcttctaatgcgtttgctgctctcccacagatcactttctccaaaatgttctgtccttcctcggccaattccctctccattctcttcttctccgtttcgtccatttccaccacaacattaagcggcttttccacacggagttggcatctgaaggtcattttcactaattaaaaagtgatctccgctgaaaccgttcgattcgaaagatcgccgacccctaaaagggaaaagaagctgatcagatcaatggtgatcaacagagggcacttatccccatgcttttcacttgcctgtgggtgccttagcgcggacacattcattaacaaagtgacatccgtgaccacaaatttcgctgtgccctttttgtcggcggcggaattcgatccattggcggaccgactgatcagcttggccttgcaactgcgtgtgttttgtttgccatttccattaccattcattcagcagaatggctttagcacccattttttttcttggcttttcccatttgccaatgtttccttcacaattcactcttccactttctgtctcacttttcgccttgtctctcttcccccacccctccattttccatgtttttcttacatttatctgtctttcttgggtttgatttcctattttatctatccctacattctctctctttcactccctctttctcttgcaccctccctctcgctcctccactgtctctctccccct

SEQ ID NO: 33571 - DNA, 739 bp, Heterodera glycines
aattcatttggccataaattggtgagaaaagaacaaaaactcatccgatatcaaattgatgccaaatgaatttcattgtcacaaatgaaaaaataaaattcgaagaaaaaaacaaacaaaaatctggacaaaaaaacacatagcaaaacattattttaaatcaaatgtgatcagaaaaagagctacgccgacaacgtttttgctttatattttggctttcatcttctgttttcctgcaccgattggcgggtaaatgattttaccctttgaaatacgaatttcattctgaaaataattcttttgcatgagaaaataaacttctttttgcccatcacatttcacctgaacttcgcgccaaacgagatgctcgtcgaagtacaggccgtgcagtttcagcattttgacgaggtaatggagcattggcgtgttcgggtagtacttctcgcttagcttggcttgctgctcctgaaatcaaatgaaaatttgcatactcaacttatccaacccgtggctaaatttgaataataatattagataataatctgattttcctttgcttacccatggctcggaggccataatttcagcaacgcgcaacgatttgatatcagtcggtcgtgtgatctgtgagcagcagaattgagtttatttttattgtaaaaatgaatgatcgcagtaacttgcgaaggtaacaatttctaccccctgaaattatttttgctggcaacccccccccccc

SEQ ID NO: 33572 - DNA, 1362 bp, Heterodera glycines
ttggaaattcggggttcggggttgtcggggttggcattgtcggggttcggggtcggggttgccaaatcgttcggggttcggggtctttcaatttttgccttatgcctaatagtcaaaatttttttaatattttttcggaaataatatttattaatttccataataatatttgtattgtttttatttcttttttatcagaaattttgtatagaattaattttttttttcttgaaattttaaaattttttattacttttttgttttccaaaacatcttttttcacgtcgctcttttctaaagacttaaggagaaagggtacggcgtccggcggtgccgataggcgccgccgggaaaattttgaaaatttggttagatctgttaacagattttgtccaaaatatgctaaatttttgcgattttgagccaattttttttaataaggtttatgactttttgggccctgtgatgccgataggcagcgctaaattttggaattaagctctattttctaagatttttcaccaaaaaaatttatgaatttgggtaaatttttgtttttcttcgatatgtattttgtcaaaatatgccaagattggtcgatttctatgagtatttaatttaaaaaaacaaatttgtcacaaagaaaataattaaagaagaaaacgtcaaacggtatcgaactcacgacagaaagtaaagtcaatggcactaacctctacaccacattccaaatgtccgaaattgagcaaatcttctttatttaataaaaatttggcaaatggttaaaaaaaattcaaatttcgtctaacttttttgcattttctcccacgaaaatgccattcttaggggtgtatatttaaccccgaccccgagtcggggttaagggtcggggtcggggttcgtcggggttggaagcgtcggggtcggggtcggggttaaccccgaaaaatggcctaaaatgtcggggttcggggtcggggcggggtcggggttgcaaccctagtttgtgtacatcttgccagtcggatgttgcgatgagaatcgcgcctttgcaagtgtgtgtgaccccagcggaggcatatccatccgtgtcgacattttcgcacaaatttccggcataaccaggtgagcaaacacatcctttgcaactttttgagttctggaatccgtcattttcgcacatcacatttttaaagcaaacttctaaaggcacgaaaaaaaagataaaaagataggcgctaacaaagtggccacttttgattattaggtgctatgacgttactcaaaataccatgcaaataaaattgaaattttgcaggataatagaaaacacttagagcttcgaaagataccaatattaaa

SEQ ID NO: 33573 - DNA, 1236 bp, Heterodera glycines
  misc_feature (1036)..(1036): n is a, c, g, or t
  misc_feature (1171)..(1171): n is a, c, g, or t
  misc_feature (1176)..(1176): n is a, c, g, or t
agaatggttttcagggagtttatttgcgctgtttcataatctacatgaattcttgaaatatttaaagtgtaatctttccataaaagcttaatttctcgccaaacaatgttataagaaacagttgtgctaaaaaaatttttaaaaagttagccaaaggcaaaaaccgtttcttcattaaagcaaacgctaatggtatccattcgccattttcagccgataaagtggcatcgccaaactataagagttttaaatttacgaaaaataaatctaattaccaatccgtgaacaatatatagctgagtgaaaggtttaggggcaacttcgaatgtcccatcgactaccaaaatttggcaattttcaactgcttgtgttgctgtttttgtagcaaatattacaattccttcatctctatttcgataaattacccaactaaaaataatatatgctcattttttggaaattaggattactatattcaacaacttctcattagtagttagcggcttatttaacaacaatttaattgctccttgtcgtgttaataataattgctctggtatatcataggaatcggtcgaaatcccatgtttttgctgtctccttctattaattataagctcgcctaattgagtcaaaggtagggtaattatatgttaaagattcttccgtatctgtttctgccactgttgcaatgtcaaattcttcggctttttgaaacccctataaaagtgaattttcttaatttttaatatttaaattacctctctccataaggtttttatattttctgtgcatgtgagtattttcaacctttgttgcctatcaatttgctcaacactcaatttttctattgggtctccaatgcatttttcatgatgtataattggttttgtgctgaccaaattcatattctcgtcaatgatagtatgagctattttaggcactctgttaaaattaattaaattaagaaaattttttaaaattcaaaaagagaattttctttttcctgtatctttttgcattttaagcattctanataaaattttctttgatataaagttgaaacaacaaattttctccaattatttgcttcttctgttccaattaaaaaaagtttttcggtatcttttttggtcgtacattgccgaactatgaaagtttcaccagtatntctgntttgatttgctacaaaataagcagctccaagactttttttgattttttcatgtagcgctc

SEQ ID NO: 33574 - DNA, 1032 bp, Heterodera glycines
aagaagaagtgagttaaattgtaacattattggcaattaagttggtcccatataaatttggcaaatttgtctttttgtgttcaattggctctgacaatgggcacttttcattgcctttccctattcattttcagccttttccctcaacatcgactgacccatcgacgattgatcttacgattcaaaagcatgtccattcaattgtggaagagcaatcagagcaggtaaacatttttatgtcaattgctatgaccatgccttattttgatttatttgtctaaaactaattttgaaacggacaaaaaggtatccgcctacgaatcggaagaaattgaagtgaaacgaagaaaaattgtggtggaggaggacgaatcggaagagagcatcccgacacttccgccaaagttggacgaggagagcgaattgtcgcgactgaaacttcagtaagtgggcaatttgtaatgcattttttcgctgggtttttcaataaattaatttgtactgctccataaaggctgctgctatcgaacttttcgcaagaacaattggaccggtacgaagcaatgcgacgggcgagtttaccgaaatcgatcattcgacgggtcaaaaaatcggaaatgcttctccccccccccctcaccaccatttgttcagttgatccatcagttcactggtgtgaccgtcaaccaaaatgttgtaattgcaattgccggtatggccaaagtgttcaccggcgaactcattgaagagggtaccaaaacaaacgcattgatatggggatttttaccaatgttttgtagcattggacattcaaaaggcggagagagaggcgaacactgacaaaaacaatggcagcagagagaggcagaacgggggcgcagaagatgaacaaccgcaaaatgagcaggcaaaaccggggagagaggagacacacaaaacccatggggcagagagagcggggaacggatttttattcggaaaagcatggaaatgaattcaaaacatacgaaaaaagagggggggggggggggg

SEQ ID NO: 33575 - DNA, 877 bp, Heterodera glycines
  misc_feature (95)..(95): n is a, c, g, or t
aaaattcggtgtgctttatgggatggccaacgacaaattcggtgattatcagacaaaggcacggcgctgaaactgaacaggcgcgcatttattgnccaggaagtgggctcagaacgaagagcgaaattgaggaggaggtcagaaatggcattgatacttaagttaagcaatttatccgtaataaaaatttcagtttaaatgtgcccgcgacggcaaatacccagaagagaatttggaagattggtcaatcacaggcaaacggagtttgactcagaaggcgcttttccattacacggaccgtcgggcgggcaaaggctattccgactttggtttcgtttcctccccattaattcccaaccgaattcgactctttcagccaccaccctttactacggtcgcccttacatttggccgcccgttcgcgaaattaaccgatggcactttttcatttgtgtgacctttgccctggttattctcgtcgactgcaaatggtgagcagaattggttgttttacaaacatgcggatttttgtaaaaaaaaaattttgtacgtaatcgaaatctgaaattttgcagacaaatagcacattaaaatattatctgcaaaatttcaagtctttctaagaactacatactgacaacgaataagaaaatcagctttttcaaatttcttgataggctaatgacttaaattcccatccctattcataagatttcctaaaattttccggcgcgccgggtcttattttaccatttattttttgaaaatttgaacccaaaatgtcgaaaactaaaattccggctttcactgttttatatttcttcgcccttttctgaatggtcgtccttcgaattgtttcgtccgccctaaatcggaa

SEQ ID NO: 33576 - DNA, 1602 bp, Heterodera glycines
  misc_feature (1524)..(1524): n is a, c, g, or t
agtgagtaaatcctataaaattctaatttttttatgcatgtttcataaatattttggcatttttaatacatatttatttacacatattttgcaatttttcttaaaattttaagcgtttttttgcagccattttagtattatgtttacgcaacatttcttctcgtaattcaattcaaacatcgatatcaatttttatgagaaaatattagctagatagaaacttaaaaaatgaatgaatatatgtaaaaaaaataataaacaattgtttattattttaaaattatcatcaacgaatttccttcaaaaaattacatttattcggttcttaaattgcaaaatcattatttatttatgtgacataaaatgagtatgtaattcaatttactcactttataacatttaaatttaattatttttattataactgatacttttaagtcttcatagtgaattaaaaaaaaaatttataatgaaactgagcaaaatcgaaaataaaattaaaattaattgcaaataatacataaaaagaaaaagataatagtataattatgtcaattggaatgattttggcaactaaatttaacaaagataaattattaattgaattcaataggttttttacattgccaagctaacaataagaaagtaacaaatagaagaaaatgataattgtataattaatttttaattataccaaggtttattccaaaaaaatgaatgaatatttattatttttagtaaataattaattgatcatttaaaaatgaaaaaccaaaacaattaaacattctaatgaacgaattgatggacagaaagacaataaaaaattaatgaaaaaaataattaaattttacaaaaaataaaaatatatcattaaaaatatacgccgtccaaattattaacaaaatcataataaattcgaagagagggacctttcattttaaaaagatctgaagatacataaaaagatacttaaagaataaagatccaaaaatggaaaacaatttgctgacaatttattttttaataataaatatcagcaaaggaagtgccaaacttagaaatggttttaagatttgaatgttatcagtttttgttttaataaattacaaaattattaattgaaactcaatagacattcatggaaaaaaccgcaatagattggtaaaatttccttcgggaaatcatggaaataataaaacaaaatattcaattatttttattaaacaaaataaaacttaaattgataaataaattaatattaaaatttacaatatttgaaaatatttagcataagcagaatatattgcataatatagtcatattaattaacaaaaaacaataaaattatcaaatattcttcctaatccatccctatcgtaacgcaaatggacgaagtgccgtgaattttaaaaagaatagaaaagttaatgagaaaaatatatgcattgaagaagacaaaaaatgtaataaataagtaaaaaattaaaaagcaaaaaagaaacaatttaaattataaaatanaaataaattttaataaaatacaatagtattattattattattattattattatttttattgcattttgtatcaatata

SEQ ID NO: 33577 - DNA, 989 bp, Heterodera glycines
tctaacaagggttgccattcgtccttggatgggcctcgctgattggaaaattgaaagggtccttttttgcaaggtgtccttgcaaattagcatccgaaaaaaactcaaaattttaagatttcaaatttttaccaatgtttttataacttattgcattatttggtgcaaaatatgttaataaatcgcacaaaaaaatcaaaaaaatttttcctggcggcgtctatcggcccattttttggatttttttgaccactttttgtacatgtttttgcaagccctaactacataggtatgttatgcaattaaatcctgttaatggacaaaattttgccttgtcaaccttctactagcaacacaagttttacaaacaatgaaaataatgacaacaacataaaaatagacagtgacaaatgcactgtaacagaaatggaagaagacgaggaagaggacgaagagtttcaaccaaacgagacggacctgagcagtgatgatgtgattagtcagccaaatgttgagagtgatcaggtttatcaagcggcaaaaaaaaattgtagatcggtgttaatttcagctagattctgtttatcatactccgaattgtgaaactcagtggccaaaagagaatgacgaacaggttgcgatgttaataaaaaaaatgtaatagttagccaaaaatcaagtcggcagaaactgattctgacaccaatttatcagaaaacttctataggctgattcgaaatcatcatatgtgccctttgtagaatgttatacttgatgattatattaagtggatgcagtttgagaaaatttgagtaaggaaaaaagctagaaaaagatgcctaattgaaagatctgaggatgcttaattaattagagtcattaagtgaaggagaaccaaacatttttgggtcaattacctatctaccttttattaatcgaccaaaactcaattttaaatataggaaatattatgaaaaattactgcctct

SEQ ID NO: 33578 - DNA, 838 bp, Heterodera glycines
  misc_feature (44)..(44): n is a, c, g, or t
aatcactgtcggcacaagtcatttcgtcgctattttctttttcncaaatcgttcaatggggtcccaagtcgtaacaaaactcaaatccgaatcctaaagtggataaggacaactgtattttttattcttgagtttacattaaatcacctgctgcccaaacaattcgtcctcaaagttttcttcttgcgagcttttgtttggtgtcaattcttccactttttcattatttttcatgttgaaactgcagcttaattaactttttttttaaaaaggtgtgcattaaataccccggtcattatttaatgtttcactcttcctaattcagtcttcatgaacagaaaacatttgcaaataattaacaaataaacaattttatcaaaaataccgtatttcttcgattatatcccccccctcgattagaaccccctctcgaataaagccccccttttgaggggggttaaacaatagagcccccgggggctataatcgaagaagtacggtattacatatttattcacaaatcgaaacaaatgtgaagaaaagtattattattaggaagaagatactaaaactgattttatagaattgtttttttatatgatgggctcaatgttctcaaataaatattgtaatttgcgcctttttactgtatcaaattatgattttgcggtatgttacataataagcaaattgccacggcgaagggcctgcttacatgatttttttaactttgttttttcactcggaaaaattctaaatgtgaaaaatgtcatataatttcttagcactctctctattttttgttttgcatttcgtgaatttttgtaagtgaaatttt

SEQ ID NO: 33579 - DNA, 1261 bp, Heterodera glycines
gggtcctttccttttttcccattgcaaatttttgttttcctccattaattgcccaattaggccaaatacagaagaataatgaaaacattaaaaagaacagtaattatcgtcaaacaaagaaatgcgccgcggggaaaaaagacaaaagcaaaacaaattgggcgaagaagcgcattttgtgggtgggcaaaagcatcgatcgatccgccgatggtcgggcgaaggtttcgctctaagcggaggggagggggacaaaaataaattaaccatattattagctatgcctcggtttggtctgaatgtcagatgggattggaacaaaattggcgccgtgccaatgcgattttaaggacagatattagaacagatgtccctggaattgtgatgccaaacggaagtttggaggggggggggggggggtgggtttaagttcccccggacgaattgctccttttgcgttctcaaaatgtccttggtagttggttattctccaaggacgaatacgttttaaattatttatttataatttagaattaacaatgttttaaaaaagagaatatctccacaaatgggacagggaatgtgaattataattggagaaaggcccgaatatatagcagcacaagtgggtaattaactaattaacatgtgtgttgtaaacaaatggaatttgggacatttaaagcgaaatgaatgaatcgccgagagtttgggggggggggggaagagaagtgggaagggatggaattagtggtaaataaacaaaaaggaaagggaaatgcataaaactgatcagtgatcagcagcactgctggctctgataagcgacaaatgatgagttattaataaattaatctctttgagtcaattctttgcaaaaaattgttttttctttttctgaagttatttaaaaatcgtaatcatagttacaatatttattttcaagaatttattatataacatattatggttcgacagaagcaaaatttcaacacagagaatacttcaaaagatttgtacggcgggttcaaagctcccgataaaaaaagcggtgatatgaataaaagggttcaaagctccctcgaaaagcggtttgattcctttatttgtctgaatgattctgaagaaaatgaaccgatggacattccgaaaaaacgaaaaaagtaaagtatgaattcggctgatttgtctgatgaattatcaatgcaaaaatttgaaaaaagaaacaaaaattcggattttcacgaggaaatagcggaat

SEQ ID NO: 33580 - DNA, 938 bp, Heterodera glycines
ggtggggagggaggtgcggtagcacataatcataaaatgttgttcctaaacagaaatataatatgtatgcccccctcccccccccccttcttcccccattcatcgtcatatctcctgctgcctgggggaatgatttttatttgcaaggaagtacaaatgttgaaaaaaatggcaacaatttttaaaaaacaaaatatttgaaaacaaaggaaattttatataaaattttaaaaaacagattcaatttatgtataaagtctgtttttgaatgaaattgatatataattttgtgggggagggaaataaatttttatgtaaatggttgcatggagaataatgaaaaaataaaataaaataaatgcaattaaaaacatttttataataaaatgtatatattatacacatacaacccaaaaataaaattagtggggctgcaaatttcatgtgtatacatatttttccaagattttatgtgctctgctgggacttcatttttacatattcgaattttgtatgaatatttcccaattattgagattttaaagaaaattttttcataaatgcccaaaataaaatacaaaatttcgctcatatttccatttttacttgggtttgagaatttatagaaattcttaaagaaatttttgaaaaatggaactaaaaatcatttagaaaagaaaaaatcaaaaattaatttttcaaaatatattaataaaatttctcgcattttatgcttattcacgcattactaagaataataaaaaaatattattatacatacctatatatggtagattataattggagtttttacattcattcctacaattaaaagcaatttaatacataaaaataccagtaattcaaaacagatacataatattagggctgcttcccgacattttttaaattctccagctatcaccgacaaaaatttt

SEQ ID NO: 33581 - DNA, 1197 bp, Heterodera glycines
  misc_feature (103)..(103): n is a, c, g, or t
  misc_feature (121)..(122): n is a, c, g, or t
  misc_feature (162)..(162): n is a, c, g, or t
ttccagccttatggaaagatatatgggacttttggttccatctcagttgtcaacgccgcgactgcatcgttatatatcagtcgatagattttcgaatcgcttntaatcgtctctttgcgtnnccttaatcttcactctgagccgagttactgcggtctaacnacgttttgggtagaatggcggccagaattaaaaaatacagtttgctatggcttcgcatcacccgcttcaacgggtgttcagtgtaaatatcgactggccattcaaattctgcctttccagccttatggaaagatattatggaacttttggttccatctcagttgtcaacgccgcgactgcatcgttactatatcagtcgatagaattttcgaatcgcttttaaatcgtctcttttgcgtcccttaatcttcactctgagcagagttactgcggtctaaacacgtttttggtagaattgcggccagaatttaaaaatacagtttgctatggcttcgcatcacccgcttcaacgggtgctcagtgtaaatatagactggccattcaaattctgcatttctagccttatggaaagatattatggaacttttggttccatctcagttgtcaacaccgcgactgcatcgttattatatcagtcgatagaattttcgaatcgcttttaaatcatctcttttgcgtcccttaatcttcactctgagccgagttactgcggtctaaacacgtttttggtagaattgcggccagaatttaaaaatcagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagacgagctgctgcggactaaacacgtttttggaataattgcgaccagaatttaaaaatacaggttgttatggcttctcatcacccgcttcaacgggtgctcagtgtaaatatagactggtcattctaattctgcctttccagccttatggaaagatattatggaacttttgcttccatctcagctgccgacgccgctgcatcgttattatatcagtcg

SEQ ID NO: 33582 - DNA, 999 bp, Heterodera glycines
aaacaaaaaaatcgattttttcaagtgtccgtttgggggtactcaaacaattatgggggagcaaaaatccaacgcagaattaaagtacagactatagggaagctattcccgaaggattcggtctccccataaatctgggcgcatcggttcggggggactgccccgaaaacaaaaaaatcgatttcttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaatccaacgcagattaaagtacagactataggggagctattcccgaaggattccgtctcccaataaatctggggcgcaccggttcgggggggactgcccccgaaaacaaaaaaaa

SEQ ID NO: 33583 - DNA, 1075 bp, Heterodera glycines
atcgaaaaaaccaggtgaaaaaatttggggaaaaggtggttcatggggcgatttttctctgctggcccacgcaattgcctaggtgtgtggaggagggaggaaggggaaaatccttattttactgttacagtaacggtaaaaattgataattaccgtatcgatttttgatcaaatttatggaattcgaacagtaaagtgctgttttgaacaggtccaaaaagccaaataaacttctctaaactgtcaatgattttaccgtatcataacaataattacaaaataaaccgtcctcttgcacaaaatatgaatatttgtcaccctgtaaaattaaatcaaaaaatctgaaaaagaatatataatcttcaaaaatcaattctatttattaggttattttttctttttatttttttaaatgattttaatttaaattcttttcaggccagaaatgaaagttcttaaataaataaacaccagagactaaattaaaaaacgaagtcaatggatgtttagaatttttctatttcatttcgaaacaacgaaacaatggaacagttttagtattaatataattgacgtaaaccctaaagcctaggaaattaaaataaataaataaaactgaacctaaaataaaaaaatttaaaaaaaaaagaatggcaaatctctgatcaattaaccggattcaaaatttagggcttccatttcataaaaaaaaactcaaaatattgaaagaaaatttttaaaaaatatataaagttctaagaattatggggtctcagggtaaaatttattaaaataaacaaaataaaatttaggccacatctttttgtacctattcttgcattaatgcatattttataatattttaaatttttgtaaaataaaataattttaattatgcaacagaaacaaataaataaagtttatgcacagacacataataaatgaataatcgtcaaataaaataaatccaacagcaggaaaaatgaaaagttcaaaaaaaggagaaaggaaaaaaggacaattcaaggacagaccaaaagaaaagcaaatgacaaccgaataagaaaaaactagg

SEQ ID NO: 33584 - DNA, 876 bp, Heterodera glycines
tgcaacactgccattcctctggtcaccaatttgctgaccgttttgctcagttttttcggaattcgaaagtccgaattaaccaaatttgcccatttatccgtcagttgttccgccaataagcgaagttcttcaaattcgcaaacctaaaaaattagtgaaatgaaacaaagccaaattgtgattaaaacgaacagcggggtcaggttcagccttagcaatttcagttggaccgtcgacttcttcagcaacaaagtccgtcatttggttaaccatttccgatatgacgagtttatcgggcaactcctaaaatcacacacaaaaatgatgaaattccaccggtgaattcacaggctcaccatgttgatcatctgattcaacgtgctcattatgcacacctcgtccacttggtttttgttggtcaccggaagacgtaacagaagtcgagcaatttgcgattggagttgcaatgccgggagatcaaacggtggcagaacgaaccaaattcggataagggccaagccttggtgagcgacgaacagacgcaaaatgttcgggtcttcaatggccagcagaaagtcgaccatccgtcgacgggactccgtttgatccacccgcaccataagcctaaagaaatcgaaggaaagtgtcgaacccatcagggaacttatgcagaccaaagcccctccttctcttacacattccccatttgagcacctgttaaactccaacactttctctctgttgcgaagcggccccttcgcgaggatttcgctcacttcggccgtctcgcgcagtgtcgggtcggagattctctcgggtctaagggccaccgctcgcttcgggtgttgtttgtcggtctttcggtcaaattcgcca

SEQ ID NO: 33585 - DNA, 978 bp, Heterodera glycines
attcagcgaccccgaaaaccctaaaatagacccattttccggctttttatgagctttttagactttggacaattgtctaattgacaatgagtatcccaccacatgtaaatgattgattgccccatttgttctcaggtgccggctccacaaacacaatccgtttgcagaaagtcgaataacagagggacgtgtccaatgagcttttgaagacttcgcgtgaccgatgaaaactttttttaggaatttacgcttttgtgacttttgttttcatatttttgttgactcggtgtttattctcaaataaagaacctacaaaggagaggtacccaagtgaccatgggacttccgaatgaaactttcagggtaggtagattaccccccctttgtattataaatttttttttatttttgctaaatgaagcttctggccgagatatgaagcttttcctttttgccttttcaatatcattttcaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttatcttatatgagagaataatttgtctattgacctattttgcttatcagtaagtgttgaaaaattctgtcgttgctactcttctcggtcctctcatctactctcgtcgcattaataatcattgtaaaaatacttcccaaataaatgccaataaatccaacaaacgttattcttttattgcaagacatattttttgtgtaaaagcccccccctcccacccaattaacaccaaaggaaaagctgctggcaaaggatttttagacacattggaattttgtgcaaaacaaggttcaaaaatgagactttgaaagacctaattgtggat

SEQ ID NO: 33586 - DNA, 964 bp, Heterodera glycines
atcccagaaaaatgactatctttttttttgataatttttatacacatcaaaatgctctcgaccatgatgggagggcggtgccccattaccttttatttttgaggaatttttaaatttatactctatcccagaaaaatggctatctctttttttgataaattttatacacatacaaatgctctcgagcatgatagggagggcggtgcacaatagcccttttattttagagggaatttttatatttatagtttatcccagaaaaatggctatctctttttttgataaattttatacacatacaaatgctctcgagcatgatagggagggcggtgcgcaatagcccttttatttttgagggaatttttaaatttatactctatcccagaaaaatggctatctctttttttgagaaattttatacctcacaaaagcgcttgggtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgataaattttatacacatacaaatgctctcgagcaagatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatgcctatctctttttttgagaaattttatacctcacaaaagcgcttgcgtatgagacggagggctgt

SEQ ID NO: 33587 - DNA, 947 bp, Heterodera glycines
ccacatcgccagttctgcttaccaaaaatgggcccactttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcagcccaacgtacagcaacaaacgggtgaatgcagaccagatacgccagctctgtccgtttccaccctcatcggtttcacgtcctctttaaactctct

SEQ ID NO: 33588 - DNA, 985 bp, Heterodera glycines
ctgcagcgtcgaaaattcataattggtataaaatgcaaaactatttcaatatttaagtaaattttcattcttttgaaaattaattcatattttcgaaaaaccctaaaaaactatactaaaattaatgtataaaatatttccataaataaaatttcaaaggaaaaaagaaataaacaataataaaaatgaacaatgtcatttcgattaattcatgaaaaccaaattgtcgaaacttattctaaaagcatgtgattccgataaagaaatatgcacaaataaattgaacaaaattgaatattaaattagtaaaaaatgataatgcaaaatttaaaaaaagcaattataaaaagacttattctatatttgtgaagttcgagaattgaaaaaagctcaaaatgattaatttttataatgatgcctaattgagggagccctataattttaaaaattttaattcatagccagagaacaactcaaagaaatcatggttgaagtatacacagatgcacataccgcagctcgaaattttttgtttgtttgtatgtgctacataatacaacccagggacattgctttttttcgagtaaaatttcatattttcataaaactgagacaaaagcgtatagccaactcagcgccactggcgcttagtctgccaccggcgaataagaatgtccccattattccttgatgcgctgtcgaaaattacgcattgctgcaaagtttattgcgccgatccatccggccaattagatttaaattttaaaatagataaactttttagcaatcattcaaaattttgtgtttttagcacattttgaacagcctgagctcatcataggtaaattgtgaaaattttgaaaaaatttctataaaattggcactaacattgcgcagaatgaataatgcttactttttgttggtcgcaaaaactttttacccttgagtacttttaatttttggaaaattcggtgattttttttaa

SEQ ID NO: 33589 - DNA, 912 bp, Heterodera glycines
agctttgatcagtgtcctctcgctgtctctcactctctagctgattagagtcggatctatgtgcctctctctcattaagttcaggctcgcccatccacactgatcggagggcaaaaatgaggaacacagagctattggtatttcaatttttaaaaacatttactagcaaaatttgacgcctccttttttcatatttttggtccattttacaagactttgattagtttatttatatccacacacacatacacgcatatcaccaatacatacaatttaagtgatcagatattgattgatacatgatacacacacatcaacgaaatacatatgtacaattcaaaggatcaataggataaatgtcaatttcttatccttcttctgttgttgtgccatgatgctaatccaacgccacatccgcggttgtcgctggagtagtcgcagcgggcgcctcagtattggtcgccgcattcgtcgtcggagtagtcgccgctccggttggatcattgttagtcgccgccgctccatccgcggtcgtcgtcggagcagtcgcagcagcgggcgcctcagtgttggtcgccgcatccgttgtcgcagtagccgctccggttgcgtcagtgttagtcgccaccgcgccatccgcaatcgccgtcgttgtcgccggagtcgtcgcagcggtcgcctcagtattggtcgtcgcagccgtcgtcgtcgtagtcgcaacgggttcgttggcgttggtcaccgtcgctccatccgcgttcgtcgttgtcgctggagtagtcgcagcgggcgcctcagtgttggtcgccgtagtcgcaccggggttcgttggcgttggtcaccgtcgctccggccccgcggtcgtcgttgtcggtggagtaatcgcagtgttccccgcggtccgttgtcaca

SEQ ID NO: 33590 - DNA, 719 bp, Heterodera glycines
gggaaggtcaacaaaagtgcaaaagaatcaaagcaacaaaaatattgaaaagcaaaggcaaatgaaaagaccgaaaaagaaaaaagatgcaaaggatgctaacaaaagtaaggacaaagcaatgggacggaggagatgaactgggaaaaagtgatcagataaaagggaaatgaatggacacacaaatcggcagggaaagggacaaaaaaaggacaaagtgccgggggggggggggggggtcagtcaccagaatgccatctgccataagcccacaaaggctgttcaacacacactgaagcttatttaaacggggcattttcctttcattcttctcagctctcagagtaatccctttccaccccaaaatttggcactttttctctccataaaatttttttattggcttaaaaagtgtttattccttatttccacaactccgatttcttttaaatttcaataaaaaactaaagacccattctctaaatttattttcggcaattttaattgaataaaatcagatgtcagaatttgtcagacacgtcattagtcgttcgagttttcattcgaggactgttttagctatggccaaaagggggatttatttaatgacctttcaaattggcagccgttttctgaatttgtcgttcaagcgatttccgctcaagttccttcattgaaaaagggtttgttgagggaattttctgcatttaaattgaaca

SEQ ID NO: 33591 - DNA, 820 bp, Heterodera glycines
tattaattcattgtctgcctttgcttctcccatttccttgttcatttatacatcaatgagcattttgtgagggtggcgaaggtggggaaggttaattaatttattcgtccgtccgttgccggggaattcgcagaaaatgaaaggcgaagtccgtccacccgcgcacctttcatttttcttcattcattctgcaaaaagataaacagttaaacactcattagctttggccagtaatttggtcgacaaagcatttaattaataaattgccaattattggtggcatagaaacgaacgaacagatggacggacttagggaagggtcatccccccgccgggggagcggggggggggggggaggggaggggagcttcccgaaatggtcatgataatttgtaaaattagttgggataagttgaaatgaataattctatgctttcattcgcacaatttgaccaatttgtcattaattaattacctttaccattttcacagtgtccaatgtctcgtccggatctcgtctcctccaccactcccattttatgatggaccgttccgagtctgctgaatcgctttcatcgtttttctctaacataaacagtcgtacaatgacttccccaggggccgacgaaaaatttgctgggacactccttccgcgggagggaaattacgaatcaatggtcgaggggacaaaggtggatgaaccagcagatcagcataggggagaacaacgaattccgattgaaaggggtggtgattatctaaataacttgatccaacaacagtggcgcgggagggaagaatgattgatcgtggaaaaatg

SEQ ID NO: 33592 - DNA, 746 bp, Heterodera glycines
atgattagatactatttaaaaaaaacattttttgcaaaccaaagggtccaaattgcaaaagtgacacttggcaaatggcgcccaaaatgccattttcgacattcattaattaattcattggccttaagtcactgcaacatggtgctagaagatgtgaaggaaatgtggacggaactgccgaagaaaggaaagggcaaaaagaagtcgaaacccgtggcgcgcgaccgtttcatccccaaactttttttgcgcggcgacagtgttattctcgtgctgaaaaacccgttggccaacccggacgcttgaagacggaagtgtcgggggatggaaaagtcgtcgttgttcttttcgcatgctttttaatcttttatttaaataaactttgcctttgcgttttttaaaaatattactgtttttctcctggttataatttttaaaatttcaattccctcggacattttccgaatggctccccgaaaaaaggtcatagaaaattagaactggaaaattggacactataggaaatgagagaaaattcaaaatgaataacggtaatactatagatggtacccccccccccccctttttgaagaaaattttttttttgttctgaaaagtcttggaaacatgtttatggggggatttcgaggtcgctgattacgaatatggcatccatttccaaccaattcgggatcccggacccgaattccaaaaaaagccgcaaaaacctaaaattttgaaaattc

SEQ ID NO: 33593 - DNA, 1553 bp, Heterodera glycines
ctcatagatactcgttaaaggatttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcggcgaaggcgaccgagcaagtggtaatgacacagcgctggccaggcatccgagcttcccggacttgggaagaaccatctcgccgctggacacagctccgagggcagtgcacaggcactcacacgagcactccggatttcccggttaggacacttcctcaggccaaaggccttcgggcgcttatgtctcggtgttttttcgaatgcaagcacactggtccccagggcaaggagttccgatccacgaactcatagggcttgtcaaccatggcaatacgccactcgctcgtataccaacaccaccaccaactttaggttcagcatccccagtgctgagttccccacagcatttgtgccttaggcaacatttacacaagtcaattaactcgccaaatttctttaacacacagacgagctgcatgttttattcatttcgacagctgccaatcgctggagaaactgaggccacgacaaaggtggcaccccagcagcagccatcaccgttcaatgccgagcacaagcgcaagcaagcacttaaacccagacggccgcgctccccacagcgaaatcgcttcttttttccagccacaatatcgcaaaaacggcccaaccaccacactcacccacgccaattaaccaacgcaaagcacatacgactaggaactttatacaaatttaaaaaagtaatattttgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaaaaaatggaaaaaaaagcaaagtcaaaacacaaaaccttaa

SEQ ID NO: 33594 - DNA, 365 bp, Heterodera glycines
  misc_feature (21)..(21): n is a, c, g, or t
tctttcgtttttatttatttntttgcaaaattaattcttaaatattttttcagaaagggttctgaaacgcaccaaattttatttacatgttagtttaggcactctgatgctcagttcatttaaataatttttatccaaaaaattttttttgggttttcggggcagtccccctgaaccgatgcgcccagatttatggggagaatgctcagttcatttaaataatttttatccaaaaaattttttttgggttttcggggcagtccccctgaaccgatgcgcccagatttatggggagaaaattttcaaaattctgagtctcctattattttatttttttttcaaaatttgaagggcggggggggggg

SEQ ID NO: 33595 - DNA, 783 bp, Heterodera glycines
aattgctggatggttgtgtgcagcagtgacacgtccttctttgtattgggtaccgtcctcatcaacttgccaacgaataagtacggttgcacgacctgggcaatacgggggccttcttggacagcgccaatattcgcaaccatcttcgactttggagagtgcctttgaagtttggcattttttaaatttaaaagcatacaaacttcaaatgtatattcatagccgtcattggtcaggagaagtttgccacgatttgatttcgcctctaaaaaacgccggagagccatgaagaaatgaatggaagggaatgagcggtaacgcatgcaaaacactcgagataaaatgaccattgctctcctcttatctttacttatgagaaaggtcaatcactcataatttgcttttgtgcccttgtaagccacattgtacagacaaaaatggaatcctaaggagaatataatttttctaatcaaatactgtatcattattttgtagaattgaaattcagcaatttttattcatctctctacctttttttaaaatttagtgctactgacaaaatgaatcgttgtttccgcgttaattttgtgtgaacttaattaattttccgccattttaaaaatttgcctttactgacgaaatcacttcttgtcgaattcaatttactgtcgaaatcacaattaggcacaaagagtaagcgaaatagttcactgtcgaaatcacttactgtcgaaatcaatcactgtcgaaatccactgtcgaaatcacttactgtcgaaatca

SEQ ID NO: 33596 - DNA, 724 bp, Heterodera glycines
aaagactgcactggtcgaacatttgtcctgatcagcttcccgtcctccccttgaattgtccgtaacaattgaatctgagcattataaattaatttttaatttttccatttcttaattggcaccagctcggcattgttgaatctcggcacttcgtacactgaccacaccaccgcttcgttgcagtccggtgtggtcagagagccgttgtagcggaaaaaagagtttaaatcggtgggtaaaagaacgctgggcatgcaaatgtcaatttgaacggaagcatcttcaatttttagagatttcaatttaaaatttatattttaaactctgtgaattatgtaaaattaaattttattcaaattcgaggacgatttgttgatttctaacctaaaattaagaaaccaaatgaataacaaattttaaatttaatagttcaaattcaaaatttttgtgtacatttcatcgccaaaattcctaaaaatttccacaccttaattggtttttcaagtgcctgtttttggccccaccatctttcagtttttttttgccatttatcccacctgcttttgtcacttgacttagtgcgttttgcagtgccaccaatgggcgtccgatgaatgccgttttgtaaaaaattcccaccacagcgaagccatccgctgttcgatgtgcttcttctgttgtaagcccttctttaatatggacaaggtgaagctaaaatagcaaa

SEQ ID NO: 33597 - DNA, 801 bp, Heterodera glycines
agagaaaaagaaacaaaatttttcaccaaataacttttgatcgatccttatttttgtattaaatttccttattaatcgctgtagaatttttttctctatcgatatgcaaaattaaaaaaaatctgttaacggaaaaaagtttcttagaataaatgaagagatagtacgccaaactgagataaattacaaagaaaaatagaaacgacgaaatagtactaggcttttctctgccagtggggcgtacccatagtgtcacacaaatttaaggccaacaaagagcagagattggcggaacagagaaaaaaaaagaaatttttaaaaagatgagaacaatttatttaaaattcaaaagagttgccattttgaaggggattttgtctgtttttcatttcccatatgtatttgagtttgaaagaatattatggccccaaatttttaaaaatccaggatcagatttaaagggaatttggcaattgacaagatttccagaataaaatcctgcttttcggggctccaatcccagccatgttcaggattctcaaaaaataatactaatacaaaaataaaatgactaaaacagaatgggcacctgggttccatatcggatatgcgtctggatttctggagaaaattccaggtccagaacaaaacacaagttgccgaaacccagggaaaatccaggttcaggccgatcacttgtacccacttttgaaatttcaatgggatttataaataattatgccaattccaattagagtccggtaaaaaaaatttccgggagcgggatcgggagtcaaattt

SEQ ID NO: 33598 - DNA, 845 bp, Heterodera glycines
attgcccgtcaccgccgcgcggcattcactgcctccatcagaaaacaacggcacatcgacgcaatcgaatcagcaacgaaagacgaccgaagcaacaaaaacagtgccaaaagaacaacaaagagagtcagtggacggcactgaaaatgatgatggcagaaagagcggtaggagcagcaaaggggaaattggaagacataaaggagggaaagaatggaacataattaccaaattatactatcgtataatgtatgggcactgaattaagcgggtgccatcaatcgcagagacccatgaaaaatgacataacaattaagaaaactcatgacctttcgctgctcccttttcaggcagactgtttggcaaagttgggcctggacccagccgccgcggcgtcaacatccaacggcttggatggcattgactgcgccgcaaataacaacggcagcttggaacctccccttcgtgccgccacagcacacggcaatgtgttatgtggcggaacaccgttgccaaatgccgttgagggcggcaccgcaaacccaactcagcaatcggcaacgctgttcggcacaccgcaccacagaaggcaccaaaacaaacattttcgaaaaacgcaaaatttcgttaggtcaaaaagtttacgcgaacgaactggcgttgatcaacggctagagcggctgccaagcggtcctcagcttagacattcattgctcccgtggaccgtaaaagtgggcgcacaatccgaccggagcagaccagtgcaaattggcgattttgtcggtgggtcgaacaaattactattcatgaaaagggccaatatttttctttttactcttatttgc

SEQ ID NO: 33599 - DNA, 883 bp, Heterodera glycines
ttgacaaatggaggaccacccatacctggcgccttttttgacgttagcgccagaaatttttttttgtaaaatttagggtttttttgttgtcatcggaaaaaaattttctattatgtaaatttagcaaaattaaagtgcacagcagggatggcattccgagcccccaaaaattttcgaaaatcggaaatcgtaattacgaccccaaaaatgtcggaaatcggaattcccgtaccatccctggtgcacagggatttggcgaacactttccaagtcaaaaacctgagcccaaattttagggaaaaagcaaacatattttgcctaaagtcatccatttttcttcaaaatttttataataaatttcaagatcttcagcgattttttgaaaaattaaaaaaaaaaattagtatttcattataaaatttggaaaaaaaatcgctagaaaaatttttcaattttttccttgaaatttttgttataaaaaaattatataatttctttaaaaaaatattttttttttcggggtgactactcccatatgtaacaacagcatgggccaggtaaataatattccagaaatttatatttttttcaattttttacttaatgacgagcaaaagtcccgtggctgttgatggcgtcgtgccgcggcgttttgctttggccttgggaatatttctgggtccaaaatgggcttgaactcgttgttgtcgttggtgttgttgttgttgtcctcccattcttcggtgttgcccatttggtgctgattatgctcggcgttctcctcgcccggcggcttcaagaagaatgtgtaattgtcacggcggagcagccaaaaagtgcgcatttggcctttgccctgttaaaaaaaaggataaaataattt

SEQ ID NO: 33600 - DNA, 1331 bp, Heterodera glycines
  misc_feature (1309)..(1309): n is a, c, g, or t
ggaagaagacttgaaggccaacgaaaaactcaccaagttttacggcttcaacatcattggcatggacgactcttcaacgctaatcgaccgtgatgaagtgatgaaaaatttcaaggaaaacttgtcgttcgtcaacaacaaatatcaaatcgcattaccatggaacgacagcgaagcaccatcacgaggccgcgaagaggccgagtgagtaccttcggtgcaggaaaattattaaattttaaaaattttttaatttctttttatatatgccaaataatgtaggcttaccttttttagtgaaaattcgatcactcatattttttgatacattgagcagaagcgttccaaactttgcagggatactccccggtaaaggactcacttactctgaaatgagcaccgagctagctggctcaaaaaaattttcgaaaatctgagtctttcgtttttatttattttttgcaaaattaattcttaaatattttttcagaaagggttgtgaaacgctccagattttatttacatgttagtttaggcactctgatgctttttctatcaaaaagggagatgaataaaatttttaaaaatttttaattcctttttaaacatgccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccttgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtacccccaaacggacacttgaaaaaatcgattagtgttttcggggcagtccccccgagccgatgcgccctggaagatggggagaccgaatnccttccggaatagcttccctat

SEQ ID NO: 33601 - DNA, 727 bp, Heterodera glycines
cagtttttctcctttttcatttcttttgttgattataaatggtcaccttttgtcaatagcttttcgaaaagcgcacgcgaaaaaaggaaaagaaaaaggaacggacgaatcattgggactgaaaggggcggcgattggatggcaaagggaaagggcgcaattcgcccactcttttcgaccttttgacgtgtcaccagcgccgtcgtccgtttttggcacctcctctttgcccgttcaccaaaactttctccgctggccttggccaatgcttctgccacctttcgccgcccctccgtcgccattccctccccccccccaatttccccgccatatttttcaattccattcatcctttaccaacacacaatccgttgaaagcaaaagcactttcaggccaagcaatggatgttcttcagcccttccgccgatgtctctgcccaatcattgccaatataagcgggggatcaattaaccgacattccaacctaacctctcgccgcatcacctctcggagtaatctaaatgaagcaaaaagttatccaaaaatatatcaattctacacatgcaaaaaaacaatcactaggggagtaaaaacgtatcgatctcgagtcttgacaatcgagtctcgagacttaaaaacccgagaccgagactcgagaccgagaccaaaaaaacccgagacttttctcgagtcgagactcgagaccgagagtctcgaacagcacta

SEQ ID NO: 33602 - DNA, 1327 bp, Heterodera glycines
atttagtcctgtactgggggagtatccctgcaaaaattggtggggttctgatcgcttttccaaaaattacttggaataaatttttactaaaattataagcctaaaaaataaggttaattattttaaatattttttcaaaaaatcgcccatttccggcactatgccaattttgggcgggacagacctaacggggagatataaagtatagggaatatcaaatctattcccgaaggattcatcctcccaaaactgtctgactgttcgaaaaattttttttaaattaagcctaaaaaatttgtctaatgattttaaatattttttcaaaaaatcgcccttataaattgcattggatattttcaagacaatttagtcctgtactggggagtatccctgcaaaaattggtggggttctgatcgcttttccaaaaattacttggaataaatttttactaaaattataagcctaaaaaataaggttaattattttgaatattttttcaaaaaatcgcccatttccggcactatgccaattttgggcgggacagacctaacggggagatataaagtatagggaatatcaaatctattcccgaaggattcatcctcccaaaactgtctgactgttcgaaaaattttttttaaattaagcctaaaaaatttgtctaatgattttaaatattttttcaaaaaatcgcccttataaattgcattggatattttcaagacaatttagtcctgtactggggagtatccctgcaaaaattggtggggttctgatcgcttttccaaaaattacttggaattaaattttactaaaattataagcctaaaaaataaggttttattttaaatattttttcaaaaaatcgcggctaaataaccattgacatggtgggcataatataaaaacccttttctacagccaaaatttctgtccacttgatatgctcagaaaagcacgaaagttaaaattaaatttcatgtttttgggtttatttgactagttttatggctgttcgagaatttttgtgcctttataatgcctattttttctgactctgatgcatatcatttgtcatttttgtgcctaaaaatgccattcctaatagaaatgtttaaatttgatataatttatttttttaaatttccatttacacatagtgatgctagaaggaagcgggatgtgggagaaagtgggataaggaaatgggaaaacctcaaaaaggagagcctgtagcctcactcagtcggttagagcattccacagtcagggaaagtcagttccgtcccagccaagtttagagcaacgtaacttttacattgttga

SEQ ID NO: 33603 - DNA, 1018 bp, Heterodera glycines
  misc_feature (11)..(11): n is a, c, g, or t
tttcagagcancgttctaaaaaatatttatgaattaattttgctaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgcaaataaaaatttggtgcgtttcaaagcagtttctgaaaaaaatatttatg

SEQ ID NO: 33604 - DNA, 836 bp, Heterodera glycines
  misc_feature (14)..(14): n is a, c, g, or t
attgttttcaatantttggccaatgatcaaagacaacattcactaaatttggttatggccaaatgacctccgaaaaatgcgtcaattcgccccgtccattctctccgattgtccatctcttcgctatttttttgtagaatttttccccgcctttccgcctgacgaaagtgccaatgcatcggctggccaagctttggcaaaatggcttttggcccctcgtccggacggtttgcccaaggtgctcaaatactgtcaatgttttaatgtggaacaatcttcaccaataaccgatggaatgaaagcggtgctgatgacaagccaaattattaaaataattttttacattttcagccctttctcggcgcttcatcctctgttaacttcatcgttaccttttgcagttacgataaaccgtttgctgcttttcccattccctatgaattgaccaacggattcactggggagcgattgtcattgatcaaagataatagccaaaatcggtatctgctgatccgttgtccaatttcacgtgatgagaccaaatggacgaaatgggaacaggaggtcatctttaaaaaacataaagctcagcggaacaacattttcattcaattgggtgatggcgacatcggcgatgagtgagaaattaataattcgagtgcataattcattttttatttaatttgtgattttcgtcttctcgatgatggaactcccggcccaagtgatcagcagcagaacagaattgtggagaatgaccgatcaacgtcgtgatattggcacttgaaaattattgagacgagactatttgacataatttttgttaattttatttt

SEQ ID NO: 33605 - DNA, 1271 bp, Heterodera glycines
  misc_feature (1264)..(1264): n is a, c, g, or t
tccccgtatcgagttggctccggaccagcaggtcctccgaactctttttgtttgtctctattcttcatatttccatcttcataattcccgtctcgtgcgagtgagttactgctcttctgttgaccttcattgttggactcattatcagcgggaggctttgtcgacatggttcgaacattcggcgcaaaaatccggcaattaattggcacaaagagatgagcgaatgaagataattgacgacccgaagaaaccaaaaacaaatcaaatggagaatacattaagttttcacctaaattttattttgtatataaattaattatttctgttaatcctttctttactcgctgtacataagtgtcagcttattgttagcccaaacacgtacagattaaagttaggtaattaaaaagatttgaattatttttcatggcattatgtttttggataattggcatttagatcaacctaaccaacaagaactaaagatcgattcatcaatcaaataacttttgatttcgtttaatgtggtcatttacattcatacatccaagcccgtagttagtggtgaatgaaagggcgggtggggttaggattgggtccattttgaaaatttctatcaatttattaaaaaatttaattgcaaatattcatttagatttaagcattttctaatttaattaacggtttgccaacctctgcacattcttcgttacaacttccgagattaatggcgtcgcacaccgccggcatccaacaacttcttgcagccgaaaaacgagctgctgaaaaggtttgacttgatgttgatttttcaaatatatttatttttattttgcagattaatgacgctcggaagcgaaaagcacagcggctcaaacaagccaaacaagaagcacaggcggagatcgaccaataccgacatgtgagtgtaaaaacagaaaaggaaagtcttgaattgttaattgtaagcagttgtaatggatctattacagttaatgagtccaatcgctttttattttatgaatccaatcaaataacaaaatgctttctttctcggaacataactttctcataaattttaatttcattcgaaatattacctagtcaacaagcaaataaacgaaaagtcatcatctaaaaaatttataataccgacgaaataaatttttacgtattgttaatcaacaaattttttggtaattgcctagcgccgagcacttttcactcaaattctttagatttatgctttagagtgataccacanaatatag

SEQ ID NO: 33606 - DNA, 719 bp, Heterodera glycines
ctgttcgagatccttcttcttcagagttgcaagactcggtggggccatagaggcacgggctgaaaaaacaaaacaaaattaaacaaatcccctataaatccagtccatccctcccccgtccattccctctctccctttccatgtttattcttcctttaccttgctgccaatcttcccgcatcgccgacagccgcatttttggcacttgtctcagttcctttgaaagcggtggtggcaatttaagcagtttttgcacacgtgccgaacggaaaagcaacgcaaaggcgagagtaatggtgttgctggtgcaccaatagagacaaactgcctaattaatgacagaggataagccatgggaagggattatgaaaaggcaccgatgtgaattggttggcggagaccaaaatgagcaacggaaaaccgaaaagcatagcgtactttaccatcttcggcatttgtaacagactgcccgtctcaatgccggcctaaagacaaaactcaagtgagtgggactccaaaatccgcaatccttggaaagtcagatttaaaagtacaaaaaatgtacgttaatttaaatgaaaatttgacctattccacaaattccgttaaaatttctaatcccaatttcagcccccccaacaatgtctaatggcttaattagtcaatttccgattactctgaacacaaaatgaagcgacgtggcggcaaagagtggcaaa

SEQ ID NO: 33607 - DNA, 655 bp, Heterodera glycines
ttgttgttgcggttgttgttgctgttcgggttgttggggctcaggcagcggccgcgcttccagatcattaacatttaacgagatattaaaaagattttcgcttgggggcatttgcaaaagttgaatgatttagaagcacaaggggaggcacttttatagccaggaccttacagagcgatttgatatagagtgctcaaaaaatcattaaaaaataataaacatagcaaagggcggggtcaattgattgcgtcaccataaagggggcggagtcagttgattacgtcatgctaaagggggcggagtcagttgattgcgtcataataagggggcggagtcagttgatgacgtcatgagataggggggggggtcagttaatgacgtcatgaggtggagacagttgattgcgtcatgctaaaggggggggggggggtcagttgactgcgttatgctaagggggcggagtcagttgattgcatcatgataaagggggcggagtcagttgtttgcatcatgataaagggggcggagtcagttgattacgtcatgctaaagggggcggagtcagttgattgcgtcatcataataagggggcggagtcagttgattgcgtcatgataaaggggcggagtcagcgtgtgaggcacggcacccgcat

SEQ ID NO: 33608 - DNA, 1402 bp, Heterodera glycines
attttcaggcttccccctaaccttttaaaatttttcttttttaatgatttatttcgctgattttgagaaaaaaatccttaaatgaatctttttaagtaaaaaatttacataaaaatgttaccaaaacttccaattttcaaaaaaaaagaggtgggggggggtcatattgaagggtagaagagagaaatttctgaaaaataaatttagctgatttcttaacaaaaacgttaaaaattctttaaaaaatttcccccgcggcgcctatcggcaccgccggacccaaaaaatttctcttaaaaattagcccaaaattgcaaatttatattgctcatttggcccccttttcagtcctatttgcgccaaaagtcccattcatcgccagcaatcaacagaaattgttcgacaaaatcggttgccggcggcaatttgtgaagaatttgtggcaaaaatcgcgcccaatgtccaattgatttgattcatttgttacaaagtgtttatgttgagaaaatgtgtaagaaaatgccaaaatactggtcatgtttaattgtaatattattccatgttatatgtttttttatgtatgttgtagatcggacttttattgtatatatatacataattttacgcatattcccattttcgaaaatgttaaatatttgttaggaaagcatcgaaattttttggaaaaaaagaaagaaaaaaattaccatagaaccgaatttagcgatgggagcaacggtatttcgagcagttataaaaattccctgaacactttgttaaatttgtaagttaaaatttaatattttattaggaaaattaacagcctttttttgtaaaagaaaaatatttccaattcgctgaaaaaattaaattaaaaaaaaaattatgtatctatttcagttctcgtcatgtctcacaaatgacgtcgggcgctactgtaaaagtgacagtttttgaaaattttttcactttttttggtaatttttttttgtttatttacacataatgatgtatattaagcattattgtcatattcttgatcagcgacctctaaaacccccgggtatttggtttcatgactttttaaacaaaaaaaaatttaccaaaaaagtgaaaaaattttcaaaaactcacttttacacacaccatcccaaaaaacgagatgtgtaccaataaatagagaatgccagagaaaaacattatctttttttctctaattttttgtctccttttggcgtactatctaatattttcattattaggaaaaacaacattcacttcgtgatgtttaactttttttctgcatgttcaatctataccaaattttgcatatcgatagagaaaagaattctgcatctttctatagtgaatttaattttgtctatggacaaactcaaaagtt

SEQ ID NO: 33609 - DNA, 597 bp, Heterodera glycines
tttattaataataatatttgttttccagatcaaaatgcctatgtcaacatactatatgaatgtcgtgaacgacatcatagcgtcctgggttgcactccatggacgaaaaaattgaattcgacgccaagcaggcccatttcaagcgaaaacttgggccgctgcgttatggcaaccggatcccgaaggccgaaaaggcccactacacaccggaacagcgagaggccgaccgctggttgtccaaccacgcttggccgcccccagcgcccttcaagggcattcttttccccgccaagagtaagtgctttaaaatttttagtctgggactggaacaaggcttttaagactgtaatttctgtacatttacatgggtacccatataaatgtacattaagtattgctttttatgtaatgtttgatttttagtctggcactggaaaaagggggccgctgcatatgcttcgcactggcgagacgagttcttggggtccaaaaacccggacgtcaaggcagctgcggacgccgctgccaagggcgactttctcaaactcggcatcaacgagtacgtgcgacttgacgtgcgcgagctcacggagttga

SEQ ID NO: 33610 - DNA, 1163 bp, Heterodera glycines
cccacttttccgtctctccgccgccggcgtcgatccaatcgatggaattttccttttcctttccctcccaaaaggcgtgaacaatgggctgaaaagtccatctttcttctcttccacaacaaatactccttttaatccgtttgtctctcttcccttttcctttctccgctgcttttccccacatttttggggagggaaaaaatgccttcgaagggacacagaaacttttattttgaatttaacaaattaaccataatgcgtttctctgcgacacataaaaagggctcaaatgactaattgttcaataataacacacgaaatgaataaatgacattcacatttacagtaacacctttttggccagggggaaatttcacttcgcgaaatcattattcaaatcgttcttttaattttgtccaacatttatttgttctgtccatgtcgtacaataatacaaataataataatacagtacatataggcgaatgtgataagatatgaaactttgttatgaattgtccaatcaacaacaacagatgaaaagagtggtgggaatggatgaaacgatacaacaaaatttccttaattcttcgtcgccctttttcagctcatcgcacaaaactcggacggatcagtcagtaccggtcctgcaatttatacaaatcattttgtgattttaagtagcaaaatggacagaatgccctcaacaaacccaccggactttttcgaatttccaccaacttcatcaagaaaagagcattccccccccgccactcttttttagtgttatttcactaattctggtggaaagacaaaaaagtcggaaaaagaaaaacgaaaaaagcgaacaaaagagggaaagaaagaaaggaaagaagcaaaagaacaaagaaagccttgaaaatcaaaagcttacatctcaactttttgctggggtcttctaaaacaatgtgtaataattgaggggttaatataaaaactttcattggttaaacggaatttggtgctgaaatcacttaccgaaagatatgagctaacagagctggaaagtccggacaatttttccgtcattttgctcacaccctgagggagaagaaaaacttatcgaaggattattataaattagccaacctgacaagtttctatcatgcgacctccccccc

SEQ ID NO: 33611 - DNA, 727 bp, Heterodera glycines
gattcccgaagattccgtcggcccgccgcggtggcagtctgaattcaacgaaatactcagtgagtgggcaatgagtgattggacactctgatcagtggtgtctgatcggcgagataataagggaagggggggggagtctcgagactgggatttaagctctatctcgagactgtcaaaaaagcggtggaatttccgtaatcgagattcagtctgatccagctcagagtcaatataactcttgaagttattgactgaatcaaacaatcttgatatcgttcgaaagctcttcacaggctctattagcctactaaaaattacagaaaatttcgaactataaaaaaagagaaataaaaaactttgaaaattctgccttttttgcggttttaaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccggaaattttgcgcttctaactttttaaaaaaatgaattacagtcaaaatggacaattcagtaccgatgggaattaaacacaagaataaactatttaaaaaaattaatatttcaataaagtagttgttcagtcaagggtctgtaatttttgtttttttaaattaat

SEQ ID NO: 33612 - DNA, 712 bp, Heterodera glycines
atggaatttttaattcattatttaaattaaaaaatttagcattgccttattaaatcatttttttgagtccacactttaattcctttttttatgactttcagctcattttatttaagtcaaaatgaaaaattagctttgtttaaggtaccctttaaataactttctctcgtaaatgttcttaattcgcaaattccctgaattgctttacgtcgctatggaatttaaatttcccaaattaataattatttcattttcactaaaattattcataaagaattaatatttttttcccgacgacccatcacttagcctttaaaaatatgaaacggtttggcattgtttaactttgtcgtgccattctttcctccccgtgcccacattttccccctactcctctcattattggctttttctatccccacttttggcatatgtgccgtctgtgtgtgctcccaaattggcaccaccgccgaattatgcttttcctctttgcttttgccccaattttttatttccctttgccctcccccccccccctctcaatgcttttcctctcccccctttttggcattgtttgtccttatttgcccccgagggtctttcgcttcaccgggcggcgccctcccttttttctcccgcttttttggcagaatccaaatttcccaagagcaccttctcattttggagaataaaaattctcttctaaaaggct

SEQ ID NO: 33613 - DNA, 685 bp, Heterodera glycines
tctattattataattcgataatttaaaaaaaatatataaattaattttttaaattttgattaaaagttgaaaaaacagtgttctcaagttgtccatattcaatggcctttcaattgaacagggtaattttgaaaatttttttaatatttgcaattctttttttttggcttttgaatcctgattcccaaaacttttgaaagtctcggaatcccaatcgcgaaatccgatcccgattttttaaaaaattttctaggttacatatctttgcttctaatgatagcaattatttttttgttttgttttaaataaacattttatgcttatttttttgctgaattaactaattgattcattcatttattatattaatttattatttattttacttttcaatttccgcccccggcgcattcgtcgccgtcgttaaataccccgacccctaatgagacattattggtcaactaatcgccgtcacatctttctcatgagaatggatcgtgattatcatcatcatttactttaactaacagttgcgtttttttaccatttgtatcattaatttctccatactatataaacgaaaaaaaaagtggcagaacgtcctcattctgctgaagcggcgtatataaatgagcaatttcgacataatgatcatttaatgatgacaattagtaacagctgctgc

SEQ ID NO: 33614 - DNA, 428 bp, Heterodera glycines
tagcattgttttcacccagagaaattattcatttgtttctgtaaatgtgtataaaaagcgtaattttcgtttcattttttcattcaaatttttgcatattttcttcagattaagctttaccattacacttttcgaaaattaaaaattaacgttcgttaatttagtgaacccattaaaaaaagtagcaattgttttcacagattttaagttgaaaaaacattcaaaaattgttagaacattaattttcacatataaaatgcttccaacctaagctaactaaaatccatcccaaattgttttaatatttgcctcattatggggttttcggggttgctgatcacgaatatgacattcatttcgaacaattccctacccgaaatggaagaacagttgagaattaaattttgcgaattatcggggccccgtct

SEQ ID NO: 33615 - DNA, 675 bp, Heterodera glycines
aggcaattgagagagagcgggacaaaacgtcgcagcttacaaaaaataaatgcaaatgtttactgttggacatttccaataataaaaaaataattgacaatggccaacccttttaaaattgacaaaataaatgactcacgtggtgatattggaaaagacgtagtaattgagcttatcggcaagattgaacggagttttgtcatttccgaatgaaacattcaatgcggccacaaggaaaatgacaatggccaacgaacggatattggccgggaaaatcccagcgaagaaatcattctggaaaacacgaaagttaatgaaatacaagaaaaatacaaaagtaaatatcaaaaataaaagcaaacctcgaattttgcgatgcgttttttataactgcgtgaaaacgcgtgccaaatgtcccgcagaacttcctggtcataagagacggaaatgccatcgtgtgttacggtgaagcttaaggcagcaatatttctggcctcagccattctaaaaaaattgtaagacgatggaaccaactgtcgtatttttttaaagaattatgtatctaacaaataataaataaaagatagaatttatgtgaaatacgcacaaaacttagtgtgggggagggggtaaaaaatcgtttactttttgtgtaatatatagagactgttgttg

SEQ ID NO: 33616 - DNA, 849 bp, Heterodera glycines
gggctctaccaattacatttgtttttatttcttggtttaaaactatcaatcacaaatacataaagtaaatggcacggaattccgactttcgaaaattgttggggcctcggaatgccatccctggtatgcattcttgggtcattcagattaacgaagtaaatccgatgcagagctgcacgtaattacggattacgggtttttggagttacgggttatagatttttgggatgtttccgtaattttgacccgtaactgaaactttggattatttttcgagacgatttcttgtaagattatttttttttacaaaaacaaattttctattttcattgaaaggttacccgtgttgatttcgtctgacttacttggtaatttgttgtattaataactagagaccggacttttaggcacgaaaatttctcaaataggcacctaaaaaaggcaccaaaaatgtgaaaaaaggcataaaaaaatacaaaaatggcaaaaaaggcacgaaaaaatggaaaaaggcaccaaatattcaacattttctagcaaaaaatttaccaagagaccttttttttttttttgctcttctggtcaaatttttttttcttctatgttatatcaacaattcaatttcataaccggagagaaaatttttagctccgaaaaaatgacaattttttgggggtcccggcggtgccgataggcgctgccggaaaaaaaattttggaaattgtaagaatatgataagaaaaattgcaaaaaatttcccatttttttccaaaaatcctgaaaaaggcatgaaaaaaggcaccaaaaagttcaagctagaagcttcaaaccaagttaaaaactcgtttt

SEQ ID NO: 33617 - DNA, 539 bp, Heterodera glycines
attaatcggtcgatcaaaatttgaaatttacagtccgaagacaacgccaaagaatcggcgccaccggcggatcaaagcaatgggattaaaatggaaaatgacaacagcagcagcagagaagaaaacggcggggacgaagtcggggacggggaggaggaggacaacttcggggagacactgggccaaattttcatgctgaggtcattgggaaacaaaaatggaatggcaaagacaacaaacagtatatccgacattttacagtaagcaaatcgctgagaatggcgtcggatgcgcacccgcaaaaaacaatagcaaaagtcaccaaaatgccattgggacggaacaacaaatgacggaaaagtcggcacaattagctttttgtaataactaataatttaattgcagcgatttgccaattcgatttctgctgaacgaatggatgctgaagggagggccgagcatgatgacaaatggcgaagggacagccgaagcgaacgcagcgaacaacgcaattggcatgggcaccgacggcaatgctt

SEQ ID NO: 33618 - DNA, 941 bp, Heterodera glycines
  misc_feature (15)..(16): n is a, c, g, or t
ttttgatttacccannttttaggtgccaacaacaacaccaacaactccaacaacggtaagaaagagtttttcttacaaatgttgttctattgaattgattatccctttttactcaagacgctggaacctgaacgcctcatggtaaagatttgcaatgaggtggcggaggcatgctcatgcggttgggcaaagtgcgtcaagtccgaagggaccaaaggaggcttctgctgtttggcgggacatgttcacaaatgttgtgcggatcctgagaacaagtaccaaatggtgaagcgggatacggtaattgtaacacattttcagatttaatcttttctgaattttgaaggaagatttggtgaacgagctccgaaagaaggacgaatgtgccagtaaaaatacaacgtgtgtttgtggtggccattcgggcctttactcgagcgctggtctaaaattcatgtgctgcgacacgtcgtcatcgtgtcactgttgtgaaatggttggaatgaatttgaattcattatttttcttagtgagaataatatttttaaacctcaattagttttaatcgaatcaaaataaatgaaaaataaagtgttttgcgttcaggattggcccctgcaccagacaaagcctgatgtgacaattaccaaaaattaattttagataaatgcgcttttcccttatttctaagtttgaactgcctgttgcgagaacatctgagtgtaatgctacgattgatcgcttatactacgatgtaaaaattaccgaaggtcaaccggcctgcattttggaacgacaaccatcacggcagcgactgctgtccagaaaattaccgcctaattaagcgtatgttgaaaaatagaaatacaacacaagccatctttaaatcgtaaaagatttttatccctgtattgtgggacgagccctgcagggatattttt

SEQ ID NO: 33619 - DNA, 912 bp, Heterodera glycines
tttatatacaatagaatttaataataaaacaaattaatataaaattataaccactttccatttcagtttctcgttcaacatcttatcgttaccgttgattttctgaggaaaacctttgatgtatctttttttaaatttatctattctttctttatcttgttttctatcattttttgccttttttcgcataaaaaacatttagaaaaattttttatttcttataaaaaaattaaaattttaaatgaaatatttgttataatatttcaaatattgcgaaataaatgcttttagtaataggttataaaaatttaaataatttttaatgattgataattaacacattgacctagggtaaggtttaaaataatatttttttaataaagtttcccaattttaattaaaatatgttttccttttccaattgcttttggcgcactaataaaatccaaaatatgaaaaaaaaaatttcattttcactgtgttttccgtgaaaaatttcacttgataaaattgaagatttatgtatgttgttttagaaaaaaaaaattgaaatttttactttttgtataaaattttcgtaaattttattcgatgcgacgaaaccttaaatcagggcttttatctgttctaatatatcagaaaagttcctattctagctattcaaattttgcataaaatttgaatttttgtgtcataatgttaatattttatctagaatttttaaaatttgacgcaaaacttggtaatttttgaacaaaaacagctaaaaaatttgaaaattaacggtcacggtcacgataaccgtgaatttcacagattttcaaattaagcattcttggcattggtcaaatagctttaatgggttttttattattctttctccaatttcaaaattttattaattttcacaag

SEQ ID NO: 33620 - DNA, 705 bp, Heterodera glycines
aaatattgatcatatggcccagaacccaaaatggtcaaaatatatgccaaccgatagctctccgtctgtaatgaaagaatccgaaagaatttttttgcgaaaaccagtccctgaagagttacagacccgggactgaaatggccaaatgactttgggactgaatcgtccactgacttaaaatgcatggaattgcggcaaaatacttatcaatcgattcctcatcgtctgttaatcaagaatccaaaggaatttttagataaaaaagaaattaacaaaagttattggtcctcaaacccggttcagtcaaaaaataacaaaaattcgtcaaattttttgcttattgcgctaaaaaccgccgcacactcgactacggcggccagtaggtggggcgagactacggctagagaccagaaatttcaaatttgcgggtcctgttgcaggattggaattcaaaatctgtattaataaaaaagtctttcaaagtataaaaaagtattaaaatatatttttaaaccaaaaaatgatgaagatgaaaaattaataacgttttttttgcttacactccaagcaatcgactgaatcttctttaatgcatttaaaaagaccgatttgccaaattgggtggctcataataatagcttaaattaaagtaaataatttttatttaaatttctttacaaaaaagccataatacattatgtatag

SEQ ID NO: 33621 - DNA, 958 bp, Heterodera glycines
  misc_feature (935)..(935): n is a, c, g, or t
aattatttattaccatggcagattcattgaaaaatgaattaaaattatttaaattatcagaattttcgaaaaaattttggacaatttttttttaaattatttaattatttaaattttttattttttatttttagacattgacacatgaaattggccatttgttgggcttggaacattcatctgatccgagggctgtgatgtatccaagaaaaaaggagcaccagccgggctttgaactgtccgacgacgatgttagggctatacgatttttgtacaattaataaaattcaatatttaaataaataattcattattacatatttttgtggataacggaaaatccacacatacttatttttactgatttcctttttattcatctttttcagaataattatttttgaattgatcaccaaaattcgactaaaagtgatcagaatcacaccaaatttttaaaggattacaatgggacaatgaaaagctgaaaacaataaattgtgcaatgattgcggttttgaatttattattttgaatttttttttttttttgccaatttttgcaaaatttaattccccataagtttttaaaagtgataggaagtgcaccaaattttaaagcgataatagttatatttttgaatttttattaaatcattttgaattttttgggtttacgattttttaaatttatttccctcattaatcttctaaaaagattagaagaatatcaaactaaaattaagcacatattttctctgaatttactttataaatgaaagcaaaattaaaatttattaaattgtcaatgattttaaacatttgaataaagtgtctttaggaccgattttttgaatttcggttccaatttttctcatttttcaattttggggctgccatttttccgtgtcccattttcccgcatattttgatgacaantttacctaattgccccacatttc

SEQ ID NO: 33622 - DNA, 654 bp, Heterodera glycines
gaaaggaaaaagcgcaaaggcaaaatgaagaagcgaacaacgaagtcccaaggtcgagaaggggggagatatggtcgagataagggaagtcatcggggggggggggagaagggatgagcagtttttgatgggcaaatggggcgggggacaaagacagcgagcggagcagacattcactcactcactgatccatcatcggcacaaacaaacatcacacacaccgaccaatcccttttcgggacactccgcccaactttggatctctccccgtcgatctcgacaacgcattgacgaggccgaggaggagaaaaagagtcaaattaagacaaagagagagaacgattaagggagacggaaatgaaaacgaagcaaaaggccgagggaaaaggaaaaggggagggaatcggaattagcagaataaaagggagagaccgacgccaataagggcagacgcaacaaattttggaaaatttatcttttctttgagaaataccaaaattcgcatgaaaaataacaaagaaaagaagaaaaaaaaaacagaataaattagcaaaaacgaaactttgaactcaataagggtgagagaaaggaatgaaataaagaaagtaaacaaaacaaaacctaaagggaataatagccagccaccaaaagggg

SEQ ID NO: 33623 - DNA, 1019 bp, Heterodera glycines
actgatgtgattttattttttctatttttgtaacttaatttttttaggaaattgatttacaaattgacgtaagagactgcagtggttcaagttcggctggggatattttttctcgttttgaaaaggatgcagaatttgagcaaatactgaatactgtaaataaactttatatacccctcataataattaatttaaggcaacatcccccagtccatctgccttggagacaagacaaaaagccgaagttgaagtaaatgaatatttgcgggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgatatttgaatgatttttgttttaatgcgactaaaaattttttaaattacggattacagattgcggattacgggaaattacggggtttttggacccccgtaattacggattacggatttccgtaactgagaaattcgccgcaattacggattacggatttccgtaattgcaaacccagttgcgtgcagccctgtttccgactgtccatataataaatctatctacaaattatttagaaaaaaaatatataaaaaattttgaataaaataaaaagcatgttttttacggcggattttcttgtgaattaataaacattttataattaaattttaaaatcattcaccagtgcctccttgttaaataatcgtaaccggagctttggtcttaaattttattaatcctcattgaaacgcagaaaatcttcaaaaaatgtatggacacgctaaagtacataaagcatgcccaaaatataaatatggccgaacctaaaaaaatttaggcgaa

SEQ ID NO: 33624 - DNA, 682 bp, Heterodera glycines
cacattctattttagaagatagtttcaaattaccttgtcataccaaacggacaaaagatcccatttttaaatatttttgtataatcgcgatcatttatttgaaaatttccaaattcagtctcaaaattcatctctcttttcatcattcatttctcattcaattgctcatactaattactcccctatttgctgagaaatgagaaaaggataaataataaattgaattatataactaaaatgttgtattatattgatgatatgatgagtaaatttggtaaataattgattcaataatttatccaggcaatataattaataattacaaaattcattgcgaaaaatatttttttaataaaaataattcatttaacacaagagtgatgactaatgaatggttaaaaagattaattaaaagattttgaataccatttttaaaaaaatttaaccagttaatccgttacacttttttctaaacaaattattgatagctattagatataatataatttttattctaattgatgcatgatattatgatataatgactaaatgtggttaataataattgattgtacaatttatccatgtaaaaaatgaataattaccaaatttatttgcgaaaatatttccataaattaaatctttactttttatctttacaaaaaacatggaactgttttta

SEQ ID NO: 33625 - DNA, 918 bp, Heterodera glycines
  misc_feature (809)..(809): n is a, c, g, or t
  misc_feature (844)..(844): n is a, c, g, or t
cttactgcttttctttccccctccctttgcccctttcctctttccttcccctctcacctctttgcccccttcccactctcccctttcccccctacccctccgtcctcttcttctcttccccctcctcccttactgcttttcctccgcccccttgtgaagccgttcattttgcgttctcacaaaagccccaaaaacgcactcactttttcttttttctctccgtcttctctttgtctccattagcaacaaagatttttgtattggaatttacccgtagacaagttaccacacgcatgaccttctgttgacgagcattgaggaggaacagcttacttcagaggtattcgtttattcaaactgttacaagggagtgacaaatcgggaaaatgaaatttaaaaggctttgccttatatttttgataataacttttaaaaatgttttgtttgtttgaggaacgagaggaggcttggaaggagtacgagagcgaaagactgtctcgccaacttttgccattgccatcctcatttgaccatggatggcactgccgcagttcctggtacgtctcagcagccgtctttcggcacgtccaccgacatggcgcacttctccaacgcattgcaactgcgacaacttcgactgtatgcaggccaagaccgcctacagaatcttccagatcaagcagttcctcagctatttcatcaacctgatccctgcagaggaccttggcgagatgaacagcgcaaatgcatttgccaattatttcaacggaattttgcaggtgaccaccaatcatacattaaaaaggcgnggaagtcaaacaaattttttgtgaaagagtctggngtggtcaattttgcgaagggacaccggccgtggaattttccaataagaattttagagtttttcttgaaattttt

SEQ ID NO: 33626 - DNA, 1003 bp, Heterodera glycines
  misc_feature (16)..(16): n is a, c, g, or t
aaggacggccaaacantttgaagaagtgcactttcttccgctccattaatcgtgcaaaatcggaaatgggaacaaaagatcgtcatcattgtcacaatcattatctgccagatcgtcagcattatcactatcttatcttctttatcactccttttgctcattgtttcaaaatgtttgggtcggaaggcttttctgcgtggattcgaatcttttttcgagaaatctttcggcccaaactccgtttcaatgccttccccccccctctctctcccccccaataaatttacgtccttttgccatctctaaccatatatttttgtaaatccttccatgaaaagttttttctctcttcgcttagttttgtgcctttgtctctctctccctctcccactctctctttgtatgtgtgtctctagtctcgtctttctcgccatttaaccaatttctaagcaatcatttttattagacaatttttgctcaaatggctgttacattaaacacatacaatacttgtgtatacattttgtacatacatatggcatatattgtaaatgtgtacaaaacaatgactagaaaaataagtgatgggcgggagaaggaggagggaaattaatgccattaaaggcactcaagaaatgatggagttcatgacacaattagaagcttttttctgttatgccgtctaccatcgcttttcctctgtcgtgcaaaatgcttgtgccattgccaaatttgtgcaatgtgtggccaatgaatcgccgtagcgggcgcccatcgccggcggcgattgtgccgaaagtgcggcggctgagagacccccgccgggcacggccaacgacgcccacacgcttttctcttgcgactgttgctgataggccacctttgggcggggaattccattttttggcttttttccgctaattgcatcacaaatcaatcctatcctctgacctttgactcattttccgtctgttttcaaaataaatcccaaatgttgcgatgg

SEQ ID NO: 33627 - DNA, 1244 bp, Heterodera glycines
ttatttttgataaaatttcgcaataattaattattttctttattattattattattattatttgtacttatacttttaacaattgcttctcctcatttcgttttataatttcttctcaatcatcaatcagtgcttgctttttacactgattgtgctttctttaagccaagaaatcctcgaatttttcgttatttgtccattattacacaccccaaccccactaattgcgtcattaaatcggtttgtttttggctcatactaaaattgagaatttatatttccgtgtttgtttgtattattatagaaatatccatttaaataagtttttaggtattgaaagtaaaaataaatttttctttaaaacataagaatctaagtcaatataatagaatttttaagttataaaattcattttcatcaatttaattaaattttttctttaattcaattaatttgatttattaataaattaattcgctaataatattaattcatcataaaatttatcaaaataataatttaataataaatatttaaaatttttgagtttctattttcatattaattattatttattaattaataaatactattaaaaccaaaactatttttggggttttattttaatgaataataaattcatttttttaataaaaatttgataacgctaaataccctttttttaaaaagcacttaacgcgaattgaacacctgctttgtgggcccaggaaaatcccctctcccccccccccccgcccaatttgtgtgcaaattcattttccatttatggccaattttttgtttactcttaattatcatgagtggaaattcccaattggcaatttgttcaaacaaaaaaagaatttattgaattttaacatttctctaattccacggcttttttaatttaatttttttttattaactttttggcctgactttagtttaaagacagattaatttggattggatctcaaggacatagtaaatttaaagacagacattaagggattaagctgcgcctcaaggacagaaattcaaagaatttaaggacattaaaaatatttaatttacttaaaatttctttaactatttttttcttttttccgttttagtaattccggaaattttttcattttatttattcatttatcctcccaatttcctaagaacataaatttgaatttgcgtaaaggtggtttatgcttgccggcatgttcttgcgtcaaaatatgactctagag

SEQ ID NO: 33628 - DNA, 939 bp, Heterodera glycines
tggtcattgaaaaagtgaacaaagtttaataaacacacattaatccgttcttatgttcaaattatggataatgatgcttcttttactcgagacacctttttcacaaagcgaccataagggattcatttgcactttcaatttgatattttaaagcatttttatttaattgtttaaatacagtttcattctttttattattaaatcggttttttatacaattaaccacttcgactgaacaaaactgtcattggtcacttttgccgtcactttttgacaacgatcgtccacaaaaatattaattaagcccgacaaatagccgctcctagcgactgctgccgccgatcaattaacactttacacatttccaacccaaactttgcccatttccttttttatttgcccatttatttcccttttctctgatcgctttaataaatttattcttttgactgaaaattatatgtaggaaaaaaccttaaccttaataaaacaaacagaaaatgaataattattaattaattttgtgcatagaaaaaagttaatttgctgacaaattgaatcaaaatgtgtaaaaagcggaggaaagtcaaaatatttgttattttcgttatcagagatcaaattgtaaatgatagaattattatcaccagcagaaagggcagcactttaagtattctgataaaaagaaacaaatcactttcccaatcactcgaaagaatgcgaatttaaactaaaatgattttgctcaaaaatgaattttatttttattaaattaatttgtaatttaattattttgattttttgttgtcttttgccgacacattacgccaaacacataaatgactataatgtttaaacattggcatttggaatgccccgggcacaattatattcattttcagtattcttcaagaaaaaattttgaatcaattcttcatt

SEQ ID NO: 33629 - DNA, 1050 bp, Heterodera glycines
ccaggcaagcgggccgaacgacgaacgggacggacgacggaggagagggaaggggagggcatatcggatgtaacgaatggataatacgtagaaaagaggctaaacgagcgatttttgctgtgtgcaaagtttgttcaagcgctaaagaaaagagagccctcgaaagagcggaaagataaaaaagacaagggggaggatgacgacagataaaggactaaaagacaatgacgaagaaatggggtgacggatagggaaaggttgaaggggaatctcggaatctcccccttccccggcaacccccataattcgtctctctgccccttcgaaggggaaactgaataatcgttggacattagttaattattttacatatcccagccagttgttgttaaaatgaaaacggaaaagcatttccgtagggattataatacaatatctaatagagaatgaaaatggcaaaataacttttctgatggttatgaatttgaaaaggtaaccaaatgggaaattcgaagtctgagacagacatcttccgatgcaataatataagtggggaatagcggtagtgagcctaaagacactgggactgacagaagaaatgccaatgccaataaacataaccaaaggtagcaaaaaaggcggatctcaaaatcaataagtcaaaagtgaaggaggaaaggaatgggattcttcttttcatagagtgtattctcatccttaattcagagtacggaattttgcgtttgtttgcctttgggtggcaaaactttgagaaagaatttttaaaaaattcgaatttcaacgcactgaaataacaaagagacgggaggctaagtcagaaagcgatccgaattcctctaaaacttttctattctcattgtcagttaaataaacacgagagaaagggggtggattgacgtgaagaagaaaagcggcagcatttgcagcagaaacaagcccagccgacgtaaatgtaaggcacggaaagggaagacggactggcgcccccgcacggcactccctccggcaatattttattgcgctgccgtg

SEQ ID NO: 33630 - DNA, 1002 bp, Heterodera glycines
aaaaaagaaaattttgtaaataaatagctaaaaaaattcttttacaaacgcatatgtggtctctgtacgtatgtctccaatcatatattctttaaaaaattccattaaatgggaattgccacaaactcagtacaacttacaagaggaatttctctaggccttttgctattttcttgctttttcctgttattttttaaaaagagtcctttaaaatatcattggcttggtaaaaattccattaaatgggaattgccacaaactcagtacaacttacaagaggaatttctctaggccttttgctatgttcttgctttttcctgttattttttaaaaagagtcctttaaaatatcattggcttggtaaaaattccattaaatgggaattgccacaaactcagtacaacttacaagtggaatttctctaggccttttgctattttcttgctttttcctgttattttttaaaaagagtcctttaaaatatcattggcttggtaaaaattccattaaatgggaattgccacaaactcagtacaacttacaagaggaatttctctaggccttttgctattttcttgctttttcctgttattttttaaaaagagtcctttaaaatatcattggcttggtaaaaattccattaaatgggaattgccacaaactcagtacaacttacaagaggaatttctctaggccttttgctatgttcttgctttttcctgttattttttaaaaagagtcctttaaaatatcattggcttggtaaaaattccgttaaatgggaattgccacaaactcagtacaacttacaagtggaatttctttagtccttttgctattttcttgctttttcctgttatttttaaaaagagtcctttaaatatcattggcttggtaaaaatccataaaatggggattgccccaaactcagtacaacttaccaagagaatttctctaagcctttggctattttctcgcttttttcctgttatttttttaaaa

SEQ ID NO: 33631 - DNA, 761 bp, Heterodera glycines
  misc_feature (158)..(158): n is a, c, g, or t
cagagaatggctgacttcaatcttcagaatgacgcgctccttctgaaagcgacgggacagccattgatagtcaaaagccgacaaaacgaccttcgctctaagtttttcttcaatcgcttgcgtcgccctttgaacgctttgggacgtgccgatcactntcacaaaagggtctgaactttgcctattagtccgtccacttattaatttccctgccctcaccttttttagttttcgctcgaattttcaattttgaaggccaacaaatctgtatttcattttggtttgtcgtcattttttagaatcccttcgctcctgtgttcttctccactcgcgcaaaaaaagaatcggcactttccccaggtgcttctcctattaaaggatttgactcattgggcaccttcccctgtctctctccctatcccacccctcttctctctctctctcctttctctgtctcaactctcccctcctttctcctctctctctttctctctctatctttctctctctctctttctctcactctctctttctctcactctctctttctctctctctctctttctctatctctttctctctctccttctttctctctctatctttctctctctctctctttctctccctctctctatctttctctctctctttctctctctccctgtctctctctctccccctctcttctttcttcattaccagtgatcattgcttccagcctaaataaaatccaaattaaaaactcgaataattaaaaa

SEQ ID NO: 33632 - DNA, 968 bp, Heterodera glycines
caaaaaatggcttttaactctcaaaaaatgtaaattgtaaataattaattaattcattttgtgtttttttgtttgtttaattaatttttacaaaaacatttgaaattaatttatagcactattttattaagcctaaagaaacttttcgtcatttgctattttctcaaaattgacattgtcagattattaattaatagtttgttaaaattaatattttcatattgcttatttgatttgttatttattttcttctaataattatatttatttttgtatgaatttactttacttttttacaattaaattttttttttcggtttttgtgttggagtttgaattgtataaaataatttactttttactcctgtttccctttccgttgatatggtgatcttccgaagtggtatttagttgataatgttttattttattatattctttataagctttggattcttttgtaaattttcattttttcattgtcaattaattatttattaaaattaattagattaaatattcttttgtgcggctaattttagtattaatttatgttttaaggcttgcactttttcgttttatattaaatttcgccttatcaaagtttttgaaaatttacaaaatttcatttaatttttgtacttaagacttatataaaaattttggtttggtgataaactaaaaattaaataaaattaataaggaatattacagatgataaatgttctaattatgatgcaatacgagaaatgaaacaaatttaattgatttgtccaactttataaaaatttcaattatgtattaaaatcataattatttcataaaaaatttcacataaatttttaatgataatttctaaaatttttaaattcaaatatacgtacatattttatattaatcaataaaatataaaagtaaagagaataaagtaataatattaatttaaaacacacaaattatttacaaat

SEQ ID NO: 33633 - DNA, 1119 bp, Heterodera glycines
tggtgacctgttcctgcaactcctcgaatgcttgtccggtggactccatctcctgcatcagtccgtcctcctcctgcttggcggactgcaactcccgcctgagtctctcgccttggtcctccaaatgcttcaccctcctccgctgttcgtccgtccaacatttgcgtttctccttcaaatcggcacgtgccaatgttcgtaatttgtctctgtaacggtcgcgttccaatcgaatgcgcaaaatgactttttgtgcctccgttaaatcggtgggcggtggtgaaaaagcgccggagttctgatgctaattgtaaattgaaaataaaaaacatactcgttttattcaaaaccggttggtcattgcattgtccgttttgactcgctgtgtccgtcggttcctcccttttcacctcacaatcagccggggaagtgccgtccgtgtcggccttttgacctgctttttctccttctgagaccgacaagttgcccgttggcatagcagagcccgagggcatttcgtcctccaatttgatgatcaaataattgtcattgttcacacgccgttctccgtccaactctttttggcactaaaatcagtgacgaaatggtatgccaatgcattagatttgtaatccgtcaccatttgcacttgggcactcatttcgttgcacttccgctttagccgtgccacttcctgtttcagctgagtgttttgtgtgtttagtgagttcatcagcgcgttcatttgttcgttgatgggcatcgcctgctcccgtgaagcggtgttcacctcatagtccacacacacattttcgtattcgcgtcgcgccgtgttcaaatcattgtccaattcgatcacagtttgttggagacgatccaatgcaattaaactgtcattctgagaattggttgattgatcagatatgcttgcaattaacaggacaacaaaacgtccctggcgaaaactatgggccaagattcaaaaattttcaagtaaaaacaaactaaggaaggaataaaaccaatccttaatattcgctgctgacaatgagtattagttgattgtgagacttcgaaggtaaaacataaaagataaactgattttccgatttagataat

SEQ ID NO: 33634 - DNA, 883 bp, Heterodera glycines
  misc_feature (852)..(852): n is a, c, g, or t
taagatttcggcccgtttcattttcactttgtacccgtgcttttttcagatgcctacgacataaaccatttgttgatcgaatgggtggacaatgcgccgatcactaagaacatgaatatcacaatgtccgtgtgttcattgatcatcgttcgtccaattccaatcaattccctctgcggctgatcaggtccgacatggacatcgtcaaattggtgcccggtacttgcgacggcaattacagcaccggcatttggagttgcgtgacggcggagtttttcgtttcgcgcgagttgactcatcacattttgcagacgtacgtgccaacgacactcattgtggtgaacggcacgatttattactgtccaatttgaagttgaaaagaataatgccttaaggtgatcagttggttcagcttttggttggacgtggaagtgatcgctttgaatttcaaattatttaaatgaaattaattttgaaattcgttgcctcaggcggtgcccgcccgcgtttctttggccatcacaactttgttaacactgagcacacaggccaattcggtgaagaattcgttgccagaagtcagttacatgaaatcattggacctttttctggcggtcagcgttttgtgagtgaattaattaattgaaagtgccaaatgaggaaaatgtctgcgcctaatttcacagatttgtgttcggtgtcctaatcgaattcacaattgtcaattatacacaacgaaacggtaatttgggggaaatgccaaaagtgaaaagcatactgtgaaagagaatacagtaatcaataaataaatggtagcggacttttctgagcgaattaataacaaatgcttanatagccaaatattgtctggacggttcatctc

SEQ ID NO: 33635 - DNA, 937 bp, Heterodera glycines
  misc_feature (48)..(48): n is a, c, g, or t
gaaaagtcccggtcacggtttttctcaaaattcccggtcccgtacacntctagtgaaaagcttaaattaattaaattatgtcgtcatattcgcgatattttttttccgaataaaaatttcttcaattctccgattgatttgccattgaatttcacaggcaatgcttttgctgtattttcgcgcctcccaagattttgcttttttgaaagaaacgcatcgccaattagtggaaagtaatgaagacaacaaaataaagaaaatgatctcactgcttgacggtctttatgaggaaggcatcaaacaaccggtggcaatgttttgccaaagatcggtaggaaaatgccaaaaattaaatgataattcaacattaatcaaaattatttttaattatttttacctaaaattaattatatttttaagtgaataatgttaaatagagataacatttataggcactaaaaaccgccaaaataggtaggctttaggctctaaaaaaccccaaaaataggcactaaaaaatggaaaataggcactaaaaatcctcaaatttaggggtgtaaaatgacaaaatgtattcaaaaaaagtaaaaaaaaattaggccaatattgagataaataatttttaaatcacaaattcttgtcaagaaaataaataaataaaatttggagatgaatttttggaaagttttttatttcttgggggtgtatttttgaaaattttcgggtcgattcttagggatgtattttttgaaaaaaaaataggtcgatgcttaggggtgtatttttcgtttttattgcatttttattaacaaattttggactcaggaaaaaatagccttttgcctaaaaatgttatccctaatgttaaataactaattttacatttatcaaaaggattacatggcgagtcaaaacgatgatggagagtattgctaaa

SEQ ID NO: 33636 - DNA, 960 bp, Heterodera glycines
tcgatgataaaaaattaattagaaaaaatgaacaaaaaaaaacccaaatacaggaaatgtttgaattcacgattggttgggtcctaatcccgcccgcccactatgcccatcccaatttgtccacattaaggcatcttctcgaatttctgcgcagtggactctgcccgagagtgcttgaactgttggtcggaaatctttctttttgttgccgcctattaaccccgactgcgcaaccaatttaatgccgaaaggtaccgttaattcttaggtggcccaattgctctcacattcttcattttggcattattgagcaaacattgagaggaattggtggaaaggagtaagcgggaaaaaagggatagagacaataaaggactccctaatcagtttttaaaatatttatttaagtactgaaatcgaaataaagctattgatttaattgtcttgcgatttgtatcattcattatcactcctcattctgattatttctttggtttgaacggggcaagaatgtcagtggctcggcagttgtcgatcgtgcacttctcgcataattcaaatttgatgatggcccttccttcgttcgtctcgtacttgtttttgtttccccaaagacacgaaagacactcttaattaaaagatttttctaaaattaagtttaaagtagctaattaccatcacataaacgaaaagttaacatatattttgggcggaaaagtttccaagattggatgcttcttgggattttagccggaataatgtcagtttgttgctcacacatctgttcattttggtgatcgcccattacctcagatgaatggatttattattatttgtgtattaaataaaatgaaaaattttcagttttttccgagttttatatctatttttgtttgtttaacctattttcttaaaaaatttcgattgttcaaagcgaatgtttatttcgattaattaaaa

SEQ ID NO: 33637 - DNA, 907 bp, Heterodera glycines
ttaagaacccatggggtgctctatgcacccacaaagtttcattctggaaatcccacggacacctggggaccttcctttgtaagcaaaaaatttttttgcccttttttccattttttgggattctcgtacttttaatgcctttttgaccattttgtgttttcatgttttttgtggcatttttccgaaaattttcattaaaatacaataaaatcgaaaaaatacacccctaagaaatgacctgaaaatttcagaaaatacgcctctaagaattgttggtcgccaaatttaattttttttttcttgataaaatatgtttgaaaattttcttattctaaaaaattatcaaatatttaaaagaaacactagtttgctgtggatttaacgtcgagaaaaaaaaataacttcgaaaactaaacgtcattttttataccattaaaatgtagaggtagtacgccaaagtgagtgaaattataaagaaaaagaaaacgatgagatagtaatatttttgccaatttattaaaggtttcataaatagggctaggatttttatgttttaacatattttttttgcggcttagttatggcgagagaagcccaaaaatagcattttctccgaacaatttttggtttagagcgacttataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaa

SEQ ID NO: 33638 - DNA, 621 bp, Heterodera glycines
aactattaccaaatgcactgggtgtcaagttttctgagatgaaattctgcggatctaaatttttattcatgcttttttgctttcgggttaatttttttaataattcaatttgagacactaaaatgctaaagcactaaaatctaaaataacatcacctgaacatttttaaaaatttggtctctttgtgcagtcatataattttccataaatgtttcttggccaccacaatcccacagatgaaggaccatattacccaaaaatctgtaaattgcttcttttggttattcaagaatgcgttgcagttacttgacgtgcgcatgttccacttccattgtagggccaagacggcttgtgtctctcgcaatgtaatttgcaaagatgattgaacgcatgcttgttttgcccgctccactctttcccataagcaaaactttccgtttggacatttttcaaaaaacaaaatacagctattattgtatttatatcttgaaaaaacggatgattgtggtaaaacactgactcagttataattcaaatggcctaaggttcctggatttatccaggaaatccaggtccagatcaaatgtgaaaaaaatccaagtccaggcttttttcaaaatt

SEQ ID NO: 33639 - DNA, 960 bp, Heterodera glycines
  misc_feature (752)..(752): n is a, c, g, or t
  misc_feature (834)..(834): n is a, c, g, or t
  misc_feature (876)..(876): n is a, c, g, or t
  misc_feature (927)..(927): n is a, c, g, or t
agatcctagtcctgttatgaatagagaagcaggaaaaatttccacttgttttgggacttcaagataaaataaaattctccaattgaaacagatcgccttgcatcagcctaccttcactaatttcaattttgggagtatttaacttatcgaaaattaaaaaaaaaaattttttttctttattttgacagtatcaatcgggaaatagtggtccgcaaaagtcggtccgcaaatgtcgcactacgaaagttaaaatgttttgcaattgtctaaaaacgctccttagtcattgttttggtgtttttaaggtcaattcttaatttatacacaatttttggtattttttgagagttaaaaaccatttttggcagttttttaaggcatattttagtgcatatttgggcatttttcgggtttttagggcatatttgggggatttttagtgcatattttatgcgcgtatttggcatttttagtgcatacaatttataaccctaattatggttgattaatctttattttttcactaattatgaagcaaaacgccaaaaaggcatcgaacagaaaacaacaccttttttaggtataggtaaagcagctttcgctccaatgccaaccgtacaaatgcgcgagcaaatccaatgtcagttttaatctcggtcattctcatgatatttctgcaaaatttaataggcaaatgaatttaattaattattattttatacgattttaaatcgtagagaaagttatattanaatttataaaataaaaatatatttaaaaagaataatattttacaattttatcggtgaagaaaaataaataattttttaatanactaataaatcataaaaagtttaaaaataaatttcaaattanatattaaattagcgattttatataaaaataaaaagtaaattaaataataanttttaaatgcatattaattttcactttaagtcg

SEQ ID NO: 33640 - DNA, 1155 bp, Heterodera glycines
  misc_feature (1116)..(1117): n is a, c, g, or t
ccccccccccctctaataatcccccccccatttttcttaccgttttgtcccactcccaactcttttttccatcggtaaattaattctcgatttatgcccattcgttgtgccactttttcctccgtttctctcttttcatcttttatttgataaaatatttttattatttttctcttttctttttcggaataataaactttcctttctaaattaataattttaaattttacattaaaatttaaatgcctaattttccaatcacttactgtcattttcaaatttattcttccatttataaattattaatcgatgtgtgcccaattttttggcaattttattttcaatttccaaacgattacaaagtttacttttcttacgaattaatttttcttttaattcatcaaatattttcacaattttttcccattcatctcttctttttgggtagttttgacctaatttttaatttttcgtattaaaaatttaatattattttaacatacaaaataagggttctgtacaaataactcacccaacgattctttggctccaattttagtgtcattttcactatcattttcactgtaattggcattttcactatcgtttttacggccattggcattttcactatcattttcactggaattggcattttcactatcattttcattggcattgtcctcatgtgccattggttgctgtccatcctctcctccgtccaaattttcggtgccttcgtccgatgtgtgctcatttgcttcctcttccgaccattgatcatctgttgaatgctttttcagtttttgatttcttttttggcactttcttaccccctctctttctcaattggcacttccatttggcaatcgtcgttcggctcactccaaaggtcatagtgatttctttctccttctcactcctcgttttattgtccatttttgtccaattgttcgctttcatttccataaaatgtctcactatttttcgtttctctaattcagaaaatcgcttttttcctaaaaataaaaagcttttgttaattagaccaatttccctagatgtgcccccatttaataatatttactttcaattttaattcattgattccataanntaataatgaattaaattatttaataccaatacttcacc

SEQ ID NO: 33641 - DNA, 982 bp, Heterodera glycines
gacgaagggagggaagggagagaggacgagggcacataagaaagtcaagaaacggagaaagagagggcgaggcgtacggaaggtgcgacgagaggaagaacgagtcaaagtaaaacagacaactttttagttactgggaaaggcggaacacacaaaggtagcggagtacagaaaggatcaatggacaacaaataacgaactataactcggagtgattcatgcattacaattgaatagaaaaaataattgactgtaaaactgtccaggaatagttatcatttgtatcattcggctggatttgttgtacgtttcattaccgcctatcagcagctgacccattgttgttcttcgggcacttccaatccgaccattctcgccgtttcttttaccgtcctttcacctcccttgaaatatttggctcggatttcgtctaaattccttttgcttcccaagtaaatggcatatgtttgtgctgagtggtgcgccttcgtagcttcacattgttttgtatttcggtgcaaactcagctgattgcgtaaatatttatgaagcgcggatttcgtcgtaaaactcttaatttttgtcaaatgttcaagaataatttgggttagataggccccctcctctctttttccgacaagaaaagattaccttgtcgggtcttttgagttctcgaaaaatttgtttgaaagttgtaattgcagttgaggtgaaagaagccataaagatgaatgtctgagattaatataatcagtagggatgcaacttttagtgaagaaaaatctcgaaataaactaaaatagtgagtaaaaatgccaaaatagtgaagaaatagtgacataattttcagccaaaaattgagcaaaaataatttttattcactgattgcaattggaaatgagctacatttcctttataaaattctcttatgaaatattgactttttttaaatcaaaaattttgtcaaaaaaaaatttggggg

SEQ ID NO: 33642 - DNA, 638 bp, Heterodera glycines
attacgtggtcagctggcagtgcttggacatcatccgcaaggacatggtcgacccgttgagcggcaagcggatggccgagtcggacatcatcgaactgcaacggggcggcacgggctacgcggctacaaacaagctggacgccaagctgatcagaccccaattggaactgcaataaatggatgattgttcatgttgctgacttgatcatggatttgccaaatatttgctataatttctgtgtttgtaccgttttgcaatttacaagatttgatgattttttttttgcttatttggggtttctgaatcctttgcatgcatggttggttgatcaaaatattttggcacggaatggaaacaatttttatttgtggtctaatttgtataattgtttttttggcatggatttgtttaaatacaaaaaaaattggttctcttgacttaccgtatatgctctaattatcccccgtgggaataattgggtactcatctagtttacctgatacttttaacatacattttcagattcctataaatgtattttagaaattaatgaaaataagttttaagggcttttctaggtcgctgatcacgaatccgggctcatttgtcagatcagcgcaaccgttcactacatggc

SEQ ID NO: 33643 - DNA, 896 bp, Heterodera glycines
  misc_feature (834)..(834): n is a, c, g, or t
  misc_feature (873)..(873): n is a, c, g, or t
cttttcgtgcttcgcccactttgcacttttcgtgcttcgacatagcaccggtctaaacatcgaaaccataaatacaagtggagaagagacgcaaactgaaaatacaaatgttggtttaaaccgaaacaaaaatacaaatgtttgccaacaaacatacacaacgacaatattggcacaaagatcgaaacaaaaatacaaatgtttggaaaacacaaaatgggaaaagacgtaaaccaaaacacaaatcttgggaaacaaacacatcacataaacaacgaagttggctaaaaaccccgaaaccaaaaacacaaatttggaaaacccacaaaccgaaaatacaaatgtttaaaaacaatcacactcaaacgccgatattggccaaaacagcgaaacaaaaaacacaaaaggagaatagacgcaaattgaaaatataatattggggagcaaacacacacaaacgattatattagcccaaacaccgaaaccaaaaacacaaatgtttggcaataaaacatgtacagaacggtgttggttaaaacagcgaaaccaaaaacacaaatggggtaaacacacaatccgaaaatataaatgttgggaaggaaacaaatacacacacaaacaacgcagttggcaaaactcggaccaaaaacacaaaattcacaacaaacatacacaaacacgaagttggcccaaacataccaaaacacaaatttggaaaacccacataccgaaaatacaaatgttgaaaacaaacacacacaaacgccgatattggccaaaacagcgaaacaaaaaacacaaatgagggagagacacaaaccaaaaatacacatntttgggaaacaaacacacacaaacaattatattagcccnaacaccgaaaccaaaaacacaaa

SEQ ID NO: 33644 - DNA, 1052 bp, Heterodera glycines
aaatccaagcaggtgcctttgtcaaaaatttgttggttggaacggagaaattcaatgacggaatggtcaatgcagctgaagaaaaaaaaacgcttgagtgaattattaaaaaaaatttttacgaaattccgagggagtgaaagatgatttggttgcgcagagcataatccggcaattcttcgatagcgtgcgggtcacttcccatcctcacccccgccacttaaaaattcaaaatttaaaaaatattttaattaatgaaaaataccgtttttaaatatgacaatttccttccaaagtgtcaattcgcttttgccatcaaaatgcgcgtccaccataacatcgaaacggtcggaaagcaatgccattttgaggccgagttgagcacggtcaagagatgggagaatgtccatccaaacatcgctacaaatccaactgaaattgtgaaaaataagaaaaaaggttggataattttatttcattcaaaattttatttttaaatatactttaccgtcggttcattagggaattagcacacagctttcttttttaattgttaaatgaaaaaattgattggataaattagaagaaatgaaaaagaataagtgtatgcgtgttaaggcaattggtgatgatgggggagggacaaactgcataattaggtcaattagtgaccaatgatcaacgtaacacaaaacgacgctattggagaggagaagagggagaaagagtgggagaggaagcctctcttcccccccccccctctcttttgttttagttcgggtccgggattcgaaattagtcaaaatatctgccacaccatcttttgatgggaacttggctaacgcggctcttggaaaatccgactctggaaaatccgacaccaactttaaattttaaaaataattttgattctttgagttgatatttaaaatacatataataaagttacagtattgaagttatccaaaatatttttattgccataatctatctaaggtaggaatatatatttatatttttatgtatgcccttttctgattatctcaaaaaaa

SEQ ID NO: 33645 - DNA, 672 bp, Heterodera glycines
catattcgtgctcagagagccccgagaaccttataatacatatttttatgacttttgaaattttttaaaaaaatttcaaaaaaggtgtgataccatcggtactattatacccagctcgtttcccccacgtcgtcatccccccccgaaaaaaattttttcggggggggggggggttgggaatgatgtgcacccctaaatatgggtttgatacagggggttttcaggggtgttggtatggatctgtcacccatttttatgaaataccaccgatatccttaattgaataatatacaaacaccgttatagttggagcatgatgaggatttcgagtctccaccacactcgtcggacgaggaggcgccagaggacgaggtggattcggactttgacaaagacgaggaggaggatgagcccacgccggcggaagaggacccggaacaaattgagcgacgacgaaaggttttttttttggaaggaaattaattcataaattcacacctgacaaaaaaaaagggtttccgaccggagacaaaaaaaaaaattcttttaataccgtccaaaaaaacaaaaaaaaaatttttttttttttgaaaaattttcagtaatgttcatgattaaaattgtaaacgccatccacctatgtattaagtcagaaaacaaatctacaataca

SEQ ID NO: 33646 - DNA, 213 bp, Heterodera glycines
agtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaacatgggca

SEQ ID NO: 33647 - DNA, 954 bp, Heterodera glycines
  misc_feature (898)..(898): n is a, c, g, or t
  misc_feature (937)..(937): n is a, c, g, or t
  misc_feature (941)..(941): n is a, c, g, or t
aagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgccagagttgncgaaaatgtgaaataatctcagaaaatggctatctcttnttanggacattttctat

SEQ ID NO: 33648 - DNA, 875 bp, Heterodera glycines
atgattagctgtgcctttccgacttttatttttctttctttctgaaggtgcatttcgctcgctttgttctgcggctttttctactccatcactgtgattccggtgctttgtaagttccgtaaaagcatttgtttttgagttttgtcccctcagtcatccaagataatccccagctgtttcccgacgcccctctcagtggcctcaattacattttttcgcattacttcggaatctttctctccgcttccatcatcttcatcatcaatgcactcattaagtaacaattaattggtcatttatcattttgactaggcgcatttgtcatcacattggaatgtttttcaaaattgcctagttaattagttccctaattagatatggtcggcacttgtttgtttctcattacctcccccccttaggcgcaataaccccaccgtcaatggcactgtcattttaccttctttgctcagcggggccatttggggctgtggcatggcatgcttatttttggccaatgaccttctgacgccaactgtcacttatccggcaagaagaatcgatcccctgactttgttcgctcttttttaccattgtcctcttttggccaggttctgatcactttgcccggttgtgtggcttctctttggagcatttacttcttcaaggaaattgaaatggtcagtcagtcaaattctgatcaatttgtaattaataataatgttgtttttcttcgttttttcacagaatcgtcgcaactctctgatcattttctgctctttcctttccattttttgcggtgcttcgatgattttcgtttcaaaatcgaagtcccgctcgacagactcttctcttccagtttctgactccacttaatt

SEQ ID NO: 33649 - DNA, 778 bp, Heterodera glycines
gcaataagtggtcaattaccattttgtttgcattatgtaacatactaatttaaatattttttgccatctttcgatatggggcctcaaaaattccatgagtagccaggaagaagtcagaattctcgaataattttggttaggatatatgtaaaaagtcatttcgtccaaaagttccggcggcaagtatttcatattatttgttgttgtagttttagggaattttccggatttcggtgaggggacaattttaatgggactgacttaggatgtgttcgaattattttaggatatttaaagagacacaatgccaaagattagcaatgaaaattgctctttggtcttttaaaatttaaattccaacttactcggttggctgacatgagaagttgtgtatgtatgtttctgagaaaaatttggttatagttagtagataaatgctctaaaatcgttttgtcagttaaatatatgtatatttgggtaaataaaatttggcgaacaatgcaatgaatggaaatcatgcttaactcgttaaaacttgttctcgcgggggttttgggaaaaatgatcacggtttgacatcatttttgacaaaccctatctaaaagtccaacaaaaagttgaaaattcaaaaattttcaagcttctttttttgttcaaattttacatatcgcccgctttcgttgtttacacaatctaattaatttgaatatgattaatcaacgaattaaaaagcaaatcaattttttattttaatacaattatacttgattatttaaag

SEQ ID NO: 33650 - DNA, 165 bp, Heterodera glycines
ctcccctttcgtcccccgccgatcacccgcactcccttttgtcctctgatcactcgtcttcccttttgtcctctgatcactcgtcttcccttttgtcccctgatcactcgtcttcctttccatcttccgatcactcatgttcctttccatctgatcagtttcccc

SEQ ID NO: 33651 - DNA, 805 bp, Heterodera glycines
aagttcagaacagtcttccacattattctgccgtcaatttgttccgcagttttttatccaatttcttgaactgcttcgcattctcggcagaaagaacaattgtccgctttggttgcggcgatcactttttggcggaagccgctgattgcgccaatcttcatgttgggccgcacttcgccagtcagcgtaatcagaaatctgcagacattgatttttagtctgaaaatttttttcaaataggcaagacgcgaaaatgtgaaaaacagcacaaaaaaagcttttcaaaaaataaattatatttttttgacctaaagcagggctgtcatcgtccatgctcagtttgcaaggacggttatgctgatttgcaaggatataacggggaaaattcatgaaatccaaggacatttaaaatttttgtttgaggcttcttggtccaactttttcatgatgatttttgcttaagttgatattttcgtgcttaatgctgagcatgtaattttgtgcttatttttatgcttaattagcaattcttgtaaaatttttgactaaaaacaccgtctcccgataataaaaacgaaaaatacaaccataagaatcgacttaaaaatttcaaaaaatacacccctaaaattgaaaaatttttcaaaaatacatcctcaaaaaatttatttaaaaatgtcaatttttgttaagaaaaatctgaaaagaaaaattgagaaaattaactgataaaattttgcttcttcttctacttcttctttttagaaagcttccagttgatccacctgccaacaactgtgacgtg

SEQ ID NO: 33652 - DNA, 824 bp, Heterodera glycines
ccgttccgaattttatttagttattttcattttcattttcatttttatattttttgtccccacaatttagcacatgcacataaataaataaacaactcttctaatgactgacagggaaaagcatttgcattttgttcgccttgcggaggaagcggcgcgttacgacgaaatggtccaggggatgaagcaggtgaaggaaggaaggaggagaccaattcagaagaatggacctaccattaattaaactttgcatgcttaaggtgattgaattggatgccaaactgaacgaaaatgaacgcaaattgttgggcgtcgcgtacagaaagtcagtcactgggcaacgcttcgcttggcgtgtcattgcgtccgtcttggcacgagggaaaggcacgaagagacagctggagatggtcaagcagttgctgaacaagctggagcgcgaggtggaagagaggtgccgtgaaatattggtcagtggtgggtgggcgcattcttgtgccgcgaaattcggcactaatttgcgtaacttttcaggatttgttggaccgggttctgatcaaggaggctgcagatgatgaagcgaaagtgttctacttgaaactgaaggctgaccacttccgctatttggctgagacacgggcggtgaaaaacggtaaaaggacagacggacggaccatacatgcacaaggcgtgtctcgacacaccccccccccccatcgttagtcgtaaggggggcggctgtaaaagaggggagtcgtcgtagagggaggcgttaacgaagggagaaaataaaaaaattttggaccttcgtatgaaaatcggtc

SEQ ID NO: 33653 - DNA, 1111 bp, Heterodera glycines
attgaatgtttgcttgccgttttggaccgatcctaccaattgcggcattctttttcgatccgacttacgccacagaatacggcaacaaattggatgctttattcaaacaatggcccgagccattattaattaatgagacggaagtgagtggcggaaaaacacttggccaaaaaatcattggaagtgttctacaaagaggaaaaagcccaacaaaaaagggcaaagaaaaggttaatgaggagagttcatcagcagcagaacaagaagcattcgtcatgaatcgtgcaaatttcgaaaatttaattaaacaaaactttgaaactgtaaaagcattgatggaacaaaacagcgcataccaagtgaatcgaatttatgaatggctttattcaacgacgacaaatcgacagcaagaaatgccaaaatcacagaccgaaacggctataccactcgatgatgactacgtgctcatgccaaaatcacagaacgaaacggctataccactcgatgatgactacatgctcgtgccaaaatcacagaccgaaacggctataccactcgatgatgactacgtgctcgtgccaaaatcacagaccgaaacggctataccactcgatgatgactacgtgctcgtgccaaaatcacagaacgaaacggctataccactcgatgatgactacgtgctcgtgccaaaatcacagaccgaaacggctataccactcgatgatgactacgtgctcgtgccaaaatcacagaacgaaacggctagactactcgatgatgacgacatgctcatcgcatttgtaacgaaagattatgccaattttgagaaccattgcattgaaatgaacaaacaggatttgttggcgcatgttggattactatcaaagcgaaagggcaaaggcaggtacgatattggagagaccgtacggtatttgaaactacagtatgaagcataccttggcgttgtgtatttgctgaaaaagaaatggaattgtgagaaaatgcaatatcctttgttaagagaatgcgaaaaatttcaaaaatatttgcttgttttatatgaatttttgttcaggaaataccttgaaggtaagtaagaaatttttcttaa

SEQ ID NO: 33654 - DNA, 725 bp, Heterodera glycines
  misc_feature (581)..(581): n is a, c, g, or t
tgataccaagattgtacaatttggttgcgtctgagaaaagttatgagtggatttagtcaaaaacttagcaaattttgcactttttgtcctccgacctaacaccgtcggcaacaattgaaaaaaaaagtaacagactgtgagactgaattgtccataaaagagggagagaaaagacaacaagagaaaaatataaggagagaaaagaaaacaaacagacgattagagagaaggggaatatttccttttcactatccatttttatatcccataaagaaaagcgagttgaaatatttgaaatttaactgtcagacagcaaacgccactaggtagcgaagcgcatctcaaacgaggtgttcgaaatttaatttttggggcgggggccttttttgcccctttaattgttcactattaagtgttttaatttgctttggcttcttttctaaaaaaaaaaatctttcataatttaaaatacacgttgaagaaaggcacatatccgacgagagtttcagttacggaagccgtaattttactgagaatgaaaacggagtaaacagttcgacacctgaaaatttatctaattnaaaattttacaaaaactaattttttaattcttttacaagaaaatttcaagaaaaaaaaataaaaaagtttttatatctatgctttttcttgataaaaatttgtttctaatttaaaaaatatgggcaattaccgtatatgctcta

SEQ ID NO: 33655 - DNA, 1020 bp, Heterodera glycines
caaacaacgtttttacgacaaaaagtgcagcaactgctccgcgaggcgggtatcccgacaactgaaccggaatacgatgcagaaatatacattcatcaagtgcaagggttgtggaacgtcaaatatcccggtgagtacaaaattttcatatttaacgattaccagatgagcccaatcaccaaatctgatatcaccgattaccaattccctattcttctctaccacaacaacaaccactttgacggcatcaaaactctttcaaaatttttcaacaaaaagaactactgtctctcctgcgagtcgccgtactacaagaaaatcgagcactcattaaaatgtacttcactctgccacgggtgccgtgaggtgggagtcgactatccatgtgagccccaacaaggatacagcaaaaaatgtgagcactgtaacaacaccttttacaacaacagctgttatgaacgccacctccacaaggatttgtgcaccaaatttcaacgctgtgaagattgtggggtaatttataacataaaggttcatgggagtgttgggcataaatgtggggaacagttttgtaaactttgcaagcaatttcatataaaagaagacgaagacgacgggatgaacccctgtacgaaatgtttcatccagcccctaaagcaacaacgaattaagtcatacaggatcatcgcatacgactttgaggcgacacaggacaagaaggtggagaaccggttcgagcacgaggtcaactttgcagcggctaccatcatttgcaccgactgcattatcaacagcgactggaacaaatcacttcagggaaaaaagtgccaaatttgcggtcctcaccgcacaattaccttttcaccttttgactacacggagacaacagtcgaccaaaaaatcatcactcaacacccgctacgcgaattcgtccattggctcctttttgacacaacaaaaatttcaacagtcgcgtttgcacattttgggggccgctacgacatgacgatgatcatcaag

SEQ ID NO: 33656 - DNA, 1246 bp, Heterodera glycines
ataaactcattgaaaacaacaaatttaatttaatttttgtttaatatttttatctttttgattgaccgtgggcaatttacctttttatgaaggtcaattcatattttttgtgaaggtcaacaaatatttttcgttttgttgtaaattacaaaatatttttaaattattttttactgcagttttaatgtttaacaaaaaatttaattgtttgtcaataaataaatttgcaaaaaaaatgctaagaaataatgaaaattttttctgggattattatgataaaaatcaatgtcaataattatttgaacacttggggaccggccgttgtggaccaaaaatgttatgttttgcctcataacttttttttcgtaattaacaaatccaacaaaattgctaatctgtgatagctctgaagttatttacttatttaacgagcctaaagaacgatttacaacaaaattataagcttggaccgtccgttgtgatcgctttattatttatttattgaccggcattaaaggacaggcaaataatttattgaaattgaacaaaattttttttctaaattttcaatttttttaaaaacatttttgtattcgaatggtactaagcttattgtatttggttgactatgcaaaaagttgtggcgtataaatgttttggtccgcattttccggtccgctaatgtaatcccagttttatcttttgcgttttattttgactccaattttcccaccaatttttgtgccaaataatcccttcccatttggacaaagtaattttctgcgggtgggagaatggaagcaccagcaaaaaatgcttccttaggctaacgggcacaagaacagccaaatgcatccaatttaatgccaaaatgccaaagcatcgaattcaattgggagggcaatttcatttgtttaaaatgccaaaagtcaaattaaattcaatatcaaattttataaaaataaataaaaattgaaaatccatttaaatttatcttttcaaattccccatttttaaattttcccaaatcctgaaaatttctttacttatttaactagtggcaaaaaaaaaccaattccatgcaaagctgtggaaatcggaaccgagttgttccggctttggtggccaaaatgagcggaggttggggggggggaggggtgggcacggcggggtgccatttccaaaattgcggttctgccgggaaggggagggggagaaatgccattccttccgcccaaattccagt

SEQ ID NO: 33657 - DNA, 779 bp, Heterodera glycines
tgcgtctggccaattgcgtctggccggttgcgtcttagtacttatggggccggttgcgtctcaaacatttggttcggaaaaataattttttttgatttatccgaaggcgcaaatattaataatttttttcttaaaactcatacgtatgaaaaagttacaagcattttttgagaaataaaaaaaatacggggttaactaattcggagtgaaattgtgcggggtggaaacatagtgctcccatatcagaaaattgtttttgcatttttatacatttcatttgttttaaatcttttaatatagcccgattttggcgctgtgaacatcagcgcgatgaattcaaatgccgaggacgaatccacacaacgctaaatgacgtcgtgctgaagaccgttggagaacacacgtgcaaccacagcgcggcaaatgtggtcacacaaaaaatcgtttctggcataaagcggcgtgccgttgagacgatggaaccaccagcggcaatcagggcgcacactcttcagcaaattgccacgccagtaatggcgaaaattccgacaaagaatgccacaaaaaaagtgaaaaatcgaattttttttttactttttcacatttttgtttttaagctggtgaagcgagacagcggtgtcttttaaggggagcttttcacatattttttaaatttaagaattctgatttttggccggcttgctttcggaaattgggcttccgaaatgaagtacatttataaggttatttatttatttataaagaaaagaaaaagtcca

SEQ ID NO: 33658 - DNA, 1232 bp, Heterodera glycines
taactaataatatctgtttttcaggttagcttggaaatcttttttacatataaataattgtatttttatttttgaatatttttggttttattttttatagaacaattcagaaagttgttgtaaagtgattttttgtttaagcatgtattagaatagtgcatgtatcgtgtttgaaatttgcttgatttgctactaacttttggccaaaatgatcgcttttccgttcagtcagttgatttttaatgtgtgatagagacaattaagactacataacttccaaactattttaaattaaacgccacaaacaacttttatgagtcaaataaaccaagcattttggtttgccttactgttgtaatttattttcttgtgattatatttaaccatttttggttcattagaaagcattaaatattttcgcattcataattactttaaattccattttaattccgacaagtaatttttcaatgatttaatttatgttaaatttattttatttgacgttttaaataaacaatgaaacagaaaatactttcgatattattttaatattgcttcttattttttagaaacaaaaaaaatctgtcgagtaacccggtgccagttagggagtgagtggacctccttgaacgtttcggggtttgtcccggctcctaacactgggagtgagggcgatagattctgtacttttgttttgtaaattaatttattcaccaaatatttacctatttttctatattacataattttcttaatccttgcgtttggcttatttggtttcaaatagaagatgaatacaacttttaataaatgaatttaatgacacttatatgttataaacaatatatttcattttttgcaggcatcgttaatgtttagtattattaatctaagcttttgcttttcaatattaaaagcacattttaattgatgtttattttaaatgataatgtccatatatgatgggtccactccaatcgactcattcttttttaaggctttttgttttattttatgtaattagcaattaatttgataatggatttaaaagttttagtttaattttttttatttgtctatgtgtctactcaatgtatgatgctaattcatgtattcagttattaattttattgaagttcaaaaaatttaagaatagtttaaatttttgggtttttcgatttcggttttttaggggttttaaccgaaaccgtccgaccaaaacaatcaaa

SEQ ID NO: 33659 - DNA, 461 bp, Heterodera glycines
tttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtggcgtttcagagcagtttctgaaaaaaatatttatgaattaattatgcaaaaaacaaataaataatgaactctcttccttaataattttcctgcaccgaaggtactcactcggccgcttcgcgggctcgaggagggacttccttaaat

SEQ ID NO: 33660 - DNA, 933 bp, Heterodera glycines
ccgaatggaacatttctgtggtcacaaagcttggcaaactaaaacatgccattaactcaacggatataattttattaattaggagaaatgaataatttaacttttaaaaaatactctgtgtgcacggccggaaaattgaacaaataatcgcaaatgttgctcacatcgtcgagggaaaattgcgcccattctttcaacagccgagcgaccaaagcgcgagtcaactcgaacatgagaaagtgatttttggtggcctccaagctttgccgacagtgctccacggaaattacgccttcgcgcagactcataaagagtgcctcggcatctttgcggtcttgggacgtcacttgatttggaggggcctgaaaaccaggaaaatggagaaaaacagcaaacaatagtcataccataataacctgagcagcaaattccaacttggaaagttcgttagaaatggaaacagccattgtgacgaatttgaaagagaaaggaaacagcaataaaaaatgtatgtaaataaacaatcttaacggaagttgtagtaatttatcttcagcttttggcgtttcggtttgctcaaaaattaacttttagcccaagaaaaaaaatagcatttcattcttcaaatataaagtctttgtttgcaacaagtgaataaataataaagttgtttgcatcactttcaatttattttctatgtaaaattttaatttcagaactttttatttacattaaaacatttcgccattttctcccttatttaagcataatttaatttatcggttctttgcagtttagaggacccaaaaattttgcaaaagtcccagtcatctacattcctatcttcctaccattgaataaagcaattatccaattataggacaccgataaacaaaaaaaaattacttgtatctaaatggaagttgaaaatcc

SEQ ID NO: 33661 - DNA, 903 bp, Heterodera glycines
ggataaattcccataaaatttttcaaaattttacctataaattggctaattttcagtgaaaaactgtttataaatgatcaaaatttccaattttttccccggcggcgcctatcggcaccgcctgcgccccccaaaactcctattttttcttagaaaatggcccaaaatcgcaaaatttggtaatttgatgaaaaactgttctccacggcgattcaattttggactcccagtgcaaataagtttattatttattttgtaatcagaacgccaaaactttgcgatacttaaattttttaggggattcccccttgtaaaaacacaagagccgatctcgagttaaaaataaaaaataaactgtgattcgatagagggggtcaaaatatgggcctatgcaaaattttaagaaaatctgacccgaggaaaatttttttgaccctagtaaaaatttcaataaatttaactcttttttagccaagtgcgctatttaaagccaaatcaaataaaacttacaatattctccagaattttctctttaaaatgaatataaaattattatatttggcctattattgcccgagttataagtctggaaaatttcataaaattgtcgatgttgtacgtaaccaacgctttttgaatatgatttttttttgacacgaaaacttttattaatggaaaataattcttcctttcttctttaaacgaagaaattgaaattaacacacaacatgaggaggatttgaacttgagaccccccttttggtgactaactcacagaccactccgacgaaaagtccaacttatttgcgcttggagcccaaaattgactcgccgtggtacaagaaaagagagcaaatacttgcattaagaaaaaaattgcgatgagaaaacccgaaattcata

SEQ ID NO: 33662 - DNA, 1228 bp, Heterodera glycines
  misc_feature (1172)..(1172): n is a, c, g, or t
  misc_feature (1180)..(1180): n is a, c, g, or t
tctgccacgaccaggacgaggctgcccgagtgatgtcccatttcaaaattctaatccgcccgatgatttccaatccacccattcatggtgcgcgaattgcgtccaaaattttgtccgacccgaaattgcgccaacaatggtcagttgaaatggcatcatttgggggggggggaatgccaaaattaaataacttttcgtccaagtctttcaccgccttttaaaatagaaatcattcgtgatcatagactcaaaatccagatttatcactctatgcttaacaagtgtccaatcccaatatgttttgaggctgggcgatgtgaagggcatggccgaccgaatcatcacaatgcgctcccaactccgcgatttgttggccaaggctggctccaaacgcaattgggaccacattgtcaaccaaatcggcatgttctgtttcacgggaatcagtcctgaacaagtccgacatttctttgtgctattcccaatttccaatgattcaggtcgaccgactcgccaaagaattcagtatttatttgacgagggacggacgaatttcagtggccgggatctcatccaaaaacattgactatttggcaaatgcgctgcacgaagtgacgaaataggcgagcagtttatcaaatatgtcccaaatggccctcggaagtgctttaaagttatgcgatcgaatgtagaatagaacactttctacaggtgataagaacaacccgtgactctgtccccctttcatttctctgttttacgtttcattttgtaatatgacaggtttatagtaaagaatgcattttaaaaagttttggatattaaaggaaaagcaaaaaaaaagcaaacgactaaaaatttatcggattctctgtttgaatgcgaataacacaataaaacagtttaaaattgaggctgaataatttcctagtcagcgtttgtattcaaaacaaaaatgttaaagaaagcacacacagagatcaaaaggattagataaatatcatccacgggacgcgccaatggtcgaaattgttttgggtaaaccccgcccaaaatgaacctttccgacccatcattgtctgtttttcaatcccttgtttattttttagaggggaaagggggggggggagggtccgaacgcacccctttggacaataaattaacagatatangaatcttnaatttgttgtgggcaagaaacataaaaacaattataaaaggggggggg

SEQ ID NO: 33663 - DNA, 432 bp, Heterodera glycines
  misc_feature (46)..(46): n is a, c, g, or t
  misc_feature (48)..(48): n is a, c, g, or t
  misc_feature (50)..(53): n is a, c, g, or t
  misc_feature (59)..(65): n is a, c, g, or t
  misc_feature (67)..(68): n is a, c, g, or t
  misc_feature (72)..(74): n is a, c, g, or t
  misc_feature (91)..(92): n is a, c, g, or t
  misc_feature (101)..(101): n is a, c, g, or t
  misc_feature (104)..(105): n is a, c, g, or t
  misc_feature (113)..(113): n is a, c, g, or t
  misc_feature (133)..(133): n is a, c, g, or t
  misc_feature (171)..(171): n is a, c, g, or t
  misc_feature (192)..(192): n is a, c, g, or t
tttttattgaattctgaaccggtttgagtagattatttcaatgggngngnnnnttttgnnnnnnngnngggnnntcccttctggggggggnnttattttgnggnntttttttntgtgttttggttgtttggtnggtttttttgggttgtgtttgttttttttgttgtgttntgttgtgttttgtgttggttngattataaaaaattgaaaattttgaaattatgtttgataatatgttgtgataggggtattattttgtaaagtttttttttaaaaataaaattgtaaaaaaggatttttgggatagtgaatgttatttttattgaattgtgaaatggtgtgagtagattagaatagaaaaaattgaaaattttgaaataatgttattgaataaattgtgatatgggtattattttgtaaagtagttttttt

SEQ ID NO: 33664 - DNA, 947 bp, Heterodera glycines
atgtgataatcccactaaggagttagaagaatgtatcaaatcgtcaattaatgaagctatcgaagatgctaagagaactttgggtggcgcggataaagccggagtagttattttttcagaaatgttagatcaaggagacataattgtgccgataacacctattagctcaaatgtggcagacgcagtcttcaaccaatttatcaaagtagaacaaagtgtagcaagaaaaagtcttaacatttatggaacaccttttgtcattactgtaacagttcttaacattaatggattaagaaaaaataaagaataaattattattattttttttttgtaaaattttataaaaaatgtgaataaaatattaaaaattttaatggttaaaaatatgtcacacccttgaaaactgtcccagatttccaaggtaaattgaaaatttactcccaatttggtaaatgaaaaatatgtaagatttcaaaaaaacagcttcacgttcttagaaacccaaaacttgatatttgtaacccctacaattgaggaccatacattttgggaccctactttttttgggacttgacattagggatctgacatttggggaccctacacttgtgagcatttggggatcctacatttgcagagttgacattgaggactctacattttacgaccctacagtgggacaacagttggggaaccctacagttggggatctgacatttgaagacttgacactttgggaccctacatttttggggaccagacatttgaggaccctacatttacggaccctcgacatacaacatttgaatacccacagtttatgaccttattacatttggggaccagacatttgaggacttaacatttatgtaaccgatacttggtacctgacatttgagggggaccttaaattttgaagatttcaaacagaaaaataaaaatgatat

SEQ ID NO: 33665 - DNA, 1018 bp, Heterodera glycines
tgtaagaaaaaattttcccactggttttatttcaattcctttagggaagaaaaagcagaaatttgtagtggttttcgacaacaaaaaaaaggcaacgacgtgaaaacaatttttggaaaatttaatgcaatttgccaagaaaaatttcgaaaaatttgcccatttttttgaaattttttatttttcgtttcggggggggggggtggaattctcactcctgtctatggacctgcccacaacacacacacacacacacttgcaggcggcggatcagcgggacgccggaacgcgatttgcgtttcagtgaccaaaatgaataaatgtcgttcatgtagtttaggccaagccgttgcgcaatggcttgaactctgtgccaaataatttgcaagaataaatgttgtgccgccccgtcccggcgaccgcacttttccattggtatcactggcaatggcaccgagttgagtgtctgtttggcattcaagtcgatcattttccgggcctctttcagcttggtctccatttcgcgcttccacatcgtaacactttgaccattccttgaaaaaaaatgaacaaatgctcaaaaaaaggggggacaaataagcaaatcgttatgtgatgctagaaggcagatgaaaaaaaattctaaaaattccatccatttttaagcaaatcgctggatcaattgcaaatttttttttaatatttatatttaaattaaactttttttttgataaaaaacaaaacaaaatttttttatactttttttaaaagttttattggtagaaaagtgcagtgcatattatttgcttttaaatttcaccaaaataatgcgtgtacaacaaaaacaacatcattaaaccgcacctgtttggttccgagtgctggaagcaataggcaaatcggtcaattgttattgagtccgggttgttgcgcactcgcgactccttgaccaccattttcatcccggcatagcgagcgcaggtggcgtgaaatgagcgaacacaggccttctttaaga

SEQ ID NO: 33666 - DNA, 702 bp, Heterodera glycines
tgccgagcacgtgtaagttgtgagaaaaagaagtcaaagagtgagagagcggcgaaaagtgtgtatttctgtgctgtgcggcggagaattgaataacaaaacaccgccgcatcgacccccccccccgcggcgggcgggcggcgctggcagaaaagtgcaatgttcccgccaccaccaccgccgccgctgttctttcactcccgcccgatccacccgccagacgaggaaattggcggctgagccccccagggaaaaaggaaggaaagggcagaccaaagcgggaaaggacagcggcagaaagggtacacacagcacaacacaatacacggcgtgaagggaaaggaggggaggggaagggacgggcacacactctcgacccctccggcactctgataattttagcgataataatgggatgcataaagacgattgtagaaggaattggaagcgttacaattgtttgacaaccttcttgagcgtaattacgatttttacttataccatttttttctaggcttaaatcacctgcgattttcggctctctgataattttagcgttcataatgggatgtattaaggcgattgtataaggaattggaagcgctaaaattgtttgagaagcatattgagagtaattacgatttctattgaaccattttttctaggcttagatcacatgcaatttttggtactctgataatt

SEQ ID NO: 33667 - DNA, 958 bp, Heterodera glycines
  misc_feature (849)..(849): n is a, c, g, or t
  misc_feature (857)..(857): n is a, c, g, or t
  misc_feature (867)..(868): n is a, c, g, or t
  misc_feature (876)..(876): n is a, c, g, or t
  misc_feature (925)..(925): n is a, c, g, or t
tagggttcagccccgagccccccgacccgacccgagacgtttttttgacctattccacgacccgacccccgacatgtgccctcggcggtccccgacccccgactttttgcccccgacactaattcgggggattggggactccgagcgttgtagttttttggaaaaacacgccgcaaaaaaaaccagtttttgaaaaagcaaaaaaaggtcatcaaattcgacgttcagacccattcgcaaattagcaaaaatttcggtttaaaaagaaaaaatgattttttcgttaaaaaatttgttgatcactacccgatcggggtccccgacccccgacaattgagctcaccccgacccgacccccgacattttgcccaccgagggctcggggcttaaccctacctaaaaactaactattttggcagtttttagcaactaaaaatcgtatctctagttatgtacaacttcaaatggatatatatctccacggaatgacatattttatcctactgagccaaacccaaaaaaagtatcaatgatagaaaagattgaaattgaattatttaactattccaaagccaaaatcgggacttgccttgaactcaaatacttggtacatttgatagctcttaatgttccgctcttattattaggtatattaagcgggggaacttctgttttaggtgccccagtggtgtatggaatggctgaggcgtaagcagcttcagtccatggtctgttgtacgcagccgcgacggcttgcgactgtaaatgttgcgcaaagagtggcgaaagaaatggacgtcccggtaaactgtgatggcttaatccatggccataatatggcaaaaccanatgctggnggaagattgnngtgagctnttttctaaattacgcatttcaaaatagtttattgcatgaatgctagggnaatccgagcgattgcttctttttatgctttttt

SEQ ID NO: 33668 - DNA, 912 bp, Heterodera glycines
ttccatgtcaacggggtttgtcatcccgtttttgtcctaatgcccggatttttttttaattggttaggacctggatttcgagatataccgactcggacaggattccggagaattgtgaaaatgtggttttgagcagttcagtgttgtattcggggattttcgagggcgcacgtcacaaaacttacatccattccgaaacccgaattcgtttttttcgttttttactcaaaaattgttcgagtttgagtttgtggttcgaaattggtcgaaccggggcagtaattgtaacgataagcaatttcatcttttttttcatttgctataattcaaggatttgactctgtttggtggcccactgttcaccggatcgtttgttgctaaaatgagcaacgattggctggttggggctcagctcaaggccaacctggaacagggcactgttggcccgacagcaatttcgattgggcgtaagacggcggagtactcactgcactcgcataccaccgacgggacggactttggtgcaaggtttgtatggaatggagttatcaaatttttgtcagggttttaaatgccgaagtagaggcctaaaacgtatacccaagattgtaaagtgaaagttttaatcaaatttagtattatttttttccattgtattcttttcagtctgtaccatcgggtgcaccaaaatttggagtacggtgtgcagatgggttggaagatgcgcgacgccctggcgagttgggcgattgccaccaagtacaacatgagcccagaattgacccttcgtgcaaagatggaccacaagtctgttctgaccaatccgttttttaatctcttccaccctttttttttagtctctcgtgtccgtttctggaaaatttttgattttttttttattttttgaaaatt

SEQ ID NO: 33669 - DNA, 952 bp, Heterodera glycines
aaatttaaaaatacccattaattgtttatttaatgttacttgattttttaaataatttagactcgaatttcaatataatatatatttgctaaattatatcactttcaattttttttattattattctctctataattttataagataataaaaagtgtacatagatcgtgtatattcgaacgaaaactagagttaattctttagatactttaaattcatttttctattaaaattttaaactatccggccaaatagatataatttatattatagtcattttctaataaattatttttgaatttttcttgtttttgttttactgtttttttttattaaaaattatcattaatttcaaaagttttccccattggtgtcgttctaaattattgtaattaatgaaataaatacaatatttatatgaacttgattttttttttgtctgtgatattgcgtaaaaatcaaatggaaaatttttaattgcaaatttgtaaaatattttcaaaattttactcaaaattctcaaacctttcccagaagtctcagtcccggctgaaaaatgcagaccctagtgatatgcacagtccagaagtttgggtatattaaggatttaaaaataaaaaatattttaaatgtgtaaaaaatgtagccgtctaatttaaatagtaataaattttaagaattaaagtttttttaaagaattgtccactacattgactataaaatattgaataagaactgaaaatcaaaacacttaaaaatattggcgaaaaagttgattatgaaattttggcccaaaaaattaaatgaaaactaaataatttgtaacaaattcctataatataattagaaaaaaataatttttaaattttataagctttttttaactgttcataatcaatttacacttgcctaagtgatttaaattgtcaaaaaataaatatataaaaaaata

SEQ ID NO: 33670 - DNA, 1019 bp, Heterodera glycines
tgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaatctaagaaaattattagcatttgaagggttctcagcagtttccct

SEQ ID NO: 33671 - DNA, 982 bp, Heterodera glycines
  misc_feature (890)..(890): n is a, c, g, or t
  misc_feature (947)..(947): n is a, c, g, or t
taaaattcaacgtaaaagcaacttaaataaaataaataggaatttaaaaagtggaatatttaatgaaaaaataaagaaaaagcaatcacaaaattaaattgttaaataaagaataaaaatgaataaattttgcgggaaaatatgaataaatttaaaattaaaaataaaatgccaataatgcaaatcaacgaatcattaattagtagtagggaattttttaggcaaatgcctaaaattttgtgcaattgatacgtacagataaggatggaaaaaagcattttccgcttagtttggggagtcaacgattacttttataatgattatttgtgcaaaattcgggatttttgtgcttaatgtgcctatttcataatttcgaaaaattccttaacaaaaatgcaacaaaatcgaaaacacacccctaagaaatgatcagaaaaaatttcaaaaaattgaccccaaagaaacgaaaatattctctcaaaaattgaccgccaaatttaataaatttgtctttgtccttattcgggaaaaaactccaaaaatttaataatcgcatttacaatccctatggcggctttttttggaaaaggtcgggattgggaccccgacaaaaccggcatttaaattccggtaatcctatcccaatcccgaatcccgggcagaaataataaagtttgaaatttctataacatttgcataaaataaaaataaaagtgtgtttagaaaaaagaatttgaacatttgcactattttggaaaaaatttactcagctcaaaaaggcatatttaggttaaaacctttcttcattaaagagtattaaaacaatttaaaaaaagcaaaggataattaacaaaaaataaaataaatttagtaaataattgatcatttanaacatgaaaaaacagacaatttaaacattctaatgtaaattgatggtaccgtgctgngtcgtttcataaaatagattttggagatgaatttt

SEQ ID NO: 33672 - DNA, 819 bp, Heterodera glycines
acagcaaatattcacgagtcgtgtactgcttcactgatttcttcacaatttatccttttgatagcatattatttaatcgacgttttcgaaattatattgggtaaaaattttaaaaaattaaaatggaagatttaaaatttaagtacattaacttcacagtaaaaattgcttataactatgctctaaagcagccgagtttttaattcttgatatcattcgatagcaagtgttctctatttgcttgcacaatttcaaaaattagttaatattcaaaaaagttatgacgaaaattttcaaaaaagaaggaaatttttttgaaattttgcagactgatagagaagagttagtgctatcaaatgtcagtcattaaaaacaaaaagtgcccgctgtgagggccctaagttagaatgttgcataaaagttaaaaaaaaatctaggcctctagctctaaccccctgggctgggtgcttctagaactttttttgccaaaagtatacagttcagtaccaggtgaatgccgcgccaggatttgatctgagcggggggtggccagcgaacttattgtagagctttgtaagctcaattttttgaaattttaaaatttcgaaaattttcaaaatttttcgagctaggcctaaaaaacggttttcgggttcttgaattttatgattttttagcgaatttttcagggaaaacggagaccactttcaagcaacagtttttcgagctctatcgattggtgggatttttagaaaattttcgattttttcccggaaatagaaaaaatttttggcctgagcgggacatttgagtcccggg

SEQ ID NO: 33673 - DNA, 1418 bp, Heterodera glycines
  misc_feature (1358)..(1358): n is a, c, g, or t
  misc_feature (1402)..(1402): n is a, c, g, or t
tgatcatttcttcaaattacttatatttcatccaaataaataaaattattaattgttaatttttcataatgcattttgaagttttggggtgtccagatcacaatgaagaagagatcagaaattgatgtaaaagactttttaatcagtgtaaaaaagaaggcagaccatattttctttaaaaattaaacattatgccaaattaataaaattcaatgaaaaaaaaattccgttttgttcttcagattttgattttcaagatggacagtgaccgagtttaggcgggaaattttgccattttatcaaggacagatcaggctattaaaataaaataaaccattttttttcaagccaaatttgagatttttcaatttgtcaaaaaacgacacataattgtgcaccgaccaattaacattttaaaatgtatttatttgacaggataatgaatttacggccaaaagcagtcaattttgacgatgtgtggtcaaagctacgtgaaactctcgaggcgatcatttctctcaagccaattgagcgtattacctgggaccataattttaggtggatcatttagttttttttcttctattttcacgccttttagcgatatatactttgtttgtgtgagcgttcccgaggcccaatctcgacgactttatacggcggtcaaaaactcgttagaactacacactatttcaatccgagaggttttgccctctgatttgtcatttcatctttaccacattagtctttgctccgtttgtccggtgaccaattgctcagtgcgtacaacagcgaatgggaaaaatttcacaaaggcgccatttatttgcataatctttacgggtaagaaagcgaaaatcatctaaaaaatatataaatttccccttaagttatctgaacaaacaattggtcaaggaaaaaatggacgcggagtcgcagcatccttttgtggtggataatgacagcgacggtttataccctcatttgggagttggcgacgtgaatttcctcttttttaaaattgttttatttcacttttcccattttaattcatccaaatttgaaaatattaaatttctacagcttgccttttcaatttggcgaaatgagttgctcatgccgttggctgctcagcttgtggcccatatcattgagctgctcggtcggattcgaaatggtatctctgcttcatttggcattcgaatttcggacctccgggggcgccgtcctctcttttggtcgatgtcaatgaatccatccatcgggagcaaaagcacagtttttgtgcatgtccattggtatccgacaacagaggtgaggccctgctgaaatccgcttttcatttaaaacatgtcagntctacgaagaaatattcgagaaacactttcttggagcatctganaatactaccgacacta

SEQ ID NO: 33674 - DNA, 558 bp, Heterodera glycines
gtatgaatttcaattttttaaagcaaataaataaaataataataaatacagaacgccaaaagaacaaatacaaacagtagacattttattttacccttgattttatgaaatttttttagcttataactttttcaataatagaccaaacaaaaccattttgtgctcattttgaagggaaaattctgaagaatatttcttaattagtcaaaagtttaaaaaattgtttattggcaaaaaaatgaaccatgtgttattttatatgttagagacatggaaatagtgcgtcaaaatgagagaaaacgaaaaaactttgccctgggaaaaaattttttcctgtgggtaacttttcttgaaattttgcctaagtgaattttttggtcttttctatcgaattctcttttgttttttgaaagtttcttttctaactcgagatcggctcttccatttttacaagggaaaatccccaataaattttaagttttgcaaagttttggcgttctgattactaaataaataataaacttgtttgtacttggagcccaaaattgactcgccgtg

SEQ ID NO: 33675 - DNA, 719 bp, Heterodera glycines
ccatttatcagaagtgtcaaaaaatcgggtgctcattaaaatgtcaggtgaaattacaaaatttaaacatatatttatttgaatttgcattggcggaccaacctggcccggccttgagctggaagtagcccaggttggccatcacaatggtgtcgaacagtgccggctcagcgcgcgtgcccagcacaaattggagtccacgcggcggattgcccgatgggtcctcaaaacaatggccgtccagcaaaatgtgccgaagatgaaacaccgcaacaatgtccttggaggcctggaaaagtggcaaattttgaaaaatttggatgaattctttgatcaataaattttgaaaaaatcactaaaattttcgaagagttttattttaagaaaatttcagtttttaaattaaaaaaatcgttcgggagaaaaacaatgcggagggcgcaccccaatgaccatggtaaaaaaaaaaattaagttaaaatttttccctatgaagcctaggacaacaaataccataaaatggtaaaagatttcttaaaaaatactcatctttttcgttaaaattttgtttttttttgtatttcagaaaaacccagtcaaaaatttttttgaaaattttcagcaatttttggaaaaatttaaattaaaaatcgctgaatttttcaactattctttcttaaaaatttcttataaaaaaatttctaaaacatctcaaccga

SEQ ID NO: 33676 - DNA, 609 bp, Heterodera glycines
tgtggggcacatgttgacactaatttgggattgataggaacgaatattttttcttaggcccatcggaaacttattcaggaatgatgacacaatgacagatgggattttttgggttagactgtcataataaatcactggttcatccattcccttcgcagaaattgcacaccaatgagaccctcccttgtaatgtgggtcccggttcacaattagcgctgcgggatattgtagagtgaccggaggcggtaattggtcactggcgaagcagccccgaaagacttgtgcggtcccccggttttcgctcaaaattgatgtgatttgcacgctgtccattcttcagccaaaaaatagagcaaagttgatggagaaccaggctaacaataagcatcaaatacaatgcgaacaccgcccagcaaacggcttgttggaataaattcccctcttctggtcgatctttgcacaattgaatgagtggtgtgagaccagctgacacttgctcttcaattaacttgtcactttttgggggagaggaggtggtggtagttgatgtgaccgtaaatggaatcgttgttgtggttgtggatgtaagcatggcctttcttcttatat

SEQ ID NO: 33677 - DNA, 1006 bp, Heterodera glycines
agctgtaaaaaaattttggggcgatttgaaagaggaatagaaagaaccaggtttcgatgaagtttttgtaaaccaaaaaaaaatccaaacatttaaaaatctataaaaaaatttaaaaatgagaattcatgcgagattttctggaaataagcttaataggccctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggccttgttaagctgtaaaaaaaatttggggcgatttgaaagagaatagaaagaaccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaaaaatccaaacatttaaaaatctattaaaaaaataaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattactctagagatccccttaatagggcctagttaagctgt

SEQ ID NO: 33678 - DNA, 804 bp, Heterodera glycines
aaaattttataaactgaatatttcggctaaagaaaataacttatctcattttaacgagtttgaagcattcgcattagagaaattatattagctttattttattacttttctatttaccaaagtatggaaattcctaattttacatgatgagacaacaggtgaaaaaataataacaactgttaactatattacattgcatattattatacctattgtataacaacgtattaggtctagaataggaatttgaactaaaatttaatgatcttgaatataaattgtagtagtttttgccagtatcaagaatttgaaaaattatttattctaattgaacaaaatgatcgcaggaattatataattagtattattggtgataatttgatgaatgattgctttttatttaaaaaatagagattattgaataaatttaaaagttatttattattttaattataagttaaaagtttattttattatatttattataaattaaaagttattttatcatttttaattttaatttataaatattattaatttatttaatttaaaatcataagaacttatctgcaaatatttattaattgaaatttaaaaggactttgtacaattatttggaaaaataagtaaagggtacatattttaaagtacataatattaagcaaaacaaaaaatgtaaaacaagacaaaaaataattaattaaaattaataaatcattttaataacaatgtttgttgttcagtttaataatttgtttaatttttttgaaataaaataaatagttaaaataaaaataattatat

SEQ ID NO: 33679 - DNA, 867 bp, Heterodera glycines
tacaggaccagaaactcaaaatttctgggctctaaaaagaaacacatattgataaacagtaaaaaatttttttctaaattttagacatgggtaattccggtttcaatgccccaggcgtttactgtgtgcatgccaaagtttgtggataaatgaatagcggcgattaatggtgcaaaatttgaccagcaatgacaaaattcatgaataacctcgcaatgcttatgaaattcttatcagtattttaataaaatttattacttcgaaaagtgtaaagttttaatgaaattttttctttttttttctctatctcaacttttgtcaagaatattcgaaattcaaattgagaaaattaagcgataagtttactgtttaagctttttttgatttttaaagtaaaatggctaacgatgttaacaaaaacaaaacctgaaatacaccacggcaaagaaacaaacaccaaacaatcccattttaagcaagaaaatttcgccatttatttgctcaattttcactgatttattttccattccaattttattattgtacacattttgtttgttttgtttgtttgtcgtcgtacaaaaaataatagtgcgaaaaatagtgaaaatgaacaaaaagagatttgtcagctcccccccccccccacactttagaaaaccaaacaaaatttgttagtgcaaaaaaagcaacaaaaaactacattttttgttggtaataaaaaaactaattgagaaatgtacatttttaaaatcgatgcttcaaattttcataaagtaagctcattttaatagaaatgaaaaattttcagaattaattcccaaaaactttacaaaatttgaattttgaatacgaccctgccaggcc

SEQ ID NO: 33680 - DNA, 934 bp, Heterodera glycines
  misc_feature (883)..(885): n is a, c, g, or t
ccttcatgcgaaagaatgaaaaattgtgccattttatcaacaaaagttgcaaaaaattgtcttgtgactcgatgattattccttcattatttttatatgcgaataaaaagccgaattcattttgtgccttttgttgcttttggcgccatcccgcaattcatcagtggtcatgagcttggcccacttaattaaattaccgacagcacttccatcatgccaaactcggccataaaaagaaaacacgcggaagcattcaaccgcaacaaaagaatttttacgtttcatcaggcaattaaagttttaaatattaaagtcccttgggggtgctaaaattttagtcatttctggttaacctaaaggaaggaagtgatatgatcacagtggttttatttattttttatccgtatcgaattatatttgtatgaaaaaattaaaccattttgatttcgcaaagttccttatattcattaagcataatctaaaaatctatgtgagcatcattataagtaattaagtgcgcctagtttgtaatgacaatttctcagatccacaatgtctcacaaattttaactaaaactcaaaccccatgaggcagataagttggcttgaacccctcataatacaaaggtctccccgggataaaagcttttaagaaattcacgcatcattctccttcatttttttgttcatccattttttatgccgtcacccactaacggcgccgcgttgtcgccggcaaaattcattcgcataaaagtaagttggcactggcaaaaacaattgcatgatggaatgttaccaaatacaaaaagtgacgaaaacgaaatttgagttttcagcactcgaaatgccgaaaaatgacctgtacaatttcttaagattnnnaaaatatataaaatgaaatcaaattcatgtttttgcagatttcactaat

SEQ ID NO: 33681 - DNA, 840 bp, Heterodera glycines
tgacaaaacgcccaaaatagtgatttttaactattttactgacgaaacgccaaaatagtgatttctagtgacgaaaagtgacgtccaaatgaaaaaattttaacgcagaaatgcgttttttgagctcctttcttcaaaacaattgagcaaaaaaaaagttttttcactaaaagttgctgccctaattattatattataaaattgaaaaattaatttatttcccattctctgtttcctctcttttcatttttttgtttttaaatttaaaaattgtcatataaataactcatcgccgaaggaagcactcgaccctgttgcaataatgttcggactcgatgtcacctacattattctagctgcaataaaaatcatcgaaatttaatttcatatgtttttatcagttcaataatgttatgcgttcacttttctgtatattttcgattattttaaaatgggcataaattttgctcttaattttttactcttttcttaattacatatttaaagactatttaattggaaacatttttatttgaagatttgcggaattaatatttcatttcatacgagctgatatttaatatttattttataggttttaaattttcgatataataaaatgcgtattttaattgggttcatgtttgtggtatattgtagtcagtatacataaccattcctgttggctataattcaacatcaaaacgggagagctaaatattatccaattgtggattacatttagactgatcgcttgggcacatttgtgcataactagacttgcgcctcacgagtataaagttagctgtatccaagagaatattaaacttttgtcgcttt

SEQ ID NO: 33682 - DNA, 1230 bp, Heterodera glycines
atataaaaacgcaaggaaaaactatttttgaaatttttctttataatttttaaaattattcttcttttagagaacccacacttatttgttagtaactatttgaagctaacaagaacataaaatgtcgtaaatttgaattttatttttggttttttgaacatttgcatatttataaaaaaataattacattaaattaaaagaaattaaatgttttaaatctaaacatttaaattattttgtttaatttattaagcaattaatctaaaaatcaaaaatgtcttgaatttttcataaagtgtcctggttttgaaatagtgaataaacaggcgaaaaatttctaattaacgtcatcaaatttatagattaatattatttcaataatatatattcgatattaaacaaattctgccaaactgagtaatttttttttgataaaattattataattcaaaaagaattcatttaattgtataaattttgaaaatattttaaaaccatttagactgtcattgcataaaaatgaaaggatgcttattaatttcttcattatttgcatttttgattaccatcttaattagtaataattatgttggatcagaaaataaaaaattggaacagaaatcatttgatgaaatatttggagaaaaatgggaagaaaaaagaaacgaagaacagaaaaaaagagaaataattggaaaattcaataagataaaagagaaaattaagcaaaaaggaagaaaatattcagcaaaagaatagagtaaaattgaaggaaaaatagcaaaaaaattgtgcacaaatcgccgatatattcaaaaatggatcaaagaattgggattaaatcagagaataaatcattcgagattaaaaactgatgaagaaaaactcgaaattattcgaaaattcaatgaaatgttaaatgaatataaacaaaaaggaagaaaatattcgaaaaaagaatgggacaaaaattatgaagaaatttgtaagaaagtcagagttagccttttcataattagaaaatggagaaagcaattttgaattagccgaaaaataatagcggcgaaagaaaaaatggagaaaatgaaaatttattggcaaataaaaagagaaaagccgaaaatgagtgacaaagaaattggaaaaatgatgaaagttcatagaaataccattggcacttggaagaaacaatttgggaaagaaaaaacggaggaatgaaaaacggatgaa

SEQ ID NO: 33683 - DNA, 1109 bp, Heterodera glycines
cttagggatttgttgagttacagttaaattgtcgacttattaccaaaaaaaccggcaaattctgccatattactgatcactaccatggtgaattttgtacagcattctgtcctgtcagggctctaataaaaatacaaacatttaagactcaaagttattttttaattgaattttaattcttacttcaaaatatattaatatatcaccaaaaaataattatacattaattttaaatatttaattttattaagatttatttaaatttttaattctttaaacacaatatccctttttcttagactgagcataagatctttaaaaatatttgtacttaaaatagagcactgcacgcacctctcataattaataattgtgtgtttttgctctgcgctaggccaaaaaagtgcataaaattatttccgacggatatgtttaatttaaacacactaattttttattgtaattttttttgttgaaattaaaaatcaaaatgtccaatattttcgctttttaacaattgcctggctaattaaaaatgattgggcgctgaaaagtgaattattattttggacttactcaatttttccttattttagctctttgttcctgaaaacatgtcacataaaattgttcctcaataaccaatctgaaatctcaagaaatcgacttttaaattttcaaaaaatttttttaaataaattcagtgtgtaaatttaaaattgggacgcacgtttttcgggaatttggccacttttcgtgagccgagtttttaaatagggccaaaagcctaaccaatttgggcagttttatcacaaaagcccgaccttcgctatgtcttacggtatatgtacttggggttaaatggatgcttgcgtataaatagaatttgtaaaatgtataagttgtgttattgaagcttaaattttttcttttctaattccgcagatcggattaaaaaaagttaccatataaagtaataaatagggcgcgggtctttaaatttttacttattttttctgcggctttaactaggcgagaaattttccagtaaatattttttttttactttaagggaattttttgtaatttattttctttcttatcaaaat

SEQ ID NO: 33684 - DNA, 791 bp, Heterodera glycines
  misc_feature (692)..(693): n is a, c, g, or t
ataaattaaaccgccaaatatttttgccctttttaggttctattatttatttcactttctcggtcgaaaacgagaataaacgacaaatttaatttattttaagggtcaggatcgggatcccaaaaaacaggattgtcccgggcaggattcaagttccgccaaaattgggattttaatctcggcaatccaacccaggctgcaagattccaattccgaatccggacccgtcatttttgtattatttttaaatttaaatatccttttttctattgaagtgatttttaaaatttttttacaatttaattaaaaaaatgcatcccttaaatgtgatttaaaacattgattaattttatggttgtcaaaaacgagcaaacagaaaattttcccacggtaacatttttttattttttaaaacctttccacttcatccaaaaaaaaaattctttttcggaatttctatgatacattaggatgaataagttcgacccaatattcacgaaaaacacacttaatttttctggttggtcataacaaaagtaaaaatgaaaaaaaataattaaaaatttgagtttttgtgatcagttggatgggaatttattaatcgtgaaaatattttttttaatattattaaataataatattactaattgcgaccaatcagtagagagaaatctgtcaatatttcactttannatgtgtaggttttagaagagaaaaatataagaattcgtttttgagaaataataatatcattcattattattgcctttcatttctgtctattaaataaa

SEQ ID NO: 33685 - DNA, 1218 bp, Heterodera glycines
  misc_feature (8)..(8): n is a, c, g, or t
caaaaatnaggaaaagcatcaaaaaattatatatttaatccattgagagttttttcctacatttaagtgcataatttaaaaaaaaaactttggtctccagtttgtaaaagcggggttgagattacgtgccgaactgcttcgatagctcaatggtagagttttggccatgaaaagagtgcttgagtgggttcgattcccacccggcacctaacattttgtccctttcttattattacatgatcaaatcgaacattattataatacacacttttaacagagctgttaatgatttattataataaatctttatgcattttttttttgattttatttgcatatttgtcccaacatattagcataggaatttctttctatttttccccattaactaaaagtggtggctgaattttatttatttttccatttattgcttttggtctattaaaataataaagtgatgatcattcgatcaattctcgtaaataatttctttaacttttttaaattaattttaaaaaaattgggacttttatttacatttttttggattttatacatattatatatatatatatatatatatatatatatatatatatatatatatatatatatatatatatatatatatatatatatatatatatatatatgtgtatatttagacacatagaaaatcagcgccttcgaaatgtaaagaaagtaaaaatgacccgcaagcgtgcataagtgggcgcgcgcccatgcgaatgcgatgcgcgcgtcggggcacgcgaatgcaagcgcgaatgatcctgacacccggcgggggaagagacgtaaaatattgccgtccttcgacctgaagcagacaggcatctaacaagcattgattgtgaatataattaattaatcgtgtattgtcgaccgctgccctcccaatgtggtgcaattgcggaactgttcggaggagtcaaataactgaacgaaatgtccatttggcgagcagacaagagaactgaccattttgcaccgacaaacgaacagaacaactcctgcacaacatcgcacagataccaaatgtttgtcgtcgtagcactgtggtcggtcgaattgtgccgcccgtccccgcccaaaatgtcccccaaacggcggcggcagtcgctcgttcaccgtcggcacaatctagggggccgtcggcacatcattttcatatagagaccagttcacatccgtgcc

SEQ ID NO: 33686 - DNA, 653 bp, Heterodera glycines
agaagaggggagagagagagagtgaaagggggaaaggggaggagaaaagaagggagagagagagagaatgaaggggggaaaggggaggagaagaagggggagagagagagagaaagggggaaaggggaggagaaaagaagggagagagagagagagtgaaaggggaaaggggaggagaaaagaagggagagagagagagagagtgaaaggggaaaggggaggagaagaagggggagagagagagagaaagggggaaaggggaggtcaaacttatcgaagattgattgtgatagtacggttttgtgagacgaaaacaaatcgtgatagggaacgggagaatgacacttatttgcacaccgaagaattaatagaaaaatattcataggactcttaggactggtaaaagttggtatttcttttcgggattctcgagggtttacgacccttcgtttctccctacctgagaagaatacgcgccattatccctcggccatttggagcaaattttgtgctctttctaatctttacaatcgccttccccggaaattttttccaggcatttaggaatttattagcatgctttctttcacattttatccagcgttacaaacttatatggcgtcaaaattttgagttttatcattgtgaaatcc

SEQ ID NO: 33687 - DNA, 1008 bp, Heterodera glycines
ggacattccaaagaatttcatgccatcaaaatgcccattgttaagctgctgctgtccgacaaggcgccgatgcgttggacaaaacgacggtgcgcatgcagaagatcgcaacggcttacggcgagctgaacgagtgcctgaaaaactttgtgaatcgggtggacccgaagtgcgactacgtggtcaccagcccacagctaatcgaggctttgctcggcttggaactcagcgacaccagcacaattggcactttcaggaggtaaactgtgagaatttttcgacccaaaatctcagaataaattctcgggtctggaaaatgccgactcttgaggcgacttgtgtatagtattagccctaaattacgtgccttactcctccgatcactgatcaaagcccgggaggggatttgttcggcgaatctcggcgagcgataccgtcatcgtgttgttcccggcaattgttattttggctttgttcggtttggccattatgccctttttccagggaccgctccgagtgtgagtacagctccgcctttctctacgagtgagcactgctctccgctgagttggccctgttctgtttggtggatttgttctggcgccacagattgctcgccgcctttgtcacttttttgctgtccgccgccgttcgccacacggtcaagctgtacttcacccaccaattggccaagagcagcatggtggacagccgatttctgatctgatcagaccacttctgctatcagaattgctgatctgccctctttaaattgcagtcccagttaatgggatgtgtcaaactaattgatcaattatcacttttttattaattttaaatacaatagataaacaatcagttaaattccgagtttccaaaaaggaaacattttccgtgccattttcactgtttcctccggcgttctcagccaattaatggtcacattgattttctgcatttgatcataattgccattgatcagttccaactgttcctttgctgtgacaa

SEQ ID NO: 33688 - DNA, 647 bp, Heterodera glycines
  misc_feature (6)..(6): n is a, c, g, or t
agttanagctgtaaaaaaaatttgggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaatgagaatagaaatagccaggttcgatgaagttttggtaagccaaaaaaaaaatccaaacatttaaaaatctattaaaaaaataaaatagtgaagttttaaaaattaataaaaatttttaaattaagagttactggcgttagcatcatagcggtgcttttccttgtctttttgatgcccttgcaaaatctggtgcgcttctgatcagtttatataaaaaaagttaagcctaaactttttggcctgtttaaaaaggaattaaaaatttttaaaaattttattcatctccctttttgataatataagagtcagagtgcctaaactagcatgtaaataaaatttggtgcgtttcagaaccctttctgaaaaaatatttaagaattaattttgcaaaaaataaataaataatgaaccctcctccttaataattttcctgcgcccaaggta

SEQ ID NO: 33689 - DNA, 203 bp, Heterodera glycines
  misc_feature (8)..(9): n is a, c, g, or t
gcctgcannggtccggacaataaaataatttattaattccatttttaatcattttaatatcaatcgccaaaaaaaccacctatatagtaagaaataaacttttaaaagtctgagatttctatataatttaactaaaacaaaaattgacataatttaaaaatatattgatatatttgaaataatgatgcatactattgtgactg

SEQ ID NO: 33690 - DNA, 953 bp, Heterodera glycines
catttcaatcactgggactcaacccaccagcatttcaatcactgggactcaactcaacagcatttcaatcactgggactcaacccaccagcattccaatcactgggactcaacccaacagcatttcaatcactgggactcagcccaccagcattccaatcactgggactcaacccaacagcatttcaatcactgggactcaacccaacagcatttcaatcacttgaactcaacccacagcattccaatcactggcactcaattctcctgcatttcaatcactgggactcaacccaccaaaattcaatcactgggactcaacccaccaacatttcaatcactgggactcaacccaacagcatttcaatcactgggactcaacccaccagcatttcaatcactgggactcaacccaccaacatttcaatcactgggactcaacccaacagcatttcaatcactggtactcaacccaccagcattccaatcactggcactcaattctcctgcatttcaatcactgggactcaacccaccagcatttcaatcactgggactcaacccaacagcatttcaatcactgggactcagcccaccagcatttcaatcactgggactcaacccaacagcatttcaatcacttggactcaacccacagcattccaatcactggcactcaattctcctgcatttcaatcactgggactcaacccaccatcattcaaatcactgggactcaacccaacagcatttcaatcactgagactcagcccaccagcattacaatcactgggactcaacccaacagcattccaatcacttggactcaacccacagtattccaatcactggtactcaattctcctgcatttcaatcactgggactcaacccaccaacatttcaatcactgggactcaacccaacatcatttcaatcactggcactcaacccac

SEQ ID NO: 33691 - DNA, 873 bp, Heterodera glycines
ttatgtaaatgctttgctattattgaaaaaatagaatttctttaattctgctgaaatttaaaaattaaaaccaattaaaatttatttattggaatttatataattatgattatatttatttacaaacgattgaaatttatttattctttatcgattctacttgccttgtataaaattatatgatcaaatagaattaaatttataaaacatttatctaagaataattgctgcaataccatggagaattgcaacattatttaaacgaataatacgcatttagttgagcttcggcacaaaagcaatctgccatatcggctcagccatttcaaaccaacgaacatgcctgttttcgtatgcacagaaaaaatttgtgcgaaacttggaacagaaagtttctaaaatttagaaaaaacaaaaatatagggatttgattttaaaacaatatggacaaataatataaagtcctaaaggagtatgctacttatgatgttatataaaatcttagaaccttatttgttaaatgaataacaatttaattaataaatttactaacaaaagaaaataaataaataaatttcaattgaaaaaagtagggttagacgggtccgggtcccggacccggtttttaaaaagaatatttaatttttattgtaaaagtaattcatttattgctcctgtggcctagtggatattatgttggattcatttggtatttctcaggtgtttaatttttttttgcaatatccccataagaaattttgaaaatttaaccctatatttcttgaaaatttgaacatttttggtagaaattctgtaaacatattggataaaaccacaaaatttggtcattttttaataaaatctgttaacaaa

SEQ ID NO: 33692 - DNA, 986 bp, Heterodera glycines
  misc_feature (973)..(973): n is a, c, g, or t
atttaattttcataaaaaaacaaaagtaatatttcttgattccatatatttaagtcattattaaaaaatgacgctaattgaattttcctcaaaaccattggggtgacccttttgtattagaaattatttgccataataatttttacgcaaacttccgcagggattttgagtggctgatcatctccgaaatcatttttactattctgaatccctaagctaaatttgaacaaaaaaccgaaattcggtaaatttgaattgccaatttttcgagttgggacccggattatgaattagtcaaattgatgttaaattcgtgacaacgagcgaaacccctgacaaaatttgttttttttatatttctttactttcttttgataagccatcttaaaatattttgtttaattttatatggatactgtactgtttttattagttaatttattttgcttcatttctattttttaatttgttgtttaatttttcttcgattattttgaatgcatttgtgcctcaacaacagcttgacacatactaggataatctatatttttattcgtcaaattttcaaaagatcattttattacatttaaaaaatttgaaaattttttacattaatattagtggcattacgtttaatcactttaaaatataatttaaaaaggttgaaaaaatcctataggatacttttttttatcaaatttgttaacattaagaaaaattttttgtttatttgagaaaaaatcattcagctacgaagtttaaaaatataatataattcatttttttcatttatttgttattttttcagtttttgcctgaatccaggtcccggggagcctggattcttttctctcttttttctatcactttaattgtccggtacttcagtctttcgcgcacaaatttaattttcacatttgaacttttctcccatatttttagcaaatttgattatccaaatttattttttaantttatttttaaaa

SEQ ID NO: 33693 - DNA, 850 bp, Heterodera glycines
  misc_feature (693)..(693): n is a, c, g, or t
ccccctcctccgcttccgcttcctccctccgatggatggcaaaacagcaatttggtgggtagcagaatcaaaatgacaacgcgaataaggcagttggaagaagacagcagcatttcaaaaacaaaaaagttaaattgaaaattaaaagatatcaatccgaccgagtttaacaaattaatttgatcacttcaattattgcctctctctctattgagtacaataatatttttatttaaatattattttttctgatcactgacgccttacaaaggagaattttcattggacaaaaacggttaataaatttatacaaaaggcgtataaaaagacaaaatgactacaatttataggcggaatgatcacagaatttgcgggggaactaatttgtaaggttaaatattgaaacgaaaaatgcaaaaggacagaaagaacaatgattaataaaattattcataaattgggctggcaattatgtaaataaatattttttcctggattattcatggtctaaatagtaggaaaacattttcttttttttacatatttcggggttttatatatatttggtatatatttttgattttttaacattttttaaaattttttgagaattgataagaaattccttgtgaaaattttaaaaattttggtttttttcaaaaaaggagataccaaaaaaaaaataatttttanatattcaaaaatgtgattctaaggctatttaggtcattttatggtattttgtgcctatttcatcctttgcaaaaaaattttttccaaaaaataaccattttcaaatttgcgtacatattttgaccactttttgtacatatttttgccagccctatta

SEQ ID NO: 33694 - DNA, 822 bp, Heterodera glycines
  misc_feature (10)..(11): n is a, c, g, or t
atttccaaanntttgttttggtgttatattatcaatattggtagttaatttatctgttttactcatttctcctatttataaatacataattaattttgcttctaatttttgtaataatataaaaaaactttgtttaattaaaatttaatttactacattttctttcccttattaataatttttagtttttattttagcaaatccattaaaataattcacaatagattttaaaaatatttctataaattatcgaaatgaccgcaataaatattttaaatctggttgtttttattccgtgtaaatcggcgcaaaatcatgtcttaatctgacgccctaaaacgctttttcgtgctttaattttttcttaagcttttattttattgctttaattcttctattttttgtgtataataattaatttcactttctcaaattaatattattgtgaaacttttaataaaccgttagaaatggatttttaatattttgactttgattagagtcatcaatttaaaaaggccccggctcgagcttaaaaagtagcgagtttttttattttaattttttaacagcttcaaattgcttcttaatccgaagttaattactattaaaaatcttttataatttaataaaacattaggcgcatttttaaaagagtaatcgtaaatttaacaaaggtgggacttggggccacaaaaatttcctcaataccgaatttttatttttgcggagccattctccaaatttttatgtgagaggatggttgacatcgaagaaattttaagaatttaagtgtaattagaattggccttttttaattaa

SEQ ID NO: 33695 - DNA, 899 bp, Heterodera glycines
atatggctatacctgttgtcggaggtagaattaaaaacaatattatttctatatttttattcactataaaaggtttccatagcaaaaataaattcttaatgatttttaaaaataatatcgtgcatcataatggcacaataaatactgcagattaaatgcggggcctgatgaacatttgatctagttcatattattattaactctatttctcgttacaaagtaatttttaaaaacgaaggaccaggtaaattcaaattttttactcttttctaaaattcacgacaaagcctaaaatcattttagaaaattaaatgatatggctatacctgttgtcggaggtagaattaaaaacaaaattatttctatatttttattcactataaaaggtttcaatagcaaaaataaattcttaatgatttttaaaaataatatcgtgcatcataatggcacaataaatactgcagattaaatgcggggcctgatgaacatttgatctggttcatattattattaactctatttctcgttacaaagtaattttcaaaaacgaaggaccaggtaaattcaaattttttactcatttctaaaattcacgacaaagccttaaatctttttagaaaattaaatgatatggctatacctgttgtcggaggtagaattaaaaacaaaattatttctatatttttattcattataaaaggtttccatagcaaaaataaattctaaatgatttttaaaaatcatatcgtgtatcagaatgacacaataaatactgcagattaaatgcggcgcctgatgaacatttgatctggttcatattattattaactctatttctcgttacaaagtaattttcaaaaacgaaggacccagtaaattcaaattttttactcatttct

SEQ ID NO: 33696 - DNA, 927 bp, Heterodera glycines
tgtgaaatggaaatgaaatgatgggattggacaaaacctttaactcgaaaatgagatttcgagatttttgaataaccggaattggacaaaaacaaaaaaaaatgtgaaatggaaatgatatgccgagatttttcggacaaattcaaattgggcaatttaaatgtttgactgttcgaagatgagacttcgaaaatttcagtccaaactgaacttgattgccttttttgggaggaggtgggaacggaaattaaagcactgattaattctggatgagaccagattaatcagacaaaggtcgccagttgtccggagcacgtcttggtagatggggttggccggcgcgctgagacgtgcaccaagacagtgcactcaattggtcctcgatgcgtcaattgtccgatgcgtccaatgtccaattcgatgcgtccaatgtccgaattcgatgcgtccaatgtccaaattgccaatgcgtccaatttccaatttgttcggctcgtccaatttgcaatttgttcggctcgtccaatttgcaatttgttctgcgcgtccaatttccaatttgccaatgtcagatacttttcacttgtaaaaggggaaagcaattatgaaattttgatgagacaaaattaattgaagtaatttaggctggaaccggttttccgccaaaatttgaaatcgagcagtttagttttgtgtggcggaaaacttgctcagaaaacctccggtttgctggttgcaaaacacaaatttcaatgaaattccaatgaagaaatttaatttcaaaaatgtgatgagaattgcaaaaaagcggaattgtcgattaaaaacaattttaagtgaataatgtaagagagcgatgggaaaaaaatgaatggcttaaatatggcggatgagaccgccgtcaatttgcaagagatatgtgtcgga

SEQ ID NO: 33697 - DNA, 882 bp, Heterodera glycines
catcttattttttggattcagggagaaatttagatttttattgataatttttgaaagaaatgttttttgaagcgaattaatatgcaaaatcttaacaagattcagttaaatattcaaatttttctttcttattctcttaaaaaattagctcaaaatcgtaattttgtcattttttgaacaaaatcgttaagaaatcgcattaaaaattacaaaaatttttccggcggcgcctattagagcaggggtgtatctgttcttatttctaagaaatgttctgatttggggtagtgtcttattttcatttaaaagaggaaatttctgaaaaatttggctattcctaacaaaattcattaaaaattcttaaaattttcccccagcggcgcctatcggcaccgccggcctcccaaaactcctattttttcttaaaaattagcccaagatcgcaaattttggtcattttttcggacgaacttgttaacaaattgcattcaattaaaaaaaaatttccctcggcggcgcctatcggcaccgccgaactctcttccctcacccatacccaaaacttttcggaaaaatgcgccgaaaaaattgttaaaaatctgttttttttattctaaatgcactgaaatttaccaattgcttatgttcgacaaaattgttaaaatcttataattgattttcggaaatgtataaatttctcatttctaagccgaaattgctcagaaaatagttggcggtgagtaatgcttgattttgttgaataaaaaagcgattcaaagttttggaagcgtgttttaaaaaatgtccttatttttgaccctaaaatcttatttttgaccagcgatgctcttatttcgggaaaattttgaagggtaaccctga

SEQ ID NO: 33698 - DNA, 1282 bp, Heterodera glycines
tttgttaccaggatgttcaatgcgccagaccagttcgccggcctcaccatcgttcccaatgtacgcgtactcgtcccccttgtccttttccgtcatccgttgcacgtcgcgggacgaatgcaacagactctgataaccggtgtaaacacgttgcccgctgaaggacggcaaaaaatttttttgtattgtaattggggataggtctcaaataattcttcgattaaaataaatttttcttttaaaaaaatttatgggaaaattgggtagattttggtcccttaccattttatgcaaaaccattaaattttaaaaaattgtttcgacaaaaggcgctcgaatgaaagttatttgaggatataaattcaatgaattgttgacaaattttttgggatgtttggacaaatgataaaaccatagaattatccgatttaatcccctctaaaagagatttagaataccaaaaaaatagacaccaattttaatgcctaagtaattaaggtaatttatttctgacatcaattatgatgcacttgcctgaagttgaacggtcgaacatattggtcacgggcacagtcgtacttgagcaggaagcaacgagcggcggacaattcgtccgcggacacacccaatttggacaccattttatagtcaacagcagtggtcagctgggccatctgtaaaataattttgctaaagtatcaaagcgattgaaaaatcgcatgtaatttttaattaacctaattattcgattgtactaaaaatgtaaaattttaagacaatgttaaaatacaaaaaaacaatagttaaaaaatataataaaaaaacaaaaaaaatagaagaattggaagaaaaaaaataaagaattaatgcttgttcgccagaaaggtcggatttctgactactgctcttagttttattttggtttctcgaaattcccaatggatcatccattaaaagtattcccgtaaccataaaatttaatgagcatctctatatattgatgtacttttgaatgattataattcaataaaaccaattatttacctgttttgtaatctgtttttcctcataaacggatgtgattcgctcaagctgtctgatcagtagcagatcaatcagttgctcaaagtcggtgaggtgctttttcagtgcatcggccagctcaataccgtacttgacgcggaccaattgcacggtacggtagcgctaaaaaaggatttgtaattatattttaatgttattgaaattattaaaattatttattttataattttcaccattg

SEQ ID NO: 33699 - DNA, 1151 bp, Heterodera glycines
  misc_feature (10)..(10): n is a, c, g, or t
  misc_feature (65)..(66): n is a, c, g, or t
agtaaaattntaaaaatagaaaaaaaagatttattaaaaaaaatttacccagaaaaaccttaaannaatgtgcgatattcacaatcatacaataaaaagcttaatttctaaataaatttcaataagttagagaataataacgttaaaagcaattgaaaaaattatgaaaatgagcactcaaaataatgcttcgaaaattttgaaattcttatcattaaaatagaatttaagagaaataaataatggtttctcaaattatatgacatttaacttaattatgtgcatacatttgattctgagtttcgctttatttcttctcgtccttctaatggacatgctgtgggaaaatgaacaaaaatgtgccatttgttcattagtaaattccggcacatgattttctcaaggttttgccataattttcacacgttaattcttttttttagtacaaacgaaaataaatttgataagccattcaatggttttaaaaggtgacacggaaaagcacaatttggggatttaaccaaataataagcgaaatgaaaaatattttggtaaattgcgtgtataattggtacatctcaatcgcccggtaaaaagcagaaaatgtcgaataatttttttaactttaaaagtaaatataattattaattatgaattattgatattttaatccgaatttttagtgcatgaaaaaatgattaattgttcgtaagtttttgcgtgatgtttacgtttcttaattacgccatcctagttaataagttattttttaactttttttcatggcttttttttgtcataaaacccaagaaggcggtgtgtaaaccttttgcagttccttttctttttcttattataataatcatttacgtttttttgcttaatttcatagtgatttaaataattgcgtattttttggtagcatttttgaaattgggcagtaccgtcgggagaaatgttggcattcgttaaatattttgagacctattgtccctaaaaattgccgtctgagttagtcacaacagaagcatgcagtgaatgttgctattctggggtcaccttttttcccattttatcccgccgtttaattgtcttatctgctcttttttctcggtgtcgttaattgctttgctttaacactctcttaaacg

SEQ ID NO: 33700 - DNA, 960 bp, Heterodera glycines
  misc_feature (938)..(938): n is a, c, g, or t
atttttgaatcgcttttaatcgtctcttttgcgtccttaatcttcactctgagccgagttactgcggtctaaacacgtttttggtagaatgcgggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagcgagttactgcggtctaaacacgtttttggtagaattgcggccagaatttaaaaatacagtttgctatggcttcgcatcacccgcttcaacgggtgctcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccangaatttaaaaatacagtttgct

SEQ ID NO: 33701 - DNA, 956 bp, Heterodera glycines
  misc_feature (914)..(914): n is a, c, g, or t
  misc_feature (942)..(942): n is a, c, g, or t
attttggtttctttgtgtttacatgaattcgaaaagcgtatcataataccaaatttcgaattgcctatcaaaatagaaatgagtcgttagtccgctttacctggtccaagtcgccctcctccgcctcgtattcgtccggctcgtcgtcttgcgtctccccgtccgaatcggagccgacgtcgtcgcccgacaaagacgcttcgtcgtcgaacagattgacgctaaacaaaaagcaatgtttgctttggtttagctgtgaatggcatttaaattcacagttttctgttggtggccgtgtcgtccgttggcttttccttttgctcctttaaaccatccgctggcactttccttctcaccaatacaattccctcatcccccgactcatagtccacttcttttcccatcatttcttcctcttcctcctcgtcctcttcttcactcatttcttcctcctcctcctctgtcaccactccttccttctccaattcttcgttttcatcgtcattttcctcttctgcttcattgttctccacttcctcctccgccgcttctttttcccattcgtttccctctcctcctccgccctcctcattttcctcttgttccttctccccctcttcttcaaaccgttcattttctgcattccacaattgccgtcgccgtttgtaagatgccatctgtctaacttcaatcattttagctaaccttttcttctcttcattataacctgtttttgaattaaaatgttaaattatgcaatttattcattttatcttacttttcctcctttgtttgccttcgtaatttctaaaattaaataaccaatcaaatttttgtgattgtaatccgtccttacttttttttccgctcagaactttgaatggacgggcctaatttgcggtggaaccattggngtcgtgcattcgaacactcggagctgcnggaaacgctttttt

SEQ ID NO: 33702 - DNA, 930 bp, Heterodera glycines
  misc_feature (764)..(764): n is a, c, g, or t
  misc_feature (880)..(880): n is a, c, g, or t
agactggtgatgaggtgcccatggaattgactgtttcggcctcacttcctccgacgctttcttcggaaaaagagggagtaggcacaagactcatggagtgcgaaacgatggaaggcattcgacaacagcttcctcaaggcgaacaacacattcacttcactcccacgactatgacggagatgctagcgactattgggcaaacgccccgaaatgatcttacggcatcaaacggtaatgacacggaaagtgcccgtggagggggatgcaccaccgatggcacgtcgactacaactcccgcttctaacaacaacgacccatcgagtcactcacaacaacttgcatattcacccacaagcaaatcactaaagcgggagtttgcctttggaaacaacgcattccattcagctaacaatggcgaccatgctctaataacggttgggcacgttgacaagcgatcatagagatgtctcagtttttttctttttttggccatgacttttagcggatttttttaattttaaaagttattagttatcaatcgctttcgaaaaaaacaaatttatttgcagcaagaaaaaccgtgtcatgtacaatcgaatgccgacgaacccccagggggcacttgtgtggtcacaaatgtgatgccaaaattgattgggcccattcccgggctgaacaacggcttcaaagtcagaaataatgcagcggaagaggaggaactttcaactcgaagttgcttaaaatacgggggaagtgtttctgcnaaactttgctggtggtgctcaggtgacggattcacttccttattggtaccatttttgtccgtaaatttgcagggaccttcagggacaattttgccttacttttgccaacaatgcgnaatcgccttcaaagacgcgtgagtttccccctcaaattgctatttccttt

SEQ ID NO: 33703 - DNA, 948 bp, Heterodera glycines
  misc_feature (826)..(826): n is a, c, g, or t
aaaaaataaaaataaataaattaaaaagaaaaagtcaaccttttatcgaactcatgacagaaagaaatgtcaaggttgatgcaccgaccaatacaccatactacactctttatttaaaaatttgtgtaaaatgattaaaaaattcaaaattttgtgttaattttttgctttttctcccacgaaaatgccattgtttattttaaaaacccaatctttaggggtgtacttttttttcgcttaaaagccaaaaagcgaaaagcgaaacttgcaacatccccgataagaacctctttctgaattagtcaattcattttttaaaaggttcaaatacttaaataattttggaaaattacccaatccataaaataaacatactgtaatgtaattggtttattgtaagtttctttccattatttaataccgtaaatagaaaaaagaagtcccttgagaattcagcagaaaaggccggcaaagggtttaaaacttttttaggccttaccgtgtcgacaactttggcaccgccgttggcaccgggacaattagcaattcgcgacaaaatgccaagaattcgcgaaatccaaggagaaccgccaaaggcagaaacaattcacaaaaaaggcacaacaacaacaacaacaaaatgccctgctggggaaaaacttaatggcacaacaaaaaacgaaaatgtgatgacaaaaaggccacagaaagcagccgtaattcaccgaaaaaaaagtggcggcacgcggcgaaagacggcacggagaaaaacgacggcacaaatgacgacaacgacgagaacgacgacgacgaaggcacatccgcncggtggtggcacaaccgatgccccaacaattcgcagttccgcagggattggcattccgaacagcagcagcactgatcagacattgatcgggaggagcagagaaggacaaacattttgatgag

SEQ ID NO: 33704 - DNA, 1437 bp, Heterodera glycines
  misc_feature (150)..(150): n is a, c, g, or t
gaactctccaaaaacatggtcgggcgaatgtcccttgcggcgacgtgctgaacgtttgcgaggcatagcaaattaattattttgcttttgaaaaaagaaaaagaaattatttgttaaaattaaatacaaacgtaaggttaaaacaaaatntaaagtcatcaataattgaatgatatgatgaatggacgaaagaaggacgaaaaataatgcctaatctaaatatcgcgctggtttgttaagttttgtacgatttcttaaagcatattgaggcaattgtgttggttcgcttgtatcattctctatgttttgagtatcactaaccaggtcattagcatggttttgcgcaggtaactctatttgttcttttataataattggatgagaatgaccaggtaaatcagcaatttcttcgctttctgcttccacaagagcattattttcttcgggactaagccagggagaagtgcaagctggtcctaggatttcaacgcatttcttaagttgattaatgtgaacgcggcgcgggttgctttggggcgaattgcaacttacaatggtaacataaataccgtcaattttaattatcctaaagacgcccttccacggcaactggaattttttggatgtatttatttttcccgcataatttcttagcaaaactctatcaccttactttagcttaggcgttctcattgttttgtcatactgtattttcattttttcttgtgcatctgcatgcacttctgaggcacttttccacgctctccgaagagagatcactagtttttgtttaaattcagtttcgtcagtaaatgctatcgggtctctaactttagggtctaaaatttgatctatgcaaaatatcggatcgcgcccaaacattaaaaaataaggggtctcgttagtagaagaatgaactgatgtattataacaaaaattagcataatcaaggaattcgtcaaaatctggctgttctttcgtaatgtacttagctaaaatattatgaaaagtcctaaaggtacgttcagtcgcagcattgccttgagaccaatgggatacagcatattttttatttatatataatagtgaacaaaattctcggaaaaactccgatgtaaaggcggtggcattatcactgactaattcagtgcagccaccaaattttaaatagcagttctttaaaaaggctatcgctattgtgtgtgatttagcgtcaggtaatggtaccgaaatgacatacttacaaaaccagcaaataatattcaaaatatatttatttccactaatagtcattgggaagggcccggccaaatcaaggcctacgcgagcaaataaagtatttgcgggaaccatttgcatttcagctctaaaagctggagatggagaatgccttaattggcaagtaatacattgtttgtaccaggataaaatatcaga

SEQ ID NO: 33705 - DNA, 960 bp, Heterodera glycines
ttgttgtcatttattttgttggctcaccagcaggctatacacctaaggggcttcaatttaacaagcccacttatgagggggaggggcttctaatggaggggcttttattttgaaccctttttaagaataacaaaaagttttaaaaataaacttctcgtttttactttttattgccgaatttttgtttggttcccagccatttttattaaaatatttttaatttcttgttttttgtgaacttttattgaaaattggggaatgatttgagaacaaaaatctcgcgctttggtaaaactcaggccaaactattttattatgcaactcaaaatgcaaaaaaaaaagtgagaatttttatatttctttttacagttcgacattccaaaaagttaaaaaaaaattaaagtcgtcaagaactttcgaatgataataagaatttaaaaaattaattaacattgccataaccacagggctcggatttaattttttatatgtttttttttgttgttgctaatattttatcgcatgaaaagctcaaacttagctttttacgagttttcttttcaatcagagcgattttttataaaataaaaaacatattttggacattctattaataaaatattttggctcatcttttggcgatttaaaaaaattggctttttcaaaaataaatttttggcactcaaatccttttgtaaatgtatgttgaagttaaaaaaaccaatgcacaatggaatctttaatgttttggatggcattgtgttagcaaaatggataaataagcagacttttttttgagaaattcacttattttagagcagttttgtttcagtttttggcacatatttggcctttttttggcgtttttggcacatataattcggccctgctggccataatttagcgctgcttaatgtttacctttttcatatgtgtcaattctctgtccaattcattgtc

SEQ ID NO: 33706 - DNA, 1037 bp, Heterodera glycines
aaaaggaaaggtcaaaaaatccagacaattatgccggttgattcagtataaggccaaaaaagggagagttgttccacatggacacccgacaaggtgtcccctttatcggcattcatttttgccaaattaaaatttcagttagtgagatttcaatagttgcacaacaagtgaacaaattaagcatcaacaccgagtttgtgctggagaaggttgcacaaagtatttgtgcaagtacgtgatgaagggagcggacatggccttcatcgaagttaagggcgggccggaaaagcaacagaaggtggattacgatgagttccatcaaattcgccttgctcgctacatcacttcaatggaggcctttctctcgctaaatgggacgaagcttgtgcgccgttcacacgaagtagctctattataacaataacaatgtaatattaattatgataaggtcgatgagctggatgtgcatggtccaagtggacaccggattgctgtggaatttggccttaaagatgaggaggaagacttgaatgcagtttgtgaagcagcacaggcggaagaagaccggagggcaagaggcgaagagcgcgtgactcagcttacagcgtactttgccttcaacaaagacaatgcaccgcttggcctgacatatgcgaagtgcaacaaaaagttgtggtacgacatcgcaaagaagcagtggaaaccatatgtgggccgagttgttccgaagttctgccgactgaagactgtttcgcctaacaatcgcgaactgctggtgataaatttctttctttcagcattagtaatttttcttaggcaattcgattgctccttttggtggtttgcgacccaactggctgggaagcactaaggacgcatgatggcattgtgcacggctcattcgttgaggccgcaaaggcccggggtctgctcagcgacaatgatctgtggatgaacaccattacggatgctttccaaacaaagaagtccatccgccagagaatcagatggctcgctgtgttcttcgcgactgcaaa

SEQ ID NO: 33707 - DNA, 683 bp, Heterodera glycines
  misc_feature (28)..(28): n is a, c, g, or t
tgacggagggtcgaaatcgaacaaacgnggggaaacaaacatattgccaatcagcgaaactgtattttttaatttggctggcaatgccaatggaaaatggcctatgcgcgtacttaatgagttggcttgagaattttaattggctaaacttttggcatttggtactgatttggccgcaaatagcactgaataccgtaccaattaacaaaatttaccaattaacaaaattagtgatgtatcatgaaaaatgacattaaatgacggctttttctataggtgaaaaagccattgaaatcccaaatttatatgtcgtaaaccgttttcggagaataatcggccaagggacttagccaacatttagctggctttatgatgtcagttttctttggcataaaatcggattttgggggcacttgagaatccggtgattatgacgaagcattcagcaatttatccgatttagcgaaaaaagaaacaaattcgtcggccaatggctcctttttataataaatttggctttttcatcttcaattacatagtccttcacttaatgaggtgtcctaatcacttttgtgcctttgatttgtcctttttttgtcccttttcccattttcccccgattaatcactcttccccccttctgcggatatgctatgaagaaatgagcttaaaaatagcatttc

SEQ ID NO: 33708 - DNA, 934 bp, Heterodera glycines
taaaaatgggtaaagtaaataaaattatagagtggcaagatttcgtatttttcatgattattttttgaaaaagatttgactataaaatttttacacgattttttaaaattttttttcgaaaaatagtgggacaactaaagtaggtatatgccattttttcattttatttttcattttgcttcacaattattaaaaatatgcgatttacgcaaaaattagatcgatttttacacgtattttgaaaaaaattttcaacttttttgttcgaaattcggatcctgggttcgaaattgggaaaatcagagtccaaattcataatcagcaccctcgaagaccccggaaactgatttatgcccaaaataaaaaagttaaagggacccccattctttaggattgccttttttgtcagaagtgcttctccattttttagtcaaaatcagatcagagactcatttaaaaacctatttgttttcaactgatgcaaaaaaaaaattagcaatgggcaaaaaatttctcgaaaaaaggtgtaaaattaaaattttgaaaaatttttttaaaccatgaaattttgaagagagttttttttacagatcagttaatacatatttggcaaaaaattcttgggggaaagacgaaaaagaaaatagtgttaggaaaatgacagagaaagaggcagacgatgagagtgtacaaaagagcgtgggctaatgcaccattataacaaatacagagtcaaaaaaagaacccaaagagaatgccaccccatccaataatttatcttttactagtattccaaacaactccattgtttggtgcctgtttttagtgctatctcgtttcgtaaatccgccaatgtgggcattttgtaaatccgccaatgtgcccattttgtaatccgccaatgtgggcatttcgtaaatccgcccaatgtggc

SEQ ID NO: 33709 - DNA, 957 bp, Heterodera glycines
tttctgctttaatttttttgttttagtgaaggtttttcgtggtttctggtagtttttaaggcatattttagtgcatatttgagcatttttcgggtttttaaggcatatttaggagggttttaagcaaattttatgcacatatttggaattttttttagtgcatacaacatatcacccaaataaatcccttttatttaaataaatataaataaatttccaatcttttcagaatgatcagtcacacaaattttgtgtgcacacccgcaggggagattttgttaaaatgatgttgggactcgaagaaggaacctacggagaaaggaattgatttcggatttgaatatttaaaggtgattcaaatgatgaattatctttcttaatttttaattaaaaatttaggaaaaatttgacaacatttccatttctgttgttttgcttggagaagacaaacaatttttggcgaatttatcattcaatcagcaggcaaataaattaacataaaattaattaaaataaattccctttctttttttgtcttttgccaatgtttacgtgccgaaaccaatgccaagggctaatgatttggcttttgccgtgttgggatgcgattctttgtttatctcggctcagacatcgacattttcttggttgattgcttatttgatgccggacgatgcgaccatttttttgcaattccgattttcttccgggtcagctttttttattatttcgttgaattttaaacaatgagtaattccgttttaggtcatcatacacgggaccattttttgcctgaatggattccgatcaaactgatcaatgacataatgactcgcgattatcaagcggagtgaaatggaagcgattttgaaaaattgttttaatggaagctggaaaaatgctaagaatgttatcccacaaatttgtacacaaaaatttaaatttgttatgctgatt

SEQ ID NO: 33710 - DNA, 1182 bp, Heterodera glycines
  misc_feature (1068)..(1068): n is a, c, g, or t
agagtggtcagacatgatgtgggcgtgcgacgatgccagcaaagcttgtgccagtgcgggaagtgagtggttgcgcacgcgggtgtgtgtgcgttgtggtgttgttttgcagcattgtgtgttggtgagggtggtcgtaggtcggaagtgtcagtgtcgtctagtggttaggacgtgagcttaacacgctcaagatcgagggttcgatcccctccattgatacttttgtccttttctcctacccacgtatacctatcgcaacggcgattgcttctaccactgctgcactacacacgcatggccaaccatcgccacgcgtgtgcaaacatatcaactcgcagcgcggatctgacccgtgggtcgatttcgagagcagcaaccacacactgcagtgcacaccgagtctgtcgacgtgcctctacagctgcttgtgtgcgccgttgtcgacacggttacttgttgttgtgttggatagtgacacaaaggttggttggcatgtcaggttgcattggggtcccgtatccacaccagcactgccccccaggtgcacgcaagggtggaggcaaggcgcggatggcgcgtagaagtagcaggtagccgtgcatgggcaacaagacgctctgatgcttggcgtcgtgtccgagtggcaaccaaatggtacaacaaggtgtgtcggtgcatgggcggcgcggcgccactagctgacagcttggccgagtggttaaggcgatagactagaaatctattggggtcacccgcgcaggttcaaatcctgcagctgtcgaattccttttcctccaccatttgcacatgacccacacacagctgtctcgcatgctggtggcggttggcgccgttggagtaggtgcgtggggtggtggcgcagtcgtagatggtacctgcagacaccttgtgcgagaaaggaacgagagtggtcagacatgatgtgggcgtgcgacgatggccagcaagcttgtgccagtgcgggaagtgagtggttgcgcacgcgggtgtgtgtgcgttgtgctgttgttttgcagcattgtgtgttggtgagggtggtcgtangtcagaagtgtcagtgtcgtctagtgcttaggacgtgagcttacacgctcaagatcgaggggtcgatcccctccattgatacttttgtcttttctcctacccacgtatacctat

SEQ ID NO: 33711 - DNA, 660 bp, Heterodera glycines
cggccgaatatcccccataaaatttaaaaacgggcgcgaagcgcccgtcctgaggccgcgaagcggccgaatatccatcacaaaatttaaaaacgggcgcgaagcgcccgtcctgaggccgcgaagaggccgaatatccaccacaaaatttaaaaacggacgcgaagcgcccgtcctgaggccgcgaagcggccgaatatcccccataaaatttaaaaacgggcgcgatgcgcccgtcctgaggccgcgaagcggccgaattaaaccttagaatacaaaagggcgcggagcgccctttgagtcagcgaagcggccgaatgagtccacaatatttagaagcgcaaagcgcgcttctgaggccgcgaagcggccgaatgtcgccttcaaaaattaagaaacggacgaaaagcgcccgtctgaggccgcgaagcggccgaatgttgccttgaaaattaataaacggacccaaagcccgtctgtggccgcgaagcggccgaaaattcccaacaaattaaaaaacgggcgcgaagcgcccgtttgaccccaacaaaatttaaatcgggtggaagcgcccgtccaagcccaacaaaattaaaagacgggcgcgaagctcccgtcctgaggccgcgaagctgcaaatgtcgcctttaaaattttgaa

SEQ ID NO: 33712 - DNA, 1135 bp, Heterodera glycines
tgatttataataccatatttaaccattttaaaaagctttactttgcatttagcgaatttgaagaattttgagaaattgtacctcaaattggaaaaatttatgtccatatttttggcattttatgtccatattttgcaatttttggtccatattttatggccatatttcgcgcttttatatccatatttttaccagccctattaatgactagggatgggaatttaagtcaaatgacttctttttttttgctgactctaaatgaccttaaaatgactgcaaaagtgttctacactttgtttgaagcttctaacatacattttttgtgactttttttgacttttttacactttgggattttttaacttttttgcgttttgtgactttttacaatttttaaggcaaaatttaacttttgtgataaaaattccgaaaaatcagtcaatcttagagacggaactgaaatttcttataccataaggactcaaatgacgggactgaaaaataaaaaataaaataaaaatctggcggtgtaacacttttgaatattttttccgttaaaattagtcgtttttaaattactttttcgaagaaagtttaaaacggcttttggatttaattacatttggctaatttttcaggacttttttggatttattttgtgcttttttggtatttttaggtgcctttttggttattttttcatgacttttttgcatattttgttacttttggcattttttaggactttttcatgactttttggcgatttttctccgggctttgtgcattcataaagtcgtatccatttccggatgctgaaaaccgggaattcgggtctggactcgctcaataacgaagaatcattgaataggatcttaaagacgatttttccatgtaaattgactcttaagtaaatatttttacttctttgtccttttgatacttctaatgctcactggtccaggcttcgtttgcacagattaatttagggatttaacttgtccataaatttaatgggatgtgttatttaattgctttttattatgttttgaatggatttgatagatctggtcagaattgtttaattatttaatcattcacaaaagtttggtgcattaggaaacttgcactttct

SEQ ID NO: 33713 - DNA, 1040 bp, Heterodera glycines
  misc_feature (719)..(719): n is a, c, g, or t
ttttggaaaaatttatacgttacaaagcgctcgagcatgatagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttanatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtggcggtgcgcaatcgccatttaatttcacagagaattttaaaattatcttatatcccagaaaatgactatctcttatttgagaaatttatacgctacaaagcgctcgagc

SEQ ID NO: 33714 - DNA, 916 bp, Heterodera glycines
tttggattgggcgccgtccgcccgccccattgggccaatgctcccaaccctccctcgggcgttggcatcgccgggggggatggcccttcccccgagggccaaccggcgcagtgttacgggcggccctcgcccaactctctgctgccacggcgcactttcgacggtcgccggccttcgccctcctcttcctcacgtctcgttgtggtgcccacacatcgaccaaattgtaccaccgatgcggcaaagcctctcccgcagccattacattcgctcctttcaattggcccaaaaagagtttggcattggcactccgtcgccggaggcaaaacgaaaattagccgacaaaagcctttttttgattgctaacagagaaaactgatttgggaagtgttgtctctttgggtcttcacttctcatccgttcagtctcttttctcacgtcgattcacttcccccccattcccgacgatcttttcaatttaatgtccatttgaccaccgtcgcccttttttccacaataaaaaattccttttcatttatcgcttctttttttaaaggatttattttcaggaaaatgaaggcgaattgtgcttccgactcccagaagaagctcccttccgcggatttgtgcaatggccgctgttcggccgagcgacggattcactgccgcgaattggccaaatggggacggcaactgacgacactcgtcggttggttaccaccgggtcatccatctgctgatagtggtggccatcagttgcacaacttacaaacaatgcaaattgatctcttctcgcccccccccccgaccttagcctcgggcattaattagtcggccctttgagtgtcgggcaaaggcgccggggtttggaatggagatgagaggaactctctccgactaagccatccctcgcatg

SEQ ID NO: 33715 - DNA, 435 bp, Heterodera glycines
atcattttaatagattttgggacaataaaggttgattttagtgaaaaataaattttcggcttttgttagaatccgggtccggggttcgaaattggtcgaaatgggtgtcatattcgtggtcagtgaccccgaaaacaaaaaatatatatagccattacgttggcaatcaatcctataaaattggcttactgatttgaaatttgtgaacaagcaaatgttgggttcgaatactctttcagcatattttccaacttcaccgctttgccttgggcgctcaccatcgctgggccggtacatttcgccgtgtcaatgtcatggtgggggacttcatcatccctatcgaatggcgtgatgtgcaggccaggattgaaggactcttgcaatgggtcaacgaacaggaggcccgaatcaatgagcggaacggcgctggaattt

SEQ ID NO: 33716 - DNA, 619 bp, Heterodera glycines
caacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccctgtcgctcgactgcggcgagcactactggctgtaaaaggacagaccacatcatggttctgtgttcattaggttgttctgtccattgctgacataa

SEQ ID NO: 33717 - DNA, 962 bp, Heterodera glycines
  misc_feature (788)..(788): n is a, c, g, or t
aggtaatctaaaattagagcatgtgaatgagaaaaagaattttatttttaaatttttaggtttcttttgaatttcaaaataggtatttaaaattttattctctttttcttttttgcttttacgttttcggcttcacaatttttaaatttaaattgttccttcttttcaagattttaattctttcttcaataataatttaatggacaatcccggcccatcaaatgggattgacttaatcgaacttggagacagtgacgatgaaagaatggaaaagtttgcatttggtaagtaaatcccctcaaaaaagtatttctttttcaaatggcactgttttaggtggcaacgacacactttccctgatttcattaaaggtatttgtacgacatatggaatttaaaacttaatgcaatttaataatttttcagacggactttgaaaggccaccgaaggaagaagccatgttaaatttagtcgacgcttcctttgagctcatcgaccctaacccgaatgtccacgaacttttcgttacttttgaccaccaatttttctcgggaactttgaattcgaatgcgtgtgtcgtcgaatggagcaaaacgatgacatcgtttgaccctttttactataatttatttgaatttcccatttcttggtttagttgcgctggcatttgtcggttcagtgtcgggaatcgcctttgttcaattcggctcagtgaacctttgctcaaacttaggccgagacgcgatttagtcgaaactcttttggtaagaattcgttttctttcctanatgaaacctcggtttacagcacgaaatgatccacgcctaccaattcgttacggatggcattcaagacagagacggtcattcatttccatcattggcactcattttttgtactatctgttccaccccaatttaggccatggccccgacttccgtttgcatatgcatcgcatcaac

SEQ ID NO: 33718 - DNA, 1061 bp, Heterodera glycines
  misc_feature (6)..(7): n is a, c, g, or t
  misc_feature (1020)..(1020): n is a, c, g, or t
ctgcannggtctggcaatgggtaaaattgaatcaaaaaaccatgttgaatttggcaatgaaatttaaaaatacttactcgattaccgttgagatagtaaattggtgccaatttgcaaaatttcctccttttttgtagtttttattgtctgtccgttacccaattcccaatatcaaaacaccgatttctttgttgttttgcgtggtttctcttcttcaattcactgataatatttatctgtacatgataaccatctcaaagcactttcgtcattctgtcttcatttaacactctcctccttttcctctccttttcctctcctttttctcctccttttcctctcctttttctcctccttttcctctccttttcctctccttttcctctcctttttctcctccttttcctctcctttttctcctccttttcctctcctttttctcctccttttcctctcctttttctcctccttttcctctccttttcctctccttttcctctcctttttctcctccttttcctctcctttttctcctccttttcctctcctttttctcctccttttcctctcctttttctcctccttttcctctcctttttctcctccttttcctctccttttcctttccttttcctctccttttcctctcctttttctcctccttttcctctcctttttctcctccttttcctttttctctcattgtcagctaactttgtgctgaatggctaacttatgctccgccaaactcctcaaagtgttcgtcctcctcctccttctcctcctcctcaattcccttctcgttctccccgctcgcattctcgtcgctcttgctcccgacaacaaaagtcacctccgttcgatgctccctttgatcaatcggttagtttctttttggccacttttttaccttttttttacccccccccccaatgtttctgatcagattggcttcatccggtcactttgtccacgtcttttccttttcctctgagaaaatagaagaaaagtttgcaccanaatgtggctttgatcaccgttcctactgaattaaaccgtga

SEQ ID NO: 33719 - DNA, 1044 bp, Heterodera glycines
  misc_feature (807)..(807): n is a, c, g, or t
atcggaacgtgtggccgaattcagcaatttggtggaggagagatatagtaagttgaattgggtcttctatcaattaaaaaacgatgggaaaacccaaaatttataatatcactcatttgaggaaattgaccgattctgaaccactgattaagattcaattggacattttgcgctatttggtgttggacgaggcggacaaactgctgaaggcgagaaatccgaaaagaccgaaaacaataataaccgttaaaagtatccccttaagaatgaggatttcctgaattgtgtccaactgatcaaaaaccatcccaaactcgtgcgtctgtttaaattagtcaccacaatagccaattgacttttaattttcgaaatcttctctttttactcccccctccctttctttattttgtcagtgcccttctcaccgttgtctgatgttttctgccacttttgaatctggcgctcagaaattggcgcttcaatttttccgtgatgactttttctttgtcaacatcggacgactgaacacggccaccgatttggttgtccaggagttcaagaaggtctcatggggaaattcggaaatttgaaaaattaataatgccaaccgaatttaaggtgcccaaattcaataagtctgacactcttgtggagtttcttttgggtgagaatggtgccggtcggcgggaattggaacgaacgaccgacggaggttatttataaattaaaacgaaataagtattaaaaagacgaagcgataatgcccaaaatcataaatttcacaataaattctcatctttttattanatatttggcagaatattggaagacgcggaaaacgcttgtttttgtggagcgaaaacggagctcggacatgttggcaattgcacttcgacagaacaacatcagggcgtgagcatcaacaggtcgggaaagagttcgacaatttgccgattttccctttgtttcagtgaccgaactctgaagcagcgcctgggcgctgccgaagacttttgcctcggggaaaatttcttgttcgggttg

SEQ ID NO: 33720 - DNA, 964 bp, Heterodera glycines
atggtactgtgtttcgcataagtgtgaaggtactgtgctttacataagtgtgatggtactgtgtttcgcataagtgtgaaggtactgtgtttgacataagtgtgaaggtactgtgtttagcataattttcaaatccattttttttttttgctttttatgcaggtcaattatcaaaaaatcatttattaaacaaaatttttattttaaatttttcattcaaaataaaacaattacattaatcataaagatataataaataccaatagatttaaaaaaataaaataaaaaaattattttataaacaacattttgatatttatttagcataaaaagcaaaaattaaaattaaaaaaggaatttgcatgtaaaggattcgaacttttgagttaaaaacgctgattaacgcactaccaaaacaccactaaacactgataacaactaaaaaaattattcaatttgtttattcattaaaagtttgacacgacgtaactcagcgcttgtaagttttttctttgttttagttcaagagcttttttgggtttttgtaaaacatttaaattataaatttatatcattttaaataatagaaatagccataaaatgcttcatcattaagacgatcgattagttatttttatattaaaaattattttataaaatcacgaaccccattacggcacattctgcaacaagtgggactgtttttccttatcgatatacgtataataacatttgataaatttatattattatttttttttttttggtattatgtggaagaaaagtttcgccgataaacattttgaaataaattaaataactttggtgagatatttattttcacttcaatgttttaagaatttatatattatattaagtattcaggaaccaaaactattcttgcataaagagaaaaagattcttccaaaatttttaaaaaatgaattcatgttttattgacttt

SEQ ID NO: 33721 - DNA, 947 bp, Heterodera glycines
taaactttaaatttactttcaattatattagtttattacaaaatataaagaagaatatgaaactttaaaaataaaaacaaaaaataaattatttgtaatattcattaaaagtaagcataatcagacgatctatcacacaaagacgtcacgacttgaagaaaagcgtgaaactccatcaaataagtttacgaaagttgaaaatagatttgaatgaagaatcactctaaatattaactatccaatacaaagaataaatgactctaaataccgtaactatcaaaaacgataaatattgctaacattatgaacactcaatctaaatatttatataaacatagccaaaaacacgaaatatttatcacaattaaataatcaaaaaattaatataatgataaatgataaattatttacttttattttaagaaatgcatcaagcaaaagcaaaaactacaatcagaaaaaataataaataaacaaaatgaaattaaagaaaatcataataattccccaactatcaaaagcattctgatagattttaacttggtaaataatcaattgtaattaactataattttttcttcctttataaacactaatggcattgggaaagaaattgaaagattaaagctttatgttgttttggcataatttgcataaatctaaaagaataaaaattaattacattatattataagtcattaatggaaaaatggcggttaaatttaaaagaaccaagccccgtatcattatcgggctctgcttccacatacaaagctcaatttaggcatagcgaattacggttaattttatgcaaaaaaatcataattattaattggatttatttaaggaaatacttattatttaaaccaactgaggaagggtatttttgatgggaaaaatttatctaaaaaagaaaaagaaaacatagaaaatatttgaacattttc

SEQ ID NO: 33722 - DNA, 955 bp, Heterodera glycines
  misc_feature (727)..(727): n is a, c, g, or t
ctccaaatatttcatcaaatgggacttttgttccaactttttattttctgcttcaaattggtcaaatttgatgattaataaaataaataaaaaaaatagcgggaataatttcattctttataattctttggtaaaaacttttaaattagcaattttgtaaattaatttattcaatttaatgattgaatttaggtaattatgctgctttatgaattatttatgaatgtatttaaacgttacaaatgagaatttattgctttgtattgattataaatatggattaatttaaaagtcaggaaattattcggctaattcagattatctaatgcaaattattttcaaaattatttattcatagtttttcagatattttttaaggaaaatttcttcaatttttcttaaaatccctcatttaaaccctccaaaatctcttttccaaattgttttttccattttgaaatgctctttctatcaattttcatcattttggcaattcccctttgattctttttttggattttctctttttatttgccattattttttcattttttccattttctgctatttcattaccacgaaatgccaaattctttctttaatcttttaattacatcataatttactcaattttcttacaaaaagcggatttggcaaattttatagaaatttataaatttcatcaataaaaaaaatggcataattttggttttatttgaatttttanatcgtttttttttttgcagaagtatttttttcctttttttgattaaaatttttttaatattatttctttaatttaaaaaatgttctttttttaaatttatactgatttttcgcatttgtcctgacgataaaaaaatttatacccaattttttaatgaaaatttttctgccatttgtcaccaccaaaatatgataataattatgttttttttaaattttcctgggtttg

SEQ ID NO: 33723 - DNA, 1704 bp, Heterodera glycines
ttatgtcattttctcaatttcagatggttttttggccattttgctcatcactttttgctcatttgtcgtccatttatttttcctttttctttttgccgtttttcctcccaaaaagtgccgtttctctttgtttgcctatgcccttctctttgcttatgccttttgctttctttttgccattgcccccggctcaattcgatttggtcaaaaggtgggcaaaaaacaattaaatatttttaaattataatttattgtttagcaacaaaatgagttggccatcccaatttatgacgagtcccaacacaaagtccaacttttgcctttgtctgttccctccgttcgaacatttttggagcaaatcgaaacgaaagcttatcgaaacgaattaagtccattgttaaatacggtggaaaaagtcaaaatcaacgaaatgctgaaggtactgaaaggaccaggcgaaacggaatgatcacttctgatttattctcttacttttttgttcagaattcgttcactttcgacttaaataatgtccccggggaatcgtccgatgattttgttcgcgagattaatatgttggaggacaacaaacacgtgaagcgaatacacgaatggatgatgaaggtgaataaagctcagtttgtgatgctaattgatggaaatgggaaggggacaaaagccatttgaaaaggtcatttgaagggcaatgggacacgtcgcgtgcttttgttcgggaacagccacgcccaagtcgcgtggagagaagtggccgaggcattcaaaggcgacttccgctggttgcgcgttgtgtcggtgccaggcaagtggcgattcaatttcacaccaattgattttaattgggcaaaaatcaagtacggtagctatacggtaatataggtaacagtacaaagaataataatatgatagggaaaatgactgtaaatgggaatacctaattggattcgagtttttcaggatgtatgccattgtttgagaacgattggcgcaccatttacggcgttcggtgtgccgaaactgtgaagggaatggtcaaaatgctgcggaagacgcggcccgaccttctctttctcatttttaggtgaatgaaatgctctccaatttaaatttaactttcgaattaaaatgccttcagatggtacgacgacttccaaccgacgcaaaacgaaaaaataaatttgggagaagacgccgaattggaagcaatgcaatcgctgatggacaaagtgcaaaagttggtcgaaacgcgcattttcatctcagcgccaaatttgcaattcgacaccgaaatttcgcaccaattggcaaaaagaatttggcagaacactccgctggaagggctaaacaaaaattattcggtgaggcaaaatcggagggaaataagcgatgccaagcaaaaaatgaaagagaatggctaaaagaaagccaaattccgataattgccaaaataaatttttattgacgaattgtccgtttgcaattgcactcatttacttcccatttccaaattgcagaagcatttggaggagaacagaatccattacgatcggttgggccgtttgcgttgtgccaaatgttcggtgttcgatttggcggaggatttctgctgggagggaatttgtcatgcgttcgaaccaaacacaaaattggcctatttttcggacaaaaatcatatgtcatttttgg

SEQ ID NO: 33724 - DNA, 724 bp, Heterodera glycines
ttaattgtgacaatgcctttgagttgtgcccagtgattgtgccaatgtttaaaataatggggacactacgaaaagcgctcggacaaactggtcatccgccgaatggcaatggcaaaacccgcaactaatcagaaaagctacgacaaactgaaggaaactattcgcgactgattggacgggcggatcaatggatctttaaaattctacgatagataggccccgatcaaaaatgacttaggcgcctttggcgtacgatcaatcgaaagaccatcgattggatattggctaactgatgatgaaaaacatttaacgaaaaaacaataataaggaaaaaacgataatgaaatacagtgaaaaacataaattatcaccattgggaagggcagtagcaaatgatcaaatgataatgataagggcgttcgtccgatgggttttgggtggataaatcgaattgcattttgcttctcccaaagctcgaaaaatgtcctcacttctgctgttggcgattgttttggagagcaattgtggagtttgaagtttaatgggggggggggagaaatgaactgataattaaggagataaaattgtgggaaaatggggacaaagtgaaagcggggagagagagagagagagagagagagagagtgtgagaaagaaataggaaaaaagagagagtgagtgaaagggaaaaagagagagagagagagagggaaagggagagaga

SEQ ID NO: 33725 - DNA, 983 bp, Heterodera glycines
  misc_feature (948)..(948): n is a, c, g, or t
gggcgacactgtacgcataagcaaggagaaaggagagcttacaaaaggctattaccccaactttattgacgagctattcaaaattgtccaggttaaaccaaccaatcctccctcatatagaattcgcgatttacaaggtgaagagattaagggtgtcttttacaaacaggagttggtaaaaaccagtgagaaggacaaacccaccgggttgaagtgttaaaatcgcggacccgaaaaggattaaagaacaccttgtccgctggatagggcattccgatcagcataacaagtggattcgggacgctgatcttgtaaaagagcgcaaagctaaataaaaaatggatgaattttatgtggtactacgatccaattcacctggaccagggaacacgacctcaaaattcactgtcaggcttccacacacgcttgagctggacgcaaactggatggtggcactttcatcaattatatacccatattatttccatccgtcggaattgatgatgacgacttcattagcattaaacttgtaaatccaaattttacattcgcggatgacaaacgttttgtggatattgaactaaaaataccgagcatgcaattctctagtgttggccatttaaggcaaacattaaatgacataatcaaggatgcatataaacaacggtttgggctctcaccacagaaggccgccggaacaacggttaaagcgaaacgccaaattgacgttacggaccttttttttcacgatcaccctggtgattattgggaaaaaattgaagagttggaaaaaaagttggctgaattaaaagaggagattatgacgaaagagagggaacatggtgccaaaggtacagagcagaaaagaaaaaggaacttgaaggtgagttgcaaattttaaggcttcgcctcaagagaaaggatgatgagctggaggagcttaagcgngcagcgaagcgtcgcgatgacgacacccctgagaa

SEQ ID NO: 33726 - DNA, 318 bp, Heterodera glycines
tcaatggcatttatcaaacatgttgcttttgagagaatggattaattgttgggcggggctttcggcctttggcaatggcaaaattcgttcattaataatggtaattaagaggggggggggggggttaatcgagggattaaaaaataagcatcaaggattatcaattaataaggtcgcgaattgggcttaatttacgttagattaattcccaacttttttggcttttccgttcattttgtcgataattgttgctaaagtcagaagctttccccggaggacgacgtccatttgccaatttaaattcagacaatgccaaag

SEQ ID NO: 33727 - DNA, 1146 bp, Heterodera glycines
  misc_feature (1120)..(1120): n is a, c, g, or t
  misc_feature (1127)..(1127): n is a, c, g, or t
aaaactaaatatatctggccatttaaaaaaagaaatttttagaggcttgcggtatacgtgaaaaggggttaatgggttgatcaagatttttaagggtcagcagaaggttggagagagatcggcggacaaattattaatggggtcaatccataattttaacgattttatttttaagcggattcttgcggggtctatggtgagaaacgactacgacctatgttggatacacattaagtggcgataaaatcaaaaaagatgccattaaaactgacgaaattgacgcgtttttacaaaaagaggaagactcggactattggtaagccaatttaacaaaattatagaagacaacctttgaaaactggtgtggaggcaataggacagccaaaaacaattgatgtctcaaaccctataaataaaacctatggaagagggggtgaattgtgacgcccaatgcaagcaaacactgtgatttgtcgaacgcagttgtgagggcgtttctgaaaatgttactaatgctgaccccaccttcttctgagcgcaattcaataacaatatagtgctatcattatcgcttaactttaaaaaaaagagttttcaatattaaggcgtaaggttttcgaccgtcagtcgggtcagcaaatggcactcactgaccaacaggtggagaaactgaatgccattgcggacaaccggttcccggaaataggtatcaaagagtgctcattgtggggcgacgaagaatgccttttttgaggttacaatccctaccctcctttcttggacattttctcctccgttcgcgagattcacccaatttccaatcgaccccccgacaaacgctctttcgttccgagtgccgatgaacgtcgaattgtcggccgaatggtccacgccattaaaatgggatggctaaaaaggaaagagccccccaaaggctcagaagaagaggaggagccgaggctttacgacctttgggacgacgagggggacgagcagcggaagagcaaatcgcaaatggcacgcgtccgaatgcatttgccggcaccgaaggtcagtcgtacataaaacaaattaagagcaaaacgagaaagtcaccattaatttgcaggtgaaccaccgnagcacgncgagtcgtacaatccccca

SEQ ID NO: 33728 - DNA, 1004 bp, Heterodera glycines
  misc_feature (941)..(941): n is a, c, g, or t
  misc_feature (965)..(965): n is a, c, g, or t
ccgacagggatttcaattagatcaccaaacaaatgaaaatcggattcgaattctccactttgtatcaaatataactttattataaatcacatttacaaatgccttgttttgattggtggtcgagaaggacaatgtccattctgttaagaaactcgagttttttgaggatttgttacggacatatcacattcaaaaacttgtaagggatacgcattcaaaaattaaattggcaagcatttggagaggaagaatggataacatgttcaacaactggcaaaaaacaatctccagatactgaaaaaaatttcgggtttttttttattttcgttccttggacaatgggtctttagctccccctaaccgctggccatggcaatggtacacaggggatttaatcacttacattaaccatataattaaatgattgggtttgccagagattaacgaaaacaaaacaagagtgactgatgtggttgacatgagttggttagtgctgttgagcgatttcagagaagaattgaagcacatccccaatggagaaatccaattcgatttttgaggcgccgtaacaccgcgagatcagctcttggtaatgtttcacctggttcaagaattcttcctgaactttgtcaaatgtgaaagaaatccgtggttttttttgcctgcatttgtcgccacacaacgaccagaagaggcgagcccgggcagagatgtttctccactttcttgtacagattgtcaagtcccttcttcacttctttggccgggtatgacgaaatggcccgtttcagttccatccgggagaattgctgctcgtagctcatctcttccggctttgcgccattttccaagtgtttttctatcctctcgaaaaatgtctgaatttcattttttgatttatttttccctgcccattcattcacatgaattttgtccaatgnacggcccatcgattccctcacatnaattccgagattttcttgatacaaaagtcgaacattctt

SEQ ID NO: 33729 - DNA, 1107 bp, Heterodera glycines
  misc_feature (1072)..(1072): n is a, c, g, or t
aattttgtaatagtgcgtaatcttttaccataataactcacaacattgaaagataactaatcttatttccaaggacaaggaaatttggtgaaacccaatgatggacaaccaaaaaaagggggagggggagcaacgaagccttcaggcgttgcgcaatattatttccgagacctaaatacaaaaattattggcaaaatatcgccatatgaatcagattaattgtgtgaattttcgtacatttttattgccttttttataattttgttgtgtgatcccaaaacagtaaagtacccgaaaactttccaattgaaaaattaaaaaaattacaaaagtaattttgattttgaaaagatagaagcggggtaaagaactgggcggaatttgcaccttaaaaaagatttttgtggtcgcaattccgaaatttcttaggggtcacggaattttccatccttctggtgcggttacacgcgaccatggcacccaaggaaaataagacccctcaaaatagttttttatttgaaaataagaaaacgaggatatgaaattatcgaaaaaacaggagaggatggaatttgccgattaaagagtaaacaaaacataaattaaacatccaaagtattgtcgttaatttgtctttaaatgtgccaaatctcgaaatctaggcattattccaacctcctcttcctcatcaattccatcaacgacatccgcgccgtatccgccgcagtcgcagtgccaagacaaatgggcaccgaatttgtgcaatttttacaaaattacgggaagatgccttcaaagtggcttcatcgtgtggcttatgatcagttgcaagtcgacctgcggactgtgcactgctcaaattgtttcaattggctaatcaaacggagggaaagtgacgaaaaagtgacgtatttttatattattttactgaaaaaccatcaaaataaaattttaatcaaaagcaacagaattttattgtatcatttgttctaaatattcttgaaacccgtggaggccgcgaatttcggtcgcgtccatcctaattcacatattatttatcggtgaaaatcgncatagatacaaaagacaaaacaagcataaaaaggg

SEQ ID NO: 33730 - DNA, 1031 bp, Heterodera glycines
ttgcgataaaattaattttaaaatttttttaacgcttcctaaaaattttgcatattgttattaagtgaataattctatcctttatctaattttcacttttaaaaaattaatttcaaatttttttttattttgaataaactatctattatactaaacgattaaaaatgacacgttctcattgaagtgataatataagctcagttttgatttttggcattaaatgaatgaagaatagaaaatatttataattataaacagaaactccaaaattcgttacattaatttatttgcttattgtttttatatttatgaatttttatattaacatgaaaaatatttccctgtaattgcattttttttttgtttcctttttgaaaaagcgaacatgtctttcattgtagccaacacaaggcaaatgtttcacgttttggcggttgtattagtaaaattgtatttttaaaatgctattttattactttctattatattaatttgtctttgacttagagatggcttatttttatttaattttctttattatttcttcactcaatttcagaaaataattttgatattaagattcataaatcaaaaagtgagaaacaatgatttcaacgcataattaaaaatcaccgtaatctttacatttaaaaataaagttattcaaaattcaacatcttcttccaaaattataagtagcggtgtcattttatgtgtaaatacatatttttttcctggcttctccatgctctaaatagtaagaaaaagatcttttgtgtatttgcgaacaaagttgggacttttattttgttttattaaaatccccaaatatcgggttccataaatgtcgtgtccccaaatgtaaggttccctaagtatcgggtaaacgtcgtgtctccaattgtcgggtcctcgggtccccaagttgcaaaaccccaaaattcgggtcgccatttttgacagccctaattataagaaataaattgcaaaacaaataatttattctgaaatatcaatttaacatttaggaa

SEQ ID NO: 33731 - DNA, 894 bp, Heterodera glycines
cagtccccccgacccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgatgctgatagccaaaaggtcg

SEQ ID NO: 33732 - DNA, 343 bp, Heterodera glycines
tttattaaattaaaaatatatagaaaaatttataaagaagaaatttgaaataaaaaaatcttatttttgagtcaaaaatcagaaaattttttcaaaatgcttaatttttataattaattcgaacaaaacatttattaactttatatttttgacttgcggtgtatttcttgaaaaaactttttggtgaccaaggaggaggagggaggccggcggtgacgggaaaaaaattgaaaattttaatacaatacattggtagattctgtacaaaaatgaccaatttttgcaaattgagccagttttttaagagaattaaagatattaaggatccggcgaggccgatagg

SEQ ID NO: 33733 - DNA, 692 bp, Heterodera glycines
agagtgggtctcgtcagtatggctcgtccaattgaaaataaatgttagtgcaaggtgtttaggccaattatcatagcacagaaattcatattttttataagttttgtaattctttatatgcattttttcttgttttaattatgtctgctttttggtattctttcttaaattcctttttaatcgagtatccctgaagataataaccaacatagtcgcttgatagctttaaaaagatgcaaattttctgctgtatagttgggatttttgtttaaaattttattttcctactttagtctttaaaataatctgactaatagttttataaactcataatataattttattgtcccttcttatattgctaatttatttaaataactgcattaaataatttatagccattactccgaaggtggaccgcaccaaaataatagtaattgtgaaaacgaaaccgaatttccagggcataataaataatatttaaattttaattaagtattcaattaaatttgtattaaactgatgattttatttctttttcaaaattaattaaaagaatatttaaagtttaaaatttaatatccaatttttccttttaaatgtaatttcctacaatttatgcatctattcttcagatgtaaagccggttgctgatgagatattatttttttattcataagtttcttatttcc

SEQ ID NO: 33734 - DNA, 1192 bp, Heterodera glycines
tcaaggacatcacaacgggggagaatgagcacaaaagcaccaccaccgacagcagcaacgccaagttggagcagtacacgatggaaaagcggaggggaaacaaacgacgcaaaagagaacaaaaaagcacatgagacaagccgaactgcagcgacagaacggacggaaggcaatgttaacttccgactgctcgcaatcgccggaatcattgcgggttggtcctttcgaaccaaaaatgattattatttaccacttaattcctttaatttttgcttcagtgttgtttattatggttggaattggaagcatttgcacgggacggtacgtgcgaaagagtcgtcaactccacggcaaatacagggtcggcaataaattaaagatcgattagaaataaaccaatggaacgagtggaaaagtgggggaggggtaataaagaaagaatattcgaccatttcgctttgttttagcccgccgcgtacgaattgcagaccactcgccccccgcctttgaccagctcttccatgactttcgcgccttccaatcgcatggccaattccaatgaattgcagcagaatcggcatttcgagtttggccaaatccatcaaataccgccgccagttcattgtcctcatcagctcacaatgaatgggaatgactgtcgtgaggaaaggctaatttaagcgggacaataacctcagttttacctaataaagaaatcgaacacactcactcaatgaaattgtattcgaaatattctggaatgccagtcatcgcgtttttttcatttttgaacggctcattatttttttttggtgtttatgttgcatatttatttcctcacatttgtacaatatttcatacacagatttttacttcgttttcaattgtctatgtacgagtataaatttcaatattaattgtttgaatcggggatgggcgcaattacgcattatgaaatttttggatcccgtaattacgcagaattcgaaaatcgcaaacccctctgcaatgtataagaacctgtgcttatcattttaataccatacagaacaagttttttaaaaacaaactttattgtcgaaaccaatcactagggcatccaattatatggaaatccatatttttttcctggactgtgggaggcatgaaacgcacgaaaaacatgtttttagcttggtttgaagcttctagg

SEQ ID NO: 33735 - DNA, 472 bp, Heterodera glycines
actcactcactcctcttttttctttctttctctcactctcttactcacttcctctccatcttctcttctaactctcctctctctcgttgtctctctctcccactctctctcaatcactcactcacttcttttattctttcattcactctactctttgtctttctctcctctctctcgatttctttctttctctctccctctctctcttactatatcccccctccatcttctcttctctctccatctctatttctttctttctctcagttcaattcctctctttttctttcgtacctcatcactccctctttttctttctctctacttatttctctctctgcctttctttctctctctctctcactatcactatctccatctccatttatctctactttttcttctctctctctcttcctctctctctctctatctctatctctctctctctctcattcctatctctctcttt

SEQ ID NO: 33736 - DNA, 965 bp, Heterodera glycines
  misc_feature (854)..(854): n is a, c, g, or t
  misc_feature (871)..(871): n is a, c, g, or t
  misc_feature (935)..(935): n is a, c, g, or t
aaaacggaaaataatgtcttaattcactacgttggagcattcgaaagtttaaaacctcaccatagagcaaaaagggaaaatgagaatgggataagccaaaaaagagggaatgccccaagagaaagaccaaacaagaagccaaacatacggcgaggacaaatcacaatggaaacaacgacaattccattaataattcgccccactacaactattattccaccagcaactcgcactactacaaccgctattccaccaattactcatactaccacaactgctatcccaccgacaactcgcactatttcaacggctattccaccgattattcgcaccaccacgacggctattccattaataattcgccccactacaactattattccaccgactattcgcattaccacaacggctattccaccaacaactcgcgctactacaaaggctattccattaataattcgccccactacaactattattccaccagcaactcgcactactacaaccgctattccaccaattactcatactaccacaactgctatcccaccgacaactcgcactatttcaacggctattccaccgattattcgcaccaccacgacggctattccattaataattcgccccactacaactattattccaccgacaactcgcactactacaaccgctattccaccaattaccacaactgctatcccaccgacaactcgcactatttcaacggctattccaccgattattcgcaccaccacgacggctattccattaataattcgccccactacaactattattccaccgacaactcgcactactacaaccgctattccacccacaacccaggctanaacaagggaaatgccanagggtacaattgaaaccattgagaagctcatcaaaaaactcgagaaaatgacagaaatacggangaaaacaaagtgaaccaacaacattcctga

SEQ ID NO: 33737 - DNA, 958 bp, Heterodera glycines
  misc_feature (906)..(906): n is a, c, g, or t
  misc_feature (942)..(942): n is a, c, g, or t
  misc_feature (949)..(949): n is a, c, g, or t
attttaaaaaattcccgaattttttaatgaatttttagcattttttctacaaagcggaagtgcacaactgtcaagtgttcacttactttggagctttgggaaacgcaaataatttcgagtaattttcgctttttattattttttttttaattataaatcatatttatttgttaaacgattttagaaactacaaagaatgcatggcttactgtaaggacgtttgagcgaaccctgacagtacagtatacgaatctgttttgctctttttataagaagtgggcgttaattgactcaccgttttctaaagatattatgacgtaattaaagccactattgtgccattagcttctgcccagtaataattcaagaatttaaataataaaatgattattttaagttgcctgttgagcttctgataattttgccagcatttttttattatgggtcttatttttctctcacaaaatatgtgagaaattttgtcggagttaatcgtttgagacagccggaagtatttggtgacgaaatcgcattaatttgcaaaagaaatcgaggcggaaatggtcaaacaacgacaaagtgtcgtgtgggaaattaactcaccaattggtcgattttttggtatttcaaaataaaaaaagaaaagaaatcaaaggtagaacgcgcataaattaacgcgtttaattaattaattaattaactaattaattacttaattggttagtttataaatgattttccgcctaattgaacacaattaaaaaatggtgtaaaaattgagagaaattgcattattatgggcttcgaagaacaaagaaaaagcatttattattgaaaaatgacaaaagacggaagaaaaaagacaatgaaaggacgacgagccgaaggaagtgaaagaaaaggctntttcttatgaaaattgacagttccaccgaatgagcngaaatanaagggaaaa

SEQ ID NO: 33738 - DNA, 279 bp, Heterodera glycines
ggaggaggaggaaaaagaacaaagttggagggggaggaggaagaacaaagttggagggggaggaggaggaggaggaaaaagaacaaagttggagggggaggaggaagaacaaagttggaggaggaggaaaaagaacaaagttggagggggaggaggaagaacaaagttggaggaggaggaggaggaggaagaagaacaaagttggagggggaggaggaggaggaggaaaaagaacaaagttggagggggaggaggaagaacaaagttggaggaggagga

SEQ ID NO: 33739 - DNA, 154 bp, Heterodera glycines
gcgaagtgctgctcaacttcgtgtttttctggccgctgttcatgtccggtatctggatcgccggcggcatctatttctggctgcaccgcgagcgccactggcgctggagcccggacatgcccgcgccggtgctgccgggcaacccgttgatcag

SEQ ID NO: 33740 - DNA, 885 bp, Heterodera glycines
aagcgaagagagatgccgaagaaaaggccaaaaaagacgcagaagcaaagaaaaaggaggaagaaatgaagaaacaaaaggcaaagcccgaggaaaagcccgcggcacctgcagaagccaaagcactagtgccggaacagaagaaggcagaagagacaaaggaaaagctgaagcaggaagagaaagctgcggaagtgccgacctcacctgaagaaaagaagagaaaggaagcagaagcaaaagcgaagagagatgccgaagaaaaggccaaaaaagaggcagaagcaaagaaaaaggaggaagaaattaagaaacaaaaggcaaagcccgaggaaaagcccgcggcttttgatgcaaatgacttcgtggcgcttttttcttcctattcttcaataaatttctctgttaaatttccaagtcagactgctcaaattgaagttgttctctcagattgtcttcttgagaacggtttgttactcaaacaaatttaatttaatttaatttaattttattagttgactcaattaaaccttcgcgcgaaccggcgccgctgtacatgaaacccaaatttgttagagggttgtcaaatgtgattgacctgatggcgctgaatgaagccacgtttgagtgccaattccaaggatttccagaaccaaatgttttatggttcatcgatgatcaacctttgacacagaaagggtgtgtgccgattgacattgtcacatttacccatttgtgggatatctgccatttccttccggtgcccccccccccctcccccgttaagcatcgcttttcttttgagatgtgaccccatcttccgttagaatcagagggatcgattggtggatcaacttgctcttctcacattcccgctctcatgaa

SEQ ID NO: 33741 - DNA, 797 bp, Heterodera glycines
  misc_feature (15)..(15): n is a, c, g, or t
  misc_feature (447)..(447): n is a, c, g, or t
tttttcagtgtccgntttggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattctgtctccccataaatctgggcgcatcggttcggggggactgccccgaaaacaaaaataaatcgattttttcaagtgttcgtttggggtactcaaagaattatggggagcaaaaatccaaagcagaattaaagttcagcctatagtgaagctatttccggaaggattcggtccgcccccccnccccgcccttcaaaattttgaaaaataaataaaataataggagactcagaattttgaaaattttttataaaaactgatgacaagctaatgtgataaaacaggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaatttgcaaaaaataaataaa

SEQ ID NO: 33742 - DNA, 699 bp, Heterodera glycines
  misc_feature (584)..(584): n is a, c, g, or t
  misc_feature (654)..(654): n is a, c, g, or t
  misc_feature (673)..(673): n is a, c, g, or t
atatatatattattttcacgtttggaaaagttctttgataagttagagcagactttggatcagctaagatcatattaataggatcgtgatttcgaaagattatgaaaaaataggaaaataacagttttgagccaaagaatttgcaaaaaaagtaaatattcaaagtttagcaaagaaaaagaaagtttcattattttaacaataattaatttgaacatatttattgattaaaagcagggctcccagatgtgaggctttagcctcattttgtggttttttgataggtcaatgaggctaaattttcaaaatgaggatttgaggctttttgtggttttttgagaaattttgaggctttttgtggttttttgagaaattttgaaaatttttgaggtttttggggaaaattcgtaagattttttaaattttgatttttttgataatttggcataatgtttgacaattatttagtaatttgggtttttaatagagcatcaaaacgaaaatagaaccaattttttccaaaaaaaaccaaaaattaagaatattttcaatgaaaatctgctaaaaatatgtacaaatctatntttccccccctgtggggggcgcctatcggcaccgccagcccctaaaagtcctttattttcttaaaagttngctcaaatcacaaaatttnggccatttttgtggacaaatacttta

SEQ ID NO: 33743 - DNA, 1230 bp, Heterodera glycines
  misc_feature (25)..(25): n is a, c, g, or t
  misc_feature (35)..(35): n is a, c, g, or t
atttctatttttacatgtaaatatnagagcacacnataggtcaaaatattaggcatcggctgggagtcgaaccaattcctacactcagtcaatcgcactgaactgagtcgaaccctgttttacatttattaaaccactaataaaatattcaaacaataattttttaattgttgtattaattaattctctcaaaatatcataaataaaagacttcccatttgttttgcatttgtttgttcgaagaatggagaatttgtggttcggcagatttctacttaccagcagcttttgaatgatactcaagatgtataattttgtgggaaaaagtttggtgtcgtattttctcagtgtcggattttccgccgctgtcgcatttttcagtgtttaagactgtaagctacgaatatggctttttattgtaattatttaatagatgcttttcatcagttccttattattaaaatgaatttaaatgaagcgattgcccaaagaaaagaagaaaatgaattaatatatttatttgaaatactttcatttttgttggggaaggacggggggagagatgtaagccaagaggggggagagatttcccccgcgcacaccgaaagaaaaaagaatttttttaattgagtaaattttttgaaaattttaatttaattttattagcaaattcttttaaaatgcccatcatttttcctcggcggtgtctatcgaaatggccggacctccattttgtcaaagtttttggaaattcggctagaaaatggcaaatttaagttttttttgtcggaaaatggctaaaaattctttgaatgagttggtgatacgtccaaatttgtctaaattggttaaatttcatttggcgaaatggcagctggcgaggtctctagttgtctaaatgtccgcaaaaaattggcatttttatctcggcacttgggcttaaaacaactttcatatttatacaagaaatttacagcaaatgctaaaattttattttaagtacaaatcacttagacttttagaatcgtcgaatttttttttttgcattaacgaaaacttctgcctagactttaaattataacaaaatgaattgtattaattataggttaagcaattatttctattgaaataagccgcctaaaaaaggcagtcataaccgtcttttttgaattagcaggcaaaataaattcctttttgcgtttaaacaattttctataacattggcaaggg

SEQ ID NO: 33744 - DNA, 951 bp, Heterodera glycines
ataaaacattttgcggaatcattttttttgttataaactattaatgaatctccttaaattttaattaaatttatcgccattttggctgaatgacttgaacaaattccatccttcaatgtttttcaacaatttactatcaatataaaaattttacgatttttagtcaattccaaagctaaattttttcacctttaaatgccatctcatcggatcttcgggatgacaacactaaaattcattcattaaccattctctcaataaatttctgtttataaatttttttaattacttaaactaaaaatcaatacatttaatttttgttataaaataagtaaaaaaattatgtataaatttatttttttttaaatatttcgcatttaatgaaattttaatgttagaaaccaaatttattaatttatttgttgcattatttgaaatagaaaaagccaattttggcaaataaaagcggaaaaaacttgatgaaatttttggaacggatgggacaaaaagaaagaaaaaatgcacaaaatgaagaaggacaaattggacaaaaagacgaacatgtaaaagtgatcaaaaggaaaatattgtgcaaaatagagaaaaagaagaggacgaattgggataaaaagttatcagaagaaggcaaaatgagaggagcattttgaaaaagatattggaaggaaggaaggaaatgaatggaaagaaacaaaaaaagatcaagacggaaacgcacaaaatttatgaaaaagtgaacaaattaaaatgttggaaaatattttcaaacaaaaaggaatttacttgagagagggaaaacattcgcgaaaagaatggcaagaatttaaagcagaaattaataaaggttttggataatttcaaaatgggtcaagtaatttgacaaaagaaattttaaatgtcaatttttgaaaaattttaattaataattgttgt

SEQ ID NO: 33745 - DNA, 886 bp, Heterodera glycines
ccctgtccattcactgtcaatcactttccccaaacaaacaaaatggcaccggaggaccaaatcccaaagccccaggcggagaaggaaaatgttgagccacaggcggacccagagaaacaacgcaaacggcgatcaccaccggcaccaatcatcagcgagctggcccgaatgatggatcagctgaaggcctcaatggttgcggaaatccaggactgtttggagcatgtgcgaaatgcgatgatggatgaggtccagctggcgttggacaatttgtgggccaaaatccagccggtcatggtggatcatgggcgctcgattgcggctttggcggatgcatttgatgaaatgaccatgaaagaggccaaggacaaaatggagaaccccacggagggaggtcctggggtaaatgacccaccggctaacagcccaccagagagtggaggccaaaataaccaggctgacaataacaacccaccacagagtggaggccaaaataaccaggctgacaataacaacccacaacaaagtggaggccaaaatgttcagttggctaatcagtttgagcgacccgcccaatggcagggccgagggtcgcgtggaacttggcgtggtcgtcgcgggttcgagaacggagggcctggtcgagtgagctacttgcgacgccagcttgagcgggagtccggcggtcgagtgcgcatccagcacccctacttggaattccgccgtggccgtggttatggaccgagtggcagaattgatcgcgcatttggacaatatggaggacaaaactctggggggccaagccgaggacgccgtgggaactgatgctggcaaaaatctcaccaagaaggaaggaatgttggatcccttcgatgcctgtctgttt

SEQ ID NO: 33746 - DNA, 880 bp, Heterodera glycines
atgaagcactaaactcatttccacccaccgacaaaattgttcaccaaattcaatcgctcaaaaaacaataccctcatcttttcaacaaatagttctaccagacctccaacaatttcttcaaataaaaatatccctcaaaatttctctaaaaattttacccaaaaaaaaaaaaaaaaaaaaaaaaaaaaaaaaaaaaaattttttttccctcttttacaacccctaaaaaaacaacaacaattttccctttgttggaggtctgacttttctaatttctgcttcttcattcaaaatttcaattatcttttatcactacctttcatttcacctcatttccgccaaaagtataaggggcacatgcccttcttttggttatttttatttttatttttgaataaataaataaatattttttactttttgtcgaaaaacccttaaatagcaaacaataaattcaaaaatatgttgtccttgcccggtttacctcaaaattcctggtcccgaccaccctattatttatttctcatttgacttaattttagtatattgttgtgaattttcagggaatagaggcaataatccttcaaattttttaattttttctaaaaatatgctaaaaaccttgtcctccaccccccccccccattttggcaaaaggattttctctgtaaatcgccctgactatttgtataattaactgtgcacagtgtattagaataattgtaaatcaatttataatttttattttaaaatcgtaatatgaataaataaaatatagttcttattcaaaatcatcaaaaagtcatcatcaataaatcaatatggacaaatataaatttatatttttagggccctctgattatttcttcacacacaatgg

SEQ ID NO: 33747 - DNA, 899 bp, Heterodera glycines
agagagagagacagagagacagagagagagagacagagagagagagagacagagagagacagagagagagagagagacagagagagagagacagagagagagagacagagagagagagagagacagagagagagagacagagagagagagagacagagagagagagacagagagagagagacagagagagagagagacagagagagagagagagacagagagagagagacagagagagagagagagaacgggagagagagagagagaacgagagagagagagagagaaagagagagagagagaaagagagagaatgggtattctacaaataaaacaaaatttgaccattttaatacatatatataataaaatgtataattaaattacaatttttaattgcttcggagatggaaaaattcccaaaaattatgtgacagcggccgatcgcttttcactgttctcatcggcacttttctgatggtcaacgaaatggaaaaattgcaacacgaactgacgcgaaagagtgaacactttgaggaaatggcaagtgaaaaagtggcagaggggcgggggcaattaacaaaatagccaagggaaaggctggtctcataaaaaattcaaaaaacctaattaattaaaattattatttaatgatttttatttgaatccgttacgcagaccaacaagatgtgagattttttgatgggacaaaacaaaatcatccgcacggagaaagccaacaatcgaaaacggcggcaatgttaaacattagaaaaaacaaaaaaaatataaaaatgagattaagacggcctttttggtgttgacactttcgccgtttcgccttcgacgtgccaacaaggggtcaagggcccgcaggggatcgcaggagaaccaggcac

SEQ ID NO: 33748 - DNA, 1412 bp, Heterodera glycines
  misc_feature (43)..(43): n is a, c, g, or t
  misc_feature (1390)..(1391): n is a, c, g, or t
tttttataccacatgaaacataaaattattattaaaaaaattntttttcggcccatctatttttttttttttgctaattaattaatattgaaatatgttattatttttgtatctttaattttgattatttcgttcctcaaaatatgtttttcaatttttcatttttatttacgttttgaaatgcttttgcttatgctttctgggtattcatgttctttatagatcgatatgccaaaagcaggcactttttggccttttttttcttcttcttttgaagagatcgcttcaattttgatcaaagagtcaaaaatgctggaataataattaaattataatattataaaatcatttagattttatctttttgaaaaaataaaaatcgcttggaaatgattgaaaatgtttttaaatctgatgtaggaataattacttaacaattttggtcttgggtttttcttataagggaaaagaaattcaaataaaacaaaaaagaaattaaaattgcatttacatttaaattttcacctaaatttgttcgccattccggaaggtcaaaacattttgtggcagcaataaatgcttggattctgttgtggccaatcttttccgatttttcatcaatttcgccgttggcatttgtgccgtccgctcttttcccatggacatatgccacaattgtgtcccaaattaaaacagcaaattgtacaaatgccattcattcgcatatttcagtgggaatgcttcgctttggtattgttcacttttctcgaacacagcgttggggtcgtttggatcctacaaaatttttgcaattttaaatattctttatttttttattataattttattttattaatttgtaccgtttccacaatcgacggtaagcacagaatgcttagaaaaaggataattggtgagaaaatcatttttcggggagtagggtttgggtttgtcatgggattgtttcagctttttttatgaagtgtgcttttgttgagcatcgtcgggtttaaatagcattcactcatcagtaagtgcaaacaaactacagatcagtgtaactacagaaaacaggcaaatcacaatgatcagaagaatggaaattcataaaaatataaaattatattttaaaaatttaaaataaagcataaaatgacaaatcacaatgctcaggagaataaaaatagaaaattataatgataaaattttaaaaataaagcataaaatgacaaatcacaatgatcaggagaatggaaattcataaaaatattaaaaataaaataataatttaagtataaagcacaaaaatggtaaatcacaatgatcaggagaatggaaatcataaaaataaaaaaataatttcgattgttttgtgtcagctgattttttnnggagatctgatatgctgattt

SEQ ID NO: 33749 - DNA, 991 bp, Heterodera glycines
  misc_feature (15)..(16): n is a, c, g, or t
ttgcatgctctgcannggtcttcattgttttcatcacattaataactatcattgttttatcactttatttttataataatttttatttttatcttgttttatcttgtttttatcactattaatttcatttttttatcacattaataactatcttggttttatcactatcactttattttatcactatcaattatcattatttttatttttatcttgtttttatcactattcattgtttaaatcactattaaaatttcattattttatcactgtctgaaaatatcattgttttatcactttatttttataataatttttatttttatcttgttttatttttatcactatcaatttctttatttttatcacattaatgattatcattgttttatcactatcactttgtttttatcactattaattatcattattttttttatcttgtttttgtcaatatcaatttcattgtttaaatcactattaaaatttcattattttatcactgtctgtaaatatcattgttttatcactttatttttataacaatcaattgccatgttttgtttttatcaatatcaattaacattgcttttatcttgtttttatcactatcaatttcattgtttaaatcactattaaaatttcattattttatcactgtctgtaaatatcattgttttatcactttatttttataacaatcaattgccatgttttgtttttatcaatatcaattaccattgcttttatcttgtttttatcactatcaatttcattatttttatcacattaatgattatcattgttttatcactatcactttgtttttatcactattaattatcattattttttttatcttgtttttgtcaatatcaatttcattgtttaaatcactattaaaatttcattattttatcactgtctgtaaatatcattgttttatcactttatttttataacaatcaattgccatgttttgtttttatca

SEQ ID NO: 33750 - DNA, 796 bp, Heterodera glycines
atcaaaaatcgcctccctggcccccggagagtccgccgggaaattcccgaccattcaacggcgcatccagcggcgcccccaattctttttctttgggccgggacggcggcgtggtggcggaggatggtcccgagcgcctcccccaaaacggtcttcatcatccgacgatagctctcgaggagtcccgtcgttggcgttgaacaccaaaaagccctggcccgtgattcccggccctcggtggagggcgctcactcctttctttcctctgccattctcgtcgctaattttttttgcgacaagcagtacggtaatatatggcaccaaaaataaattcagaaaaagcaactttcacagaatttttatcaaagtcattagcagtacagtaatatatggcaccaaaaataaattcagaaaaagcaactttcacagaatttttatcaaagtcattagcagtacagtaatatatggcaccaaaaataaattcagaaaaagcaactttcacagaattgaattgtttaaatatgatgatgaacttattgatgatagaaattaacatgaatcaaattcttgaaaataataattaattaatttttataaaataatattcattctcaatttcggtagtaccatttcgttaatcaatttcgcttgttgttgctgatgttccgattgtttcaaatttgaatggttgtgcccttttctcatcattggcattgtgccttggtcaatcagctcaagttggtgtgctttttgttgttgcgcgtttgcatttgctttctctaatgccgacccccgg

SEQ ID NO: 33751 - DNA, 710 bp, Heterodera glycines
ttttctataaccaataggattaactagccgaaaaattaccctttaaaatgaccagcataagcggatgttttttgataattcgttaccccattttgctggaccattggcaatggtatcaatgggagaaagaagcgattgaatggtaaatcaatcagaagggagcaaaatttaaatttttgttttatatttttaaattttcgatattttataatttttgttttatatttttaaattttcgttattttataatttttgttttatatttttaaatgttcgttattttattatttttatgtgcaattaatttgcgatgagattcaaagtaagtaaatttatcgagctaattagttataagtcataaattgaatacccattttttgggtgctgagtcgttatataaaaacattcaaaaaagggcgttatataaaaaaccatcgaatggatttcaaccaaaaactgcacataacttttgttaaggtaaacagaattaaacattcttggtattattcgatagccctaacatttctctattagttcaccttaatttcaaaaaatttggtcaagtttaagcaaagttatggccaaaagtacccaaggcaccgggttttcaaacttttttggccataacttttttgaaactaagccaaattttttgaaattttggaggctaatagaggacacatagggctatcgaatgatagcaagattat

SEQ ID NO: 33752 - DNA, 920 bp, Heterodera glycines
gagaagagactgagggaagagagaaaagagaggggggtagagagagggggagacagagagaagagatagagagagagacagagagagaagagaggtctgttgtccttttttgtttttgctcttctggcgttgtgctcccccttctgtcattcgtttctctgttgtcccatcaaataggcggtgtggtgttggacagaaaagttgtccatgaaggaaaggtccaattgctgaataaattttgctcttttatgctcaattaatcacttgcccttgcccattcgaatgaaaagtgatcagtgttctctgactgatatcagcaaaattcacctgcatcggtcgctgatcggcggccattcgttgtccgatttgtaagccgccgagaagactctccacgttgggcgcctctaaatgattttggctgagcatcgacacgatttcgtcgcttctgaagggcaaacgaactgatcacaaattgcataaattggaggacatttccatggaattgccctgctgaatgtcccccggcgaccattggttggacattggcgaaggcgaatcgctcccaagtgccgagcacaatttgctgaatgggagagaaggactgatcagagcggaaactgacctactggagtggattttgacaaattaacataattaagacatcaattaaccatcaaaccccccccccccctactgaccttcccgtcgttttggccaccatcacaatctccgattctatatatccccgtcgttgattcgttcgctcgcagccgctgctcctcactttcgaagtaggcaagcatttcttctttgtcgaagtccgggtgcagatatctgatcagaaatatcaatcgatgctcattaattgccaaaggctccgtgggtgggcagacacaaaatgccaataattcaaaaaatgc

SEQ ID NO: 33753 - DNA, 1031 bp, Heterodera glycines
cagttttcgcctattctcaagtgttggcagttgcaggtattctaaccgatttaggtatggaattggtggaaggctgcatttaaaaaatacccttttggtgaaatatttttgacacttttctatttgttaaatatttttttgtagagacggattccaaacctccggagcgtattccaataaaggcctaatataagttttatataacgtaatccaaatcttagatgatttggatttaattattctaaacaaggaactcatacgtaaatacgcattccttgttatttggttaacatgaccggtcacattttttccatttataattgcctcgtaccaatcttccacaactgttattagttgacttgtcgtagacctatttctaacaaaaccaaattggtattccgaaattttattgttttttaggaggaagttgtaaatattttggctaagaattctttccataaccctgcaaagtgagcaggttagagaaataggcctataattttcaggattagatttatccccttttttgaaaagaggtaaaactattgattccttccaaatatctggaagagaaccagaatctaaagaaatcctgaacaggtcagtaataacagttgccaatgaagaatggcagtttttcaatgttttatagcttatatcatccggggatgtaccatttttattcgggagttttttcaaaagtttttgtgtctcgatgatgttaaagtctatatctgatataaagcattgattagcaaaagttgtacccaggctataacagcctgggtcatcttcagaattattaaacgaatttacaaataaattggcaaataattcacatttttcagcaccatcatgatagcatttggtttcaaaaactaaattaggtatttcaaagggattaacctcgtatttctgtatatatttaaatatggaatttcttccctttgaaaagaattttgagaacattgtttggcactaattttttctgaaaaacaaaatcaacagtaaaaaatttaacaaacgaaaaa

SEQ ID NO: 33754 - DNA, 882 bp, Heterodera glycines
ttttctgaaaaaatatttatgaattaattatgcaatcctacatgaaaacgaaagactcagattttcgaaaatttttttcgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcggcccactgccacccttgcaaataaataaggcaaacgaatacacggacttactaaaagaaatgagtgctgagtatgattttccatgtagtcatatttagcactatattcttatcacctgtgacttaatagcatatgcttgatttatttttattcattatgtattactgtactcgcttagtatttttcgatttgaccaaatgtatttgatgttttcttttcgtgaccttagacgagcacacacgtgcctctgttgttgctcgatgaatgatattatatcaccgacaacaattttcaggaactatgtccctttttgacaattgccaagagtttttttggaatgggaattgtataaaagctattgctcaactatcctatggcttgtctatatgaagtatgctatacactccgagtcagaaaacgatacatgcgtctatatagaaagagcgcagagaaacattttttctctaccttttctctccttttgacagactatctaatatcttcattattaggaaagacaacatttacttcgctaggctttgtttcttttttatatgtta

SEQ ID NO: 33755 - DNA, 883 bp, Heterodera glycines
ttcaattttagtgtcaaatattctctttcagaaagattccgctgctgataaaaaaattggcaatgggccgagagattaagcaaattagcaaaaatttggcacttgccgccctcccctcaaatgtcttacaacgataaactctgtgaatagaagggcaaaacaagtcaagaaaacagttttagtttttaagagccataatatttttaggcggcgcaaaaatagactgacagcatttctttgattacaaatgcttactaaaaaatgtctcactaaaagtgtggtaagcggcggggccgggaaggctcaacagattttcagggcggagtgaacagtcacaattttcagatgggaaaatgtgtaatggaaaaactttaatcactgctaacgcaatattgccttcgcctaatctatggacacaatcgcaatgaatacagtttaaaaatacatttttcaatttgttttgaattggataaatccatttgccttatcgtttcaatctgtccgccgttctccgcgtccaacgccgtgggaatgaatgctttggctgtttggaattttttaaggattgggcaaaacggcgcttttgatctccattttttcaccacggcctcctccgttcaccgcctccgccatcagcgacagcaatttgcatttgtgatgtttttatgttttgtagaacgaaagaacaatggaaaaaattacaaaaaaaagaaaccgattggtacaaaaagaaaggaaaattaatggggttttattacatgtggcggatggcacaaaggtttggcacgggctcaacactttgtattcattgatctatgcttaatagtcaatttaattagctttgtgcaaagaaagacctgcctttagatatgtaatttaatta

SEQ ID NO: 33756 - DNA, 953 bp, Heterodera glycines
  misc_feature (940)..(940): n is a, c, g, or t
ttcacgtccctaacgatcagtcacggaacaaaaaatttttgtacgcgttacgttccggacaaaaatttacagtgacgacggaaaaatagggtttttcatttcgctttttccattttcaagggaaaataatcacaatccgagttgaagcagtggtcagccaaagaaagcatgccctgctcatatttggaaatatcgaccccgtgttgaaggtaaatttcaaatttataacttgaaaaaaattccaacacaaaaaattgtttagtgtcgcctgcctattctttagacaccccttgaaaaatttttttttattgaaaaaaaaaattttttttttgaatttcaaataaatgatgcagaaaatttacggtttttctctaaaggtgaccaaacttttcggcttttttctaaaatagtaaaaaaaaaaaattatttttttacgagtattttgaatttattatttttttgtttgctcttttccgctgtgcacaccgttaaaaaatcggtctcggcctttttaaaaacctaataaatttatgaaattttccaaactaacagagatcatactgtaatgctattaaaatatagtagaaccaccaattgacaaatatgaatgaagtttagccttgaaactggggacagagttggggaggggaaggcggaacaggaaaaaacttcgccgccgaaattatttttaatttttcaaaatgagtttttcatgaaaaaatcatagaaaattcttaacgaaaaggaaaaaatttataattttttaccgctttttgaaattttatgacgaagtattaaatttatttattcggcgaaacaaaatttcggcgtcgtaattttgtttcggcaaaatttagtccttcggccgagaaaatcggttatggtataaaataattgggttttttggggcctcatctgcactttaaggacattgttaganaaaaaattttttt

SEQ ID NO: 33757 - DNA, 924 bp, Heterodera glycines
  misc_feature (892)..(892): n is a, c, g, or t
  misc_feature (910)..(910): n is a, c, g, or t
gtataaattataactaaatttgagatttttatgtgccaattgctctgaaatatgtaatataaaatatgcaaaaaatgctgaaatatgtgctaaaaccaaaaaaatgcaaataaatgtgctaaaatatgattgaaaactagaaaaaatagccaaaatatttacgatatgtttcggagaaaatgatatttttggcttctctcgatctctttttttccctttactccgctcaaaatttttccatcctatttgttaaataaaaattctatttttatcttattatagacttgacagatttagtcatattttgacatttttctttttttttagtccgtactgtaatttttttttaaattgagcccccggggctctatttttgaaccccatcccccaccttaagggaggaaggctttaatggagggggtctattttaggggaaggagctatgttttcgtaaattaggtattaaattttttgcgtttttaaatacacgcaaattgacgcacaaagaattcaaattgcacatattttaacatttttggtgaatgagcacatattttggtgacattttttggcccgtaataattctaacgccaattatgccactccaaaacacttttggcaccctaattacccgcttccccagaccttaattagtgcaactgtttctctaatcacagactgccgatgataatatgcttctccgttccttcgtgcaagatcgaacaaatttcgccgaattatgcaagaaattggaaaaattggatttgatgaaaatgatcacttttgtaaccaggcgccgtggcaaggctgtgtacgatagtggggaaacggtggaatatttgaggcagcaattcgaagcataccttggcgtaatgcatttgatgcgacaganatgggcctgtgagcattntgagaaagcaaagc

SEQ ID NO: 33758 - DNA, 517 bp, Heterodera glycines
gttttttgaagttttctagccataccttttttgaaacataatgaaattttttgaaattttgcaggctaataggtgactcttgaggctattgaatgataccaagaatgtttaatgtgtatgcttctaaagaaagttataatgcattaaatttgtcaaaaattttttatggtcgtgtgaactgcaatagagcccagcttttaaccaaaatgaaatttttgaacaaattttccacaaggcctcaaacaatttcacaacaccacaaaaatttctggattgacagctcaaaacccacaaatgagaagggataatcccgcacaattgggagtcatgaaaaaaagattaaccccaagttaaatctttttcaacaactcttggcaatattttttttggttatttgcaaaatgattcagtgtcggtcgatggccaaaaagaaacgagtcgggtcctcattttactattggaattattaacgatgacaaaaaatggcctttttattcgccgccgttcgtgctttccg

SEQ ID NO: 33759 - DNA, 1083 bp, Heterodera glycines
aaattgaaactcttctcctcatgaaaacgcatctttcaattaaaaaggaaaaactgaataaaattgtcttttttacttattccaaattaaccgcaaaatcacgcgacgcgcctctcatactgtaactgtacatttggtatcactttctgcatactgtattttcggtagtcgtccgtgaggaattcggagtgaaaatttcgcattttcaccgacgcttcgttcgcttcgcgttcctttctctgccgcgtattacgcataaagatggaagtggccaacatcagcagcagagaaaagcggacgaaatcagcggaattggccgaacagaaaaaaaagggaaaagaaaaaagaaaagaaaagggaggaaaagggaaaagagggggaaaagaaaaaaagaaaaagtgaaaaggaaaagaaaaggaaaaggaaaaaggaaaaaggaaaggaaaagggaaaagggaaagggaaaaaagaaaaagtgaaaaggaaaagaaaaagtatgataatagggaaaatgagtgataagaagtgcttgatgaatacaagttgattagaaagaattcacatcataaacaatgacttccctaaacaataattaaaatgtttaatttgttttatttgtgcattttttttatattcgttaaatgaattttatggattttggcggtttcattttatgttattgccattgtatcgcagttgtgtcgagtcgattatcacttattttcaacacattctccgcttgaaaagcgacgaaatgcgatgctttttccattgggggaggggacaaaaccgaaaagacggaaaagccaaagccaaagaacgaaacgaattgatcggagaatgaatggcacaaaaacaaaagtagttttattgcatttgataacatcaaaaggaattcgaaaagttggcacaattttattattgcaaaaagagagaagacaatgaaatgactgactaatgatttttcatttgttcagttgtgtgtgtccaccccgaccgagaagaaacggcacatccaatggaaaatggactttttggggaaaaaaacaaaaaacagtgccgccctttttttttggagggggg

SEQ ID NO: 33760 - DNA, 898 bp, Heterodera glycines
  misc_feature (44)..(44): n is a, c, g, or t
aaaaaagtttgtccccccatacatcaaaagttttccaccccccnccgtccttatcaaaatttcaaaaagtttccacatgccaaagccgtcagcacttcaaaagcgactccgcctccctcactctcagaccagagtgcctgtggcacacgcgcggtaaaaccatgcgccgcctccccctcactctcgcacgcacccctccctcccgcacgattcgactcgcattcgttacgcacgctctccaggtgtttgttcaaattaagtatatataaaaaatagccctattcagggatacccattcaacccttgcttgatgggaacgactgttcgcgcgagtgtgcatattcgacttccaaagatcagcgcaaatcacgacgacttcaagtccatctgtgaggagttgaaattgcagatccgcgggattcacggcgaacattccgagaggtaattatttattgttctgtttttgaaacaattgtcctttatttagcgctggcggcgtttatgacatcagcaacaaggcccgtcttggtctcacggagttcgaagcggtgaagcagatgtacgacggagtgaaacacctgatcgaattggagaagaaagcataatgggaggaccgatctatgatgatgactttatattgcgtaatgtggagatttgctagttgttctgaatctcttaggctttaactatttaattattgtcccaaaatcgtgcttcatccgtatgattatttccgtgcataaatttgttcgtgttctgttcgagtattgaaccccttcattgcaagtggatactaacaagcgacacccactaatttttattgattggtgtgttaaaaattggttaggaatcagtaaaatggttaaattgatggttcggcacccatgacttatgccgc

SEQ ID NO: 33761 - DNA, 1292 bp, Heterodera glycines
ctcctacgaagtgaaaatttttctcaaaaattcatttcctacctgagaacttttaactttaaaaattatttttaggtaccttttagggtttttgtctttaaacatcccagtcctactcatttgcaactgcaacaagataataaaattatttttgcttaatttttggctaaaattatgtcacttttcccactgttttggcatttttactcactcactattttaattaactattttgagattttcgtcactaaaagtagcgaccctactaatagctatttaaataaaaattactttatcatgtatttcatttggttttcaactgtttgggtaaaccactgccccgcttggatagcccttccaaaacggtcgttttcacaccgaacaacgatcacattaattttcttttctttgatttcattttctccgtccaaaaagaaatagtgactttgtgtagcaaggatcgccaactgaaatgcgttactccaatttgggaaaacgatgactgtgtgaaaatatctaaatttaagaaattacaaagataaaaacgaaattaggcattttgaaaaatgaaccagtaatactttggatggtgcccccccccattttttggaaaaatattttttgttttcaaaaatcatgaaaacatgtttccaagggttgttttatttaaaaaaagtctttttaaataacttggggatatatcaaatccaataaaccgtaaatgtttaaatttgaaatttattacttacttttttgggcctattatatcaagcttttcctttaccctctgcgctacttttttatactcggcttcactctcaacaatagccgttgtaccaattttattttttgcatatgcgcgcgaaattgttggccaagtgacttcctgaattcaatttatatacgaaatgaatgcggtttacctcagtgtgggccattacggtagaccggcacggttgggccctcaactttgggccccagaatgtttttgcactatatatatttttctttgtcgaccaaatcaaaaatcatggtacctttcgaaaacttaacatatttagaagattttctagctattgctttgcgattaaaaaattgataaaaaggttataacatcaaaaaccaaaaaaggtcaaaatttttgaatttttttttatatactagaaaatctttttgctttttgtaaggcaaatagagcacgtcatgatgagccgaagttaccaaaagtataaatgattgaaatatttaaatttattaattattattaatttatttgttatataataaatcat

SEQ ID NO: 33762 - DNA, 671 bp, Heterodera glycines
ggtgctatgacgttagtcaaaaaccatcaaattaaaatattttttgatataactttgctcaaaagcaacaaaatttttaattcttgatatcaataaatatccctaagtgatttctattatttaaaagaagcaattgttgacttttataaaatttatatagtttaatcattaaaattataatattattattttttccacattatatacttaagcattgacaaaatttgttaaataaatattatttttgttacacaaaacggatgtataattaatttaataatttttcaagatcacaatactataaagaaattcattttttaatattagaagtcatggattaaatgctgaattgttttctcagtttattaccttttcatttttagaggaagaaaatttttgtcttttcaatttactattttatggattgattgaattttgtaatcatttgtttaaactagagtagagcgggaccgggaattttgggcaaaaccgggacctgagaagccgggacctgagaagccgggaccgggacctcggattttgtccgggaccgggaccgggaaccgagaccaaccgggaattttaaaaattcaaaaaaattttaaaattaaaaaaaaaattcaatttttttttatatcaagggaaataatacaaaattatttggtttttat

SEQ ID NO: 33763 - DNA, 616 bp, Heterodera glycines
aaaacaacaaattgctgctctctaatcagcatggtgagtcataaaaccgcaccaaaattaactcgagactaaagaccaagaagagaatgtcaaaaaaatttagtggatgaatttttaagagaagttttaaattcttagtggtatttttgaaaaaaaaattcaggttgattcttagggatgtaacaaaatcgcaaaaagaagtggtgaaagtgactgcaactgccggttcaacactggcgtcatcaaattgtacgccatcggcagtagttccaacatcgatcaacaaccgaagcaaataattgtcttccggcatttatgggttcgaattccgttttctaatttttgaacagccgtcggaatgccgatttccaatctgcatcgcgcttttttcaaaaattcacaatctgcctaagtcgaaccagattaaaaatgtaaagttcaaacatcaggcgggcggcatgaaaaagacattttaaaaggattaaagataatctgaggctgtttataaatgctgttagttaatgcatcactgttttataaatagttgatcatcacaatataaagtctcattttattgatcctcgaacgggggctcacacgcagactattgagaggc

SEQ ID NO: 33764 - DNA, 901 bp, Heterodera glycines
ctgagaaagccctcgacagttgctctaatccgactcattgtctgcagtcgctacaatcggtcgctggaggaacagctgatcggtttcacgaagacggaaacaaaaagacatcagccatggtcatgtccacgggtgggccccactccaaccttggcctgatgagcagcagcggtggaccgcactccaaccttggcccgatgaacccacattcggtccagaatccactttctgtgcagaatcctcattcggtgcaaaacccacaatctgtgacgggcattgccccgggctcagtgaaatcgtacaatgatgatatgcagcatcaaatgcaacagcaaaaagcaagtggaagtaaagaggaaggggcaaatgaagaactgacagttgtggagcagtacaacgaatccagggaccagtttatgaacgtatgcgacaacattgagcgcaacatggtatcattgacattggacttttaacaatagagtgtaccttagattatttttgggtttttgtgtcggaaaaggggtccgacgtaccgacacgcgaagttgcaagggtgggggataccgagagaatggaccggactattccatactcattagaaaattttcagcaactcatcctcgaagtaaaccgtcaacagagcaagctgtacaatcagcagcaaaattctgcagtcgcgtgggttgaagtgacatcaatgttagggtgagccactaattttaactcgttcattcaaaaacgcattttcaagtgttcacaccactacgctgcctcaggtactccgcggttacactgaacttatgaacgccgacaaacaagcaatacgggagaacatcgatagcctgaacagcttgctgacgaagttaggtggtgtagaacacaacaacggacgagcagcaaa

SEQ ID NO: 33765 - DNA, 85 bp, Heterodera glycines
tccactgacgcgcgctacaccgaacccgctcaactggccgccagcaacgatcccgaacgcatcgaccgcgacggcaccctggtcg

SEQ ID NO: 33766 - DNA, 993 bp, Heterodera glycines
  misc_feature (943)..(943): n is a, c, g, or t
attaccctttccattctacatatttgtaaatggcaaagcaaaacataatagagaaaacggcatattgccaatgtgtgctgaacataatgaataagcaaagagcggccccgaggacggataacgacctaaaaaaagaatgtttcgccgattttggctaatatgggaccagtgatagtaaacgaaacgaggacgccaattgggagcacccaaaatggaatgcaaagcacaaatgatgttaacgaaggcgtaacacatcagaaagaaaaagtcaagcacagccgcaatagtgtccattgcgcccatcaaaatgccaagttcggcgatgagagtagtgagcagcaagccgaagaagggctgaaattgtcgaacgaatcaacaaaatcacaaactgttatcaaaacaatacctcattgcttttggtcactttggcgaaacgtttgaggaagggaattacgttgtctttggcaatgctctgcaaaagtcgaggcgcgcctatttgcgatgaaaaaggtgagaacaaaaaacaaagtttcatactgcaaagacactgaagagcagcaccgaaggtagaaaggaaggagccgaccagaaccacccattcagtaggccatgccaactgcgcaacgaccattcgcccgtccaatgagaggccggtcctttggacgagttaagcgtaaatgggaagtgggcctacccccgaacaattttatccaaacattcattcgaaaaatgaattgcgtttaaaaaaggacgcgggggagaaaagcagcgagagggggcgagggaatgaaattatttttaggtttttacctattttcccatttttagcacctatttttgcagtttttagcacctaaaaatcgtatccccataaatgaccatttccccgccctttgtccacgctcttctcccacatcgtcctgagaaatcgctcatgaaggtngaatttcagtgaatatatctcccactgtctctgatcagttcgggtttgat

SEQ ID NO: 33767 - DNA, 284 bp, Heterodera glycines
aaaaaggtcaattttcaaaattaaataattcttttgctatagtttgagtaaatttttttgtgttcgttttatcagtcattttcggcacattttcgaatggtttcccaccgtaaaaaaagcctaaaaaggcaaaaggtaacaatgggaaggaatgggcagggcaaaaataaagtcttccattccgttctcaattttcttcgtcctttcccaaaatgcatacaaagaaatgacacgacggcacacatttgtgggtgccgcgtcgggggggggggtgaattaattat

SEQ ID NO: 33768 - DNA, 1136 bp, Heterodera glycines
tgttcaaaaatggaaggagcaattctagtgcacatttcggtcttttcaaaactgctcaaaaagtgaatatgcaaatgtgttcaggtgacaattattgtgttttcgcgttggtactacaaaacggagttattggacgaagacatgaaagagaagctgaggaactcaatggaccaccgagaccgatactatcaggttggacgggaagagaatacaacgacaatgagtcgcaatgatccaagacaggcctcgttacctagaaaattgttttgggaggggcacccgaaaacttttttacttcgacgttatggggaaaataggaaattttagccaattttctccaaatttggtatttttgagaccaaattttgtataaaaaagttttgaatattgggacccggtggtcccaattggcgccgtggggaaattttcgaaaacctgacccaagagaagggtaaaaccctgggaaattctggcgatgccgattttaacactcattgaccacccgtaggatttctattggctgttggtgcaaaacgaacattacaatgactggacgcatattttgtcaaaagtgagcctctgaaaagcctttgctttatccgtcgtttaagctcaaactgaccttctacaattacaagtcgtctattgagaaatacaacagagaaacttttccggtaattgctttttgttttgttataatccgttaattgagtcattaatatttttcttttttaatagacatacggaggagaaacctcattttatgtgcaaactcacgcactttgctcaattgttgattcatttttattcttttcatttttgtttttaataaagattaatattttcaatattaaatgtgttttatcagtttatcaaataaattgttttaatacatggtaatattcgaaacagtcattatactcttatccctaacatttacagtaatttgccaattgattgacggcggtcattgaattcctgttatttgtgttgtttctatcgtttttttgtgacaaatgaaatacgcccagctaggtgagtttggctttatcagttcgcttcaaaagttgtcaattcgcaatgcttttgactttttcagttgtcggccccgccggcagtgggaaggtaaaaagaaa

SEQ ID NO: 33769 - DNA, 213 bp, Heterodera glycines
tgggattatttttcaacctcctcagaaaggggggcataattggggacagcgggattaatggagacagggccataattagagaatatacggtatgtagatttgatcaatcaattaaatgcactcctggacatgacatgaggaatcgaaggaattagcattgacgaaaaccgcttttcgtgacgcgctttttccaaaaacttttgagaacttggg

SEQ ID NO: 33770 - DNA, 1236 bp, Heterodera glycines
  misc_feature (120)..(120): n is a, c, g, or t
ggtttcctataaagaaaatatgatccctcatagtttttttaaaattgatacatattttatcatttttaaatgaaaatcctaccaattgagcttataatcccaaaaaccaatcttttttgnttgaaaatctgttaacaaattacacctaatttttaaaatttctcacgacggcgcctatcggcaccgccggaccccttctttcccaaaagttttttgaaaaagcgctccgaaaaaaagtgatgtgaaaatcaaatctgaatttctattaatattcgatcatttagtccaaaaatgattaattgtttgaaataattgaagaaaatttgtttggaaattttcattaatttaatttagctttaacttttggattttattaaataaaaaccaaataattttgtattattttcacttgatataaattaaaatttgaattttttttttaatttttaaaatttttttgaatttttaaaatttcccggctggtcccggttcccggtttttcttgcggtcccggtcccgaaaaaatatcgaggtcccggcaagtcccggtcccggttttggcaaaattcccggtcccgtgtcactctagtttcttcccatttttctccaaatatttctgcaaaggttttttgttcctttttttctgctccaatttcaattagagtaattaaaaatgcaattaaaatggaaaataggcactttgggacaatttttttctaaatattcaagttgtaattaaactcacaaaatgaattttttgcgctaataaatcctcgacttttaagtgagttattgacagaattgtaaataataaaaattatacaatttctctctactaattagtcgtatttaatatatgtaaataaaaaatatttttaattaaataaaaggggagagagagagaagaggagcgatagagagagaaagagaaaaaaagaggagagagagagagagagacggggagtgaaaagagaaagaaaagaggagttgagagagagaggtagggagggagggagagaaagagaagagcagagagagaaagagcaaagaggagagagagagacggggaatgagagagaaaaaaaaggagagaggaaaaaggagagagagagagagagagacgggaagagagagaggagagagagagagaaagggtagagagagacgggaagagagagagaagaggagagagagagacgtgacaatatgaaagaagggtaatttagttttcaaatc

SEQ ID NO: 33771 - DNA, 258 bp, Heterodera glycines
ctcaaagccaatgctttctaccggctttgccaagaacaaggatgctgacggcctgagcatggccgaacccggagccatggccgagcagctcaacgccgaagtacgcacccacacccgtatcagcggaatcgaccctggtcataagcgcctgtggattggtgaggagcaggttatctaccgcgacctgattctggcttggggggcgcaaaccgtgcaggtgccggttgaaggcgatgccggcgatgcgatttttccgat

SEQ ID NO: 33772 - DNA, 868 bp, Heterodera glycines
gttcaagaattatcgactattttttaaaattattattgttttttgtcaacctaccaacaatgagcacggcacaagccaaatcacgcctgtacaaattcatcagcaattgcaaacgctgcgaatggcaaatggtgctgctgctgcttctgctgtcattgttgttgtctgttctcgcgctgatgccattgttgttgttgttattgtcacaattgttggcacaatgccaagcggtgaacgaattaacattcatgttgctgttgatgcttctgtccacggtcagcaagtcgaccagctggttgcaggtcaaaattcgcgcattgtgtattgtctttagctgggcacctgcaatggtttattagagtgaatgaacatcgattttttttttttgaaaattcatgcaaaaatatattaattttatagacgaggaatgaattttctgagttcccgagactttaagctttcgtttggtaccatgaatgtgtgttttggccaattaagaaattgaaaatattggaacagagccgaatcgcatacccgtcgaaaatcggttcaaaaagaaattttgttaatttcaaattttgcaaaatgtttgataattgattgtattgattagcaaattccgaggtattccttcctgcttaagtgcctgatgatgtcaagaaaaaaaatttttttttttttttggaagtttgtacttccacagaccaatgcaaatggtgaagctctcagaggagactttggatgttgcaacgggctgacgatgaatactgccaatgtcagaatgttgtcggtgtacggccataattttcgaatcgcacgaatgtgacctaaaataaaaagtgcaacccaatttttttctactcacact

SEQ ID NO: 33773 - DNA, 285 bp, Heterodera glycines
atccagaatgtagccatacagactgaagcagaacatcgccggagcgtaaccaataaagctacccaacgccatcgccgcacctgttttattttcagcaatttttgcttcgccgataggtgcaaaaaatacggctcgctgtgtaaagactatcgcgccaaagcccagcgtacatgccatccctaaatagaccggcatactttcgtgcggcagcataatcaacagtacgagcgcagcggtactaatgataaaggtgtagcatagatatttacttggcgatttcaggat

SEQ ID NO: 33774 - DNA, 298 bp, Heterodera glycines
taataacgctgcggacatctacatttttgaattgaaaaaaaattggtaattactctttctttttctccatattgaccatcacactcatactccccccacccttttcttcttccgccacccaccctttctcctccttcattttttttcctttccttctccaaccctctcctccctctcttgatagcttaaactgaaggcgggaaacgacaatctgatccccatcaagctagcttctgcaggtcctgctcgagcggccgcccggggatcgatccccgatctagtaacatagatgacaccg

SEQ ID NO: 33775 - DNA, 1573 bp, Heterodera glycines
  misc_feature (620)..(620): n is a, c, g, or t
  misc_feature (1492)..(1492): n is a, c, g, or t
  misc_feature (1509)..(1509): n is a, c, g, or t
tagttttttaaatggggattttgaaaattaccgtgaatataaagtcaatgagtataatttttagaaaatggcgaaacgtcatagaaccgaaaggaaagagggagaagaaacagaagaaagggaagagaaagagaacaaagaaagggggaaagagaaagagacagaaaatgaacaggaaatgagggaacttggccaaatggaggtcataaattaattaataaagaaaagtcaggaatttgaaaattcaggatcagatttcgggtgggagccagaccgggtcggattttactaataaaacattgtttttcaagatcctgatccaggtcccaaacttttgaccctgaccacgatccgtttctaaaaatgcctaaaaaatttaattcgagaaaacaaaattattgaggcgtcattattagtgctcgactttttgaaaaaagactgggcctggatttgttgggcctgagcctggcttgcgtggacaaaatttcggaaaaacaaggtccatgagaaacccaggttgccgaaaaaggcccggaccttgcttgacctggatctaggaaaatccagacttggacccaattccaggtcgagctctatcaactttattatagttaaactanatgtacttgtcaaaaatatcttgagactcccggtaaaattatcaaatagcctcagcactttagcttaattattttctttagcatccgttgccgaattatttgttgccagaagacaaaatcccggagtataagctgcacaaatgcacacagtgtttatgttcattttattgggccaaatcacttcaaaaacactcatgcaaaggccaacagacggagaaagggacagaagaagaaaaggaagcggtgatcagtgattgattgaaaatgaatttataataatttaaatggattaattaaatccgaaatttcagaaacaaactgttactgatgctaataacccgggagagcagaaggaggcaagtcaatccgatgcaaaagcattgggtgaaaaacagcagaactgttatgatgaggtaaatgggttttccagatctgggattttccttatctgctaaaagtctgtaagaatttgcataaaattagggtttgctgatttttttgcttttttgaaaaactttacctgacgctgtctttttttatgaccaactgaaacatgatcagcgtcagacacatgaacaagctataaaatatgtaaatagaaggggaaaaatcgaagcccgacccggacttctttcttcgacccaacccgatttttttctccacccgctacaatccgggaagacattatttttaataaaacgttaaattaattgttactttttatttcaaatttaacagaaaaccaaagccaatgctgagaagcaatatgaggtgggtatttaattgaatgagaattaattaactactaattacttccattcatttacaatactcaaatgattgttgtaatatttgcataattaattttttanatttttaatatttctanattctgttacatggaaaatttgtgtttataatttattagtgtgaaattttgcaaaaacgctatt

SEQ ID NO: 33776 - DNA, 996 bp, Heterodera glycines
ctattttaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataatttgttgagtaccccaaacggacacttgaaaaaatcgatttttttggttttcgggggcagtcccccccgaccgatgcgcccagatttatggggagaccgaatccttccggatagcttcctatagcctgtatttaattctgcgttggaattttgctcc

SEQ ID NO: 33777 - DNA, 1281 bp, Heterodera glycines
cgaaaaaatttcaattaaattcaataaatttccaaaaatcaaaaaatgctgaaaaataaatttttaggggctggcgggatgcattaaaaggggctgatgggtcgactaagatttttcgattggatccgacggtaaaaagtagagtgccacgggaccgggaattttgggcaaacccgggaccgggaccttttcgggttgaaaacccgggaatttttggctgggaaaaccgggaaaaaaccgggactagtcccggtcccggtcaaaaccgggaccttggtactcagttgtccgctaccaggtcccggtcccgtggcactctagtaaaaagttgatcggaaatcaaattattaacggttcataaatttgactatttttttcttttcaaaaccacttttttgcggtgcaagaaatcggaaatttttcaaaaaatatacaatataataaaaaaatttctaaatattttaataggctaaattttttaattcttaaccaagtaaaaggtatttcacaaatgtttttagtatattcgcttgaaaaaattattcaattattttatcaaaatctttttttgtcatttttcaatattttagaacatttttgggaaaaggagtgactatttacacgttttttacagcgcgattttttcaaaaactttttgggaacttggaggaaagtacggcggtgccggtaggcgccgccgggaaatttttaaaaatttcagttcaatttattattagaaattgtacaaaacttactagttttttaaaaaaaaattaaaaaatttacgacttttcatcaaaaatgtcggaaatcggaagtctttccgtgccatacctggtgcatatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccaggtaaaatttcacaaattttgaatgaaatttgcgatgaaaaatgagttaactttaattaaatttattatttaatttatttaaaaatatttggcattctgtcttagaaaaattttcaaaaaaataataaaatcccgcataatcccgcacaaaaaatcaaatttccggatcccgctgcgggattggaactcaaaattctttgcgggacgggatcccgcgggattaatcccgcaaatcccgcattttccaaaaatgcgggattgcggactgggatccgcaaaatcccgcgcggga

SEQ ID NO: 33778 - DNA, 1114 bp, Heterodera glycines
accgccgtcaattcgacgccgaaggcaaagcattttctgttgcctttcgtccatccgttccatttgaaaagccgcgtcgacaaatggaagaatgttttggcgcttttccgtgggcaaaagtgccgagtcaaaggacagcaaagccgagcaattacagtgtctaacgaaatctttttttaattgaaacggcaaaaaatgagtgcctgcagaaagctttcaaatgggcacaaaaaagttccaacagatgcacgtcagcccacaatggggaggacaaatccgtaatgagaagccgcaaaaaattgtcattggactcagcgaattggcgatggattttggaccaaagatttgcgagcgatggctgctgttggtcgcattcaaaaacaatgacacggcctaaggcaatcagccgatcaatgtccaagtggtcatcgactcgagacaagtcaaacttaaattgtgctgttgataaatggacatttcatcacacattaaaaaaggtgggggtgaaaaaagggaagagaaaagagaaggacacacctgaattgcatgtgtggcgaaagggaaaggaaaagaaagggggtggaggttcgagtccgttgtgctacatgaaactttatttatttttgtccaaaaatttaaaattgcttttgaataactttctagctaacccactttttgctcctaaaaaccctccattttgtccgtcattttttcctctatcgatatgaaaaattaaaagaaatctagagggaaaaagtttcttagagcaaataaattgtttctgctctattaacagagacaaagaaatagtacgccaaatgggaggtgtgtttccccgataaccgagcccccccccttttttggattttgccacctttgtcgctcctttgtctccgttttgttcgccttttttcaatggtcctccaccgatcgtcgactcgtgcgtcggtttcgtttggtatctccacgcgattttgagccgttcgttcgattccgccgtcccttcgtcaccatccatccccccttttgtgctttatgatggcacttttcccaaaagctttcgcattttcccgaaaagggactcgctaagaaaagcttctgtccctcatccaat

SEQ ID NO: 33779 - DNA, 991 bp, Heterodera glycines
caaggtccatctcctattcatcataaaagtgtgcaaaaatcgttgaaaaattaaaaaaaaaattcttggaattttttatgaaaaatttagatttttttaaatttttgacaattgtaaaaacaggaaaaagtacactcaacttgagtttggaccgaccaacccaaaaatggatttccccatttgtttttttttgtatccgacaatccagtctcgacagacttggacactccaatcccgctgccaaaactcaaattgacgcaaatgccgtctcttatccagaaaagaaattttttcgtgggtgggtggacgacaaatagacaactaaagacaattaatggtccgctggagtcgaaatatgccgctttggaaaatttccgaaatattgggaatttcatggaatctttaaaaaagacttggtttatcccccccatacgcaaaatttaggtctccctgttatttgtggtctattaatttttcacttttttcagtacaatgaaccaccggaagccaaacttcccaaactccgctggcgcttatatccgttcaaggtaaaaacaatgcgttttcattttgaaattcagccagtttttttttcaaaaataaattcaatgccatggattggcacaattttacatttctcaaaaaaaaaataaattgtttttcactgatttttcctgccttcctaaatttgtgggtccggtgacaatcggtgctctgtcacttattcattcacttctccccagggtgacgatactttaccggtgttttacatacatcgtcagtccgcttatctgattggtcgtgatcgcaaaattgccgactttcccgtcgaccatcccagctgctccaagcagcacgccgcgctgcagtaccgctcattgcaatacgagcgctcggacgggtccatcggacgggtgagagagagtccgtgtactcgcccaactccgccctttttcacttttttacgagaaaatttcatgaatggttgaaa

SEQ ID NO: 33780 - DNA, 550 bp, Heterodera glycines
taaaaatccttaattttcttgaaaaatttgctcaaaatctcaaaatttgaacaattttttgaaaaaactgttaacaaatcgcattaaaaattacaaaaatttttcacccatgttccctaaagtttttagaatattttagatttttcaaaatttccgttttccaacgtttttggggtcggaatcccgatttccgaaaattttggagcctcggaatgccatccctggtatgcaccacgcacttcttttatctcctctgtcattttcctcaattttttttaatttttcaaacagaaatttcaaaaaagcgtaaaaaaatttttccatgaatatctaagttaatcaaaattaaaatttaaaaaattaattcataaaaaaaattttttttttaattttgaatttataattgaagaggtctttttttgcgcctgaagtgaaatatagccgaaatttaacatttgagttttttttcgattttggggttgaaatacatgtgagaatttaaatttttaccaaaccggttccgggcccggcaatttgaaattccggtttt

SEQ ID NO: 33781 - DNA, 530 bp, Heterodera glycines
ttattttttaaatttattgttttttattatttaaactttgtattatatcaattaaatgtgactcttttgaaatactaccaaatatatttcaaaaaatttatttgtttgctaaaatttgtaacacaatttttgatattcatcgagtttttatattttttaatgtttttatttttggtttcagtccgttttaactcaactcaattttttttatccttgtctaatgaaatcccagttttacaatggtggccgcactttaggtcaaattgataaatactaaaaaaataatatttaattgactaatctttaatcataaaatgagatataattaattgttatatttacatataagaataaaaattaaataactttaatttatctttatgtaaaacaaatttttttttcttaaatgaaattattcttcaattattaaattagggtgttgcaatagttttgcgccaaatttttgtttttgctttttgtattttaatttgaaaacgaaaaaatttacttatattgatccttgccttttt

SEQ ID NO: 33782 - DNA, 990 bp, Heterodera glycines
agtaataagatctgaattattaattagatttttaaccccaatgcacggcttttttccaaactcgattttttttgcctgagaacatccctaaacgcacacaccggaagtgtccaactccgaacggtcgtaggacttctggaactcgccctgaccaggctggaaacgctccttcacgttcacctacaaaaaaaaacggaaaatgtgagctagggcaatcgatgcaagccagggaaaacttttttttttgaaaatcataggccacaacctcctcaaaggatgaaatttttttggaaattttgtaagtcatggggcaggcaaacacacggacccctttgagcgcctccaattcgtcgcgcattgcgctgtcctcttgaatgtccgcgccctccaagtcgccggtccgccacttctgcttcacctcgttcacctggcttttgatctcctccagctcgtccttggtggcaccggctgaaaaagaaaatcattttttttgggggttttaaaatctaaatgtcaaacatttgggttcatttttttgggagtttaaatttaattgtcaaaaatttgggtaattaaaaaatggtgggccaatcgcagcctcaatggaaaattacggtacttacagtaaagaaacgatgccggagttgccgtaagcattttttgggtggtgttattattaattagtagttaaaaaaaggaattatatttgatggatattttgggtatttattggtaattagttggctaattaattaaggcaagtctatgaaggaccaaatgatgttgggaaaattattgcaaatacaaaatgtatgccaattccaaaatacttatgctatatagcagggatggagttccgaggcactaaaaattttcggaagtcggaattccgaccccaaaaatgtcggaagtcggaactcggaatttttcaaaaaaaaaaatataataaatttaaaaaaaatatttaataggctaaatttttaaattttt

SEQ ID NO: 33783 - DNA, 658 bp, Heterodera glycines
taactagggtataaattatattgactaaaaaacgtcaaatatggacataaaatatggactaaaaaagcccaaaatattgactaaaaagctcaaaatgcccaaatattgactaaatatggactaaaaactgtcaaaatatatgttctaaaccctccaaaattcctaaaaaggtttatatattcaatatttgcttaaacagacttaaaaatacgctaaagactgccaaaatggatttaatcataaaaatgccaatttttattaaattctcgcttcacaattgcaaaccaaatacgtctcaaaaaatttttaataatctattctgttgtcggtgaaaaattttcggaatgaaaatacctaaaaattttcttaaattttgaaaaaatcttttttaagggtgtattttttaaaattttccaaaacagtcgaactttaggggtgtatttttcgcttttttttgcattttttttgtgaaaatttgccaaaaacggccgaaatatggactaaaaaggcaaaaaatggcgaaatatggatttattccgaaaaccccccaaaatttggatttatatggactaaaaaccttcaccaaatcaaaaaaattttaacgtaaaaatgctatttttgagccccttacttcatagcatatgcgcagaaaaatatg

SEQ ID NO: 33784 - DNA, 1254 bp, Heterodera glycines
aaattaaaatttatttaataattattgaaaatgaaaaatgctttattaatatataaataacattcgcaacagcttctagttcagggagaataattaagcaaaattaattgttaaaagttaaaatacgaattttacacaacaagagcaatttatttaatttatatttaattataattaaaaataaatacatttgataatttatagaaaacacaaaccacagccggatcagagtgtttacaccaagaaaatttattaagcaaaaacaaatttagaacaaagcaatgaataatatgcatgaactaaacagagcaattaattaataaaatttaacaattttcatcaaaacatttataaatattgtcgcgatttaaataaacggaattgctattatttcttcggggcgatagcagcgacttttcttataattaacgctgcgatttatagttgctaaaaactgccaaaataattagtttttcttatgtaaaaaatccaaaaatggttgctaaaaatgggaaaataggtgctaaaagtttcaaatttaggggggtgtaaaatcgaaaattttatccaaaaaggtaacaaaattaaaccaaatcagtattgagacaaataataaaaatcctcgtcaaaaaaaataataaatttggagatgtatttttgagaaattttccccctaaaaacatgttttttatctagttatttgctgtccaatactaataatttattaaattaataattaatttatccgaaaaaatagcataataaccaaaaaataatatattagagggaagaattaacagcagtaagacgaataaatttttaatttacaaaaataaatgaaaaaagagatttatggtaacaaaaaatataatcaaattaaaaaattattaaagaaaaatattattttagatttttattttttcccgaaattgtccgcaaatgtccgtccgcaagtgtccgtccgcaaatgtccgtaaggcataaatttatcgattaaaaaatcaaaatttgagatattgatgaaaaatataaaaaaaatttaaattaaaaaaaacttattaggaaccaaaaagcattaataaatcatcattaaagaataaatagtaaaattcaattggtttgggaaattaataaatatttgttaaataaatataataacagtagttaccctacacctatcgtcgtcaggcgtgaaaacgattaatgaccgttaggcctttgatgtgccgccccgcccgcgcggggtttaccgca

SEQ ID NO: 33785 - DNA, 1095 bp, Heterodera glycines
  misc_feature (55)..(55): n is a, c, g, or t
aaaaatacgctaaaaaatgcccataaatggatttaatcttaaaacatgccaattntaattaaattcacgcttcacagttgcaaatcaaatacatatcaaaatttttgtaataacttcattgttttcagcgaaaaatttttggaatggacaaaatacctaaaaaaaaatttccgaaatttcgaaaaaattctctttttagggatgtatttttcgctttttttgcatcttttaaaaatttgccaataattttcgggtttgtttttcttttttcaactccaaaacttccaactcgagttcgagttttcgaatttccaacgtcaattttgcgtcctccttttcaagcactttgagttgcatttccttcagtgttggcaattcagcagcagcagcagcagcagtttcacaaatttttgtcgtcaacagtgccgtttcaacttttcgcctttttgcttcaatcttcactgactttgaacgaatcggggtcaaatcagtgaatgagagcggaaacgatccagacgccttgggatcagcagcaacagtagcagaacttgatgatggtaggccaccagcatcggacaattgctgctgcttcgccggaccttttttttaatatttatgttccaattaatttgttccgtttgcacctaattccaaaggactttcacatattcctgcaatccggctgtcatctgccataaatcggtcaaatatctcataaaatggttttctttccggcgcttttcctccgccggttgggggattttttttttgtatcgctgtttgatttgctcaacatcgcgcactgatcgcgcatccttaattaatagggaaccgactttttagtgacgaaaaatcccgaaatagttaactaaaatagtgatgaaaaagtgccaaaatagtgacaaaatagtgaaaaaaagtccaaaatagtgacgaatagtgaccaaaatttttcagccaaaaattgagcaaaaaatcttttattcccttgattgcagttacaatgaggtacattccttttcttaattttttttacaaaaatttgaatttttaaaccaaaaattttgtaagaaaaaaatttgggggaaaaaattt

SEQ ID NO: 33786 - DNA, 784 bp, Heterodera glycines
acccgacatttggggatcccgacatttggggacccgaattttggagacccgacttttggggacccgacacttaaagaacccgacatttggggatcccgacatttgggaacccgacttttggggacccgacttttggagacccgacacttagggaacccgacatttggggaccggacgacattgaggatcccgacattttggggacccgacttttggagacccgacttttggggacccgacacttagagaacccgacatttggggacccgacttttggagacccgacttttggggacccgacacttagggaacccgacatttggggaccggacgacattggggatcccgacatttggggacccgacttttggagacccgacttttggggacccgacacttagagaacccgacatttggggatcccgacatttgggaacccgacttttggggacccgacttttggagacccgacacttagggaacccgacatttggggatcggacgacattgcggatttcgatgttttggggcatcatttgtgacaaatatttacttagatattatgaatatgcgcgaaataagaccaaattaagctggtgaagtgagcgatagggatatagcattttaggggaaaagacataatagggatttctagggtcggataggggcgtgtagacgaaaaattcccgaacaaaaaatgtgctcttcgtgcatttctggtcgagtatacgccgtacaaataggaaaaatcttagaaatcctaatccaactcatatgtaataag

SEQ ID NO: 33787 - DNA, 995 bp, Heterodera glycines
  misc_feature (48)..(48): n is a, c, g, or t
tggcccggcaataaaaacatgaaaatccacttaaaacaatattttatntggcgtaagaaccagggctagcaactgaaaattttaaaatcggcatttgacgacaaaaaatcatcgtttgggctcaaaaatcagcatttattattcaaatgaaaaataataaaatgttttttgtagtgcacttttttcaaaaacactttttgatcatttttaaacagatttcaatgaaaattaaaattattaggtcgattttgcgctttgaaaatcatcatttaaaaaatcatcaacatgtgaatcatcaaaatgatgataaatcatcacatctgatagccctggtaaaaactgaaattgattatcaaaagtatttctcccatccgccgattttctccaacaattgtgattggacaaaaagtttaaaaagaaaattaatattgaagggattgttttaattttcaaattttttccaggcggcaccttcgggaaacgccactaaaaaaagtgacgcaaaaataaaaaggtcgtcgcccggaggctgtgcaccatccaagcggaaatcctgggaagtcccttgtttatttatttttctacaaattcaagtcatgctgacaactacgattaatatttaaccaattcaattttggcctcgtagctattgtttggcctttctaacgacaccaaaaacccctcctacccccccccccttcatttagacttacctgacttaaaaattcttaaccaaatttagaagtgaagttttttttttaaatgtcgtccttaaagccgacgaatttgaaggatcggatgaagcatttgttcagttcgggggatcattcggatgtgcactttttggttggagaggaaaaggaggcaaatttttatattcattttcgaatttcttttttgggttttttatttcctttgttttaagctgtttcgagcacacaaactgattctgaagtcaacttctgaagtttttgaggcgatgtttcgttttgact

SEQ ID NO: 33788 - DNA, 1299 bp, Heterodera glycines
aaatgcaagaggaaaaaattaatcaaattaacaaatttttgttgggtttttcatttgatcgattttttctgatcatttttggcgccggagccaaaaaagccgaaaatttacaatagtaaatcgactatgctccccccgataaaagtggttttaaagcgatttggacactcacagttcgcgatgttcccttgtaagctgttcataatttttattagcatccattgaaatgtgataatgataatggcaaaatttgaattatgtattttattacgaaattgattttactggtgtaattggcgcttatatattttttaaatttttatcaattaaattatgatgatgataatgatgatgatgtcaacattttgaaattacatattttcttggaattaattttaattagtgtaattaggcgtttcataatcatagaaattttatccattaaatgatgttagcaccactcctccttcccctcctccaattgcacacccaacttgacaagtgattggacaaaatgcggctcgtgttgacgttgaataaagtgaacaattgccattccgcgcccatgctggacaacttaaatgttgttttattttttttttgattccgcttcttcttaaaacaacaaaatcactaaaggcttatatcttatgacaatttttaaataaaacgcaaaaaaactaaaaattttaaaaaatatttttaaaatctgtcgacgaaaacattttatttttaagtaaatttcctaaaattaagccactgggtgcttgatttttcagcccctttctaaatgagggctttatttaagagagtgggtctaatttaggggggggggggctatattatagaaaataaattgagtaaaaataaaaaatgtttgcaaaaagattagcttttaaaagggacgatattttgagatttttaaaatccacatataatcaaaacaaattatcaatgactgagatttgtcatttatgtatgtgccattgaagtctcactctaaaaaatccttgcaatttctgtttggaagcggcggatctaaaatttggggtggccttgtcggcacatttccatccggtgggcatcggttacatgtccacgggcattgccaactcattaagttaaaatacaactaaaaaattcaaattttcttcaattgaatttctttgagcttgtcgattctcattttttacatattaattaataaattacattctattatttttgattttaaaatagaacatgtaattatctattattttcttaagaattagaattttatttactttgaattattat

SEQ ID NO: 33789 - DNA, 1323 bp, Heterodera glycines
atgcagtaatttgcacctaccggatttgtctcaataaattaaggcccatctaaataatttccttaatttaacttttatagtacgatgagcttgtttaatacacttaaattctttattcatttgtaaacatgatacaaatacacgtatctaaaattggaattcatcagtgagaaggtcagtggaaatttgcaaaaaagtcattctgttagaggaaatagcccagcaaatgcgcagcacccaaaatgcgtatttcaccctcaatcacacgcaaaagttcgcagaagcatgtccgatcgcaggggttggaggacacagcgcgcggtaccattgcactgataaaagaaattggcaatgatttagacatcattatataatttttgattgatgtcgaaaatgtcataatcatcaataagcgtgttgagagccctgtcaacttatcttaaatattcgcgctcacgtgaaggcgaacacgagaaaacgtccctgtccccgttatttatagacgtattgaacccaattttattttctttgaataaaaattcaattttttgactaaatcatgaaaatttacaaaaaaaagaaaaaaaataaaaatttaccagaaattcataaatttttggtgaaaatatgttacaaaatagaccttaaatttcaaaattcacccggcgctgcctatcggcatcgccggcgccacaaaaaaacctattttttcttaaaaaaaattggcccaaaatcgaaaaaatctatcattttttggacaaaatctgttaacaggcccatccaaattttcaaaatttttcacggcggcgcctatcggcaccgccgaacccatttctcctaaacgtctttagataaagagcgccgcaaaaaaaagaccaaaaaaaaaagatttatacagattttcgctgaaaattggccattttaaatgctttaggtatgtgtttttaattaattctatacaaaatatttatgataaaaaaatacataaacgaccatatacttattatcatgaaatttaaatatttcgtagcaacaactcataacgcttcaagattagttgactcagaatactcattgcactaccaaggactcatattcggaaacgatgctatgattcgcattatcgacacatcaatttcctcttatctggattaaaaagaagtttattattgtgcttgaattatgtacgttggacagtatacaaattcttccgccgatgatatagagattattgatgactttttaatattaactagaaactgataatgaatttacaaaaatatgaacaattgaacgctaaattctgctatagccgctaaaatg

SEQ ID NO: 33790 - DNA, 299 bp, Heterodera glycines
  misc_feature (163)..(163): n is a, c, g, or t
tgaaaagttgcggggattagttagctgacttaatggactcacaaattattatttggaaatgaatggacaatgaacggaattgcggacgaacagcagcagacggagggaaggaaagaaggcgacccttctccgatcagtggtcagtgggggggggggggggggnggatcgaagcgaaaggggcggagggagcggcagagaaagcaccgaccgatggacgcccttttcttggcccaattttgtgcccttttgctgccaatttccctttttggcaacttttttcgcacaattgcaggggcct

SEQ ID NO: 33791 - DNA, 923 bp, Heterodera glycines
ttattttattaaaatttataaattctaacttcgtttttccaaatttttgaacgcttagaacggagtaacaaatggaggaattgggaatttgcggggagaacgaatttgcgataaaagggaccagggacaaaagacacaaattcattgacaagttcgacagggagaggacgacgacggcacggcattttaggggacaatatgtaaaactaggaaagggccacgctaaacggaaaaagtaaactttttaaggatttgcattattttgtgaagtaaaaaatattcataatttttagacaagattatgaaaaaaaagaatttaaacaatacagaatattgcgataaattaaaaattgggcttttagtatagaattgagctcgattaaaaacagtcaaaaacgcactaatgacatctaaccttcagaaaaacatttccgaggttcaaaaatagaaacaaaaaacagtttaactatcggttaaaaatgttaagaaaatgggcaaaaacactgcatcacatcaaattttatgaattaatatttaatctcatccacaggtgcgctggtttttagcacaataatcaaaactcataatgtttaaatttagccagttttgccaatttttcacgtgttgaattagtttaaaaaaacttagacgcttaatttttgaacactcaatttcggtaattttgaccgattcaaaaccgattttttgatttttccgtaatttttttttatgaagattagaagtcattatagcttgattggaatagtagtgatcaaactatatgataaagaatgacttatttgaacaacaatctttggcttttttgtccagttagcacatgagggcttttagtacatatcagaccttactaattactagagttgagcgggaccgggaaatttgacaaaaaccgggaccgggac

SEQ ID NO: 33792 - DNA, 609 bp, Heterodera glycines
tttttcaaataatcattataatatttctcgtctgtatatttatttatttaggtctttaaattattaaaaattctaaattttatttttttcttaataaatataattttttcttctatcattataggctgttaattttttgtgctaggtacttaaatttggtttattggtaattattcatttattacgattttatttaaatttctttagccccaagttttaataatttttgtttcttgtatgaagaactcaaaaatatatagaatgatcttttttaaaaattttcatggtgagtcccagtatttttagcagagaatcaaaccaattcctcatcattaaattattgattttagaatttgtttttttgtaacaattaatattcaatatattaaaacttaatttaatataataaaaatgaaaatatataaaaactaaaataaatggtaaatatgtatcatttggaccaaaatcaaacaatggaaaaatttggtatcgttcgagagcttataagagattacggaattttgagtttttttcagaattaaatagaaaattgactgcaatcgggagatttgaagaaatttttaaattattctttaacatactaagatt

SEQ ID NO: 33793 - DNA, 1036 bp, Heterodera glycines
tcacttttgcttgcgtttgaaggcccataacttttttctttaaactctgatcaaaaaatgcccgctgcgagggcaccccgccaaagggtcctctacatgctggtattttttatttttttaatagagccaccccctggcctgcagaaaatggcaactgaagcgtgctcaaaaagtacacttcagtaccaggcgaataccgcgtcggcgtttgatctgagagaaaagtgcccagcgaacttattgtagagctttgaaagctcgatttttcaaaatttaaaaatttcgaaaattttcaaaaattttcgagttaggcctaaaaaacggttttcgggtttttgaattttaggattttttaacgatttttcccagagaaacggagaccacttccaaaacatagtttttcgagctctatcgattggtatttttttcggaaaaatttcgattttttcccggaaatagaaaaaaattttggcctcagcgggacatttgagtcctgggcccataactcgtcaggggttggttttagcgaaaaattgtattagaacatttttgtagagaattttaaatgctatcgaatggtgtgcttaatgactggaaaatttcaaaaattttcgagctaggccccctagaaattttcggaaattttttttcggacgaaaatgggggtgaaaaatatttttctggggtaaaataaggtgctgagtacgaatataatgtctattttaagtttcataatttttggaattttttaaaaattctttattttttggcaattttttggccttggaaatttgggttaatattggaaaattcataactcggtgatggtttcatcgatttaactataataaagctttaaaaatagagaaaaataaggagaattttacgggatttatttgagttttttatttcaaaaaagaaaaaagttatttcagaatttctggaaattttcgatttttcagaaaaaaattcgtagctgccttctgaaaagctattcgggaaaagtaaaatactataaaaatcccgcaattttttt

SEQ ID NO: 33794 - DNA, 889 bp, Heterodera glycines
  misc_feature (869)..(869): n is a, c, g, or t
ttcttttttatttacttaaaatatgaaattcattatattaaaatatttaaaattaattttatattttattaatttacagattttattgaatcgaagccttccgcactgtcattcagctgaacaccatagaaattggtgggcagaaaaaatttgttctcaaaaaatttcagaattggccaattcagcgcaattcgggtgtcctttcgaagcttaaataatactaattaattaattaattaaatgataaataataatttaatttcaccttttcgctgaaataggcgtcgtaaaaaagttgaaccggcgaattgctaatcggacaaagtgccatccgtgcgcaaatgtcgttgccaaaatggtaacttccgtccggcaattcgaccgtcatattgtgcagaatggcattcattgtgccctgaaattgattaaagcatagattttgattatttattccaatttaaaatttgtccgcctgaattgcgttcgccacttctctccgcagcatatttttccaccacgggggcgaagcggcgccatttgctgcaacattttgctaaacaattaattaataatgcaaaagaattggtatttacaatgaatagaaaaattttaaaaattaacagaaaatttaccaaatttgccgcgtcttccactgatgagtcatcgacacccgccaaaggcggtgccgcttccaatgcgatggcaatgtaagagctgaacaaaaagccaattaatgatcaaaataaaagcaattaggggggggggagaatgacctgttgacggagtctccgctgaattccttgtgaatttggtattcgaaacgggacagcgaatgttcgggcgaatacaaaaagcgcaggtcgtcctanagcaaattttagaaatatcc

SEQ ID NO: 33795 - DNA, 924 bp, Heterodera glycines
  misc_feature (775)..(775): n is a, c, g, or t
  misc_feature (896)..(896): n is a, c, g, or t
gttaatccctaagaaattcaaacatttttgcacaaatcggcagacaacaatttattgtaatatgtgtaaaatagtaaaatgttgtatatattgtagaacaatttaacaaaaacacaaaacaggaggacgacgataattttcaatcaaacactggatggaaattgtgatctgtgtggagcaaaaatggatgaaaatttgttgcgcgcgggcataattatcaaaagaatttggaccatttgaaaccagcgccccctttgtcttcgccgccgccaccattagtgcccttcttttttgtgcctgctgctggcatttcttccggctcttccgcttggtcatttgctgctgcgcctcctcctttgccgccaccactgtccaacccgtccacggtgccgcgccgtcccgcttccaacttggcaaactccagcatcagtgtacgttgacgagccgttagatgcctgtggtgttaaggaacatgaggcgccgcaaaaatcagttgacaacggacgatcaaatcaaaacattccatttttataggatggagaggggataggaaggggcatctttttgctggtggtcccgaattttcagccccaggggtcaatgaaaaatagtgaggaaatcaaatatgtccaaatcatcatcaagagccactccaaatttacgcaaaaaaaaaactcacttcggcacattcactttgatgttgagtatttggtcaccatagcccggctgctccaggcgtttaattcctttgcccttgagcaccatttgcgcatgngaagacgtgccggccggtatgtgcacccgtgttttgccatcgttgttggtggatatgcttggcacgtcaattgtgccgccaagcgttgcctgcacaatgagagaaaagttacacatcatanaaaacgagcaagcgctccccccactagg

SEQ ID NO: 33796 - DNA, 962 bp, Heterodera glycines
aaatctcctcaaggttaggtgttttccaaaatgcaccaatttctggaaaacataaattcgttggtaaaatcgtcaagatccacgctgatttcatgatcaccaaccgtgatcttcagtgggaagaagactttcaaaacctcagtatctgcatttaagaaatatgccatacaatatatagcctaatttttaaggctgcaatttttagtcacttcactatttttacggaaaatgcacccctaagaatcgaccgccaattaagattgacactaagattttcaaatagacacctaagaaatgaaaaattttcttaaatccatctcgagaatgaattttttgataagaatttgtgtttaaaattacttttggcataaattattacatttttgggtaaattttaatgttgcagccctaataattatgaaaattacacacgtttttcattgtttttatgcacgttgtatgcaataacgtaaccaattgcaacagacccgaccacaattggagttaagagcgttgcgatcgctgctcctattgctagtgccgaaagcaattctgccgttttggtatcaaaaattataattccttcatctctatttctatagattacccagcttaaacatttatttttataataacttaattagctattaattcaaagaaaattaacttgtcatcctttgacaatggtttatttaaagctaatttaattgctccttgtcttgttaataataattgtgcaggtatctcataaggatcagttgaaattccatgtttttgttgtcttcgtctattataggctcgtctaattgagacaaacgttgggaaattatatgttaatgattcttctgtttccgtatcggcacctgttgcatcaaattcctctgctttagggggaccctaaacctcggtatttaaatttaatttgtcaataaacctcacgccacaaagtttttatattttct

SEQ ID NO: 33797 - DNA, 803 bp, Heterodera glycines
  misc_feature (701)..(701): n is a, c, g, or t
  misc_feature (772)..(772): n is a, c, g, or t
  misc_feature (792)..(792): n is a, c, g, or t
ttttgaattttatcaaaaactaaaaacaaaaggggggacccttttggtttgcaaaatttattaatgtatattcatgaaattttattcaacggggttttcggggttcccgatcacgaatctgtcaactattttgatcaattcccatttcctaacctaaatttgaacaaaaaatcataaatcgaaaaattcaaattttgatttttgttcgggtttagaaattggtcaaaatagatgtcaaattcgtgatagcgaccctaaacccccggagaacaaattttaacggttttttatcacaaaatttttttgcaaaacaaaagggtccctcccccctattgtttttgataattttcaaaaatgtccttcttttaactagtgccaaaaataacagcaatatttaatgaagatacacaacctctttaagctgcttggtagtcatttcatcaaaagcagtctttcgtcttaaaaccgacaacccaaaagagtatgggaacatgtccttaaattaaaaaaatatttaaaaataataaaattacaatttcctgtacttcatactccataagaatttcagtaaatcccaatttcttaatgaacggtaataattctttaatataatgtggctttggtgcagctcctttcagatcgaaatggacaattaccttaaaattgtagttaatttgcaaaaaattagtaatttatcgtanatatcaccttttcgagaatgaggaaggggtttttggttcaccataagcatttatgctttaaaagtgatatncaatttcaattggttataanataaaaatacg

SEQ ID NO: 33798 - DNA, 1275 bp, Heterodera glycines
  misc_feature (51)..(51): n is a, c, g, or t
tcaggtcggttaattgctgatcagtcgctgtgcctttttcccttctcaacncctcccattttcagatcggtacttcatttctcagtgtccatcttccgcccattttcgcctttctcctcctcttctgttttcttcctgctcataattatcgcattctcgccctttttctggcatttctgcacataaattcggcgcttctccaagtccgatcaaaattagccatttgatcattcctttctttagatctttctattcgccccctttctcgctttgctttgtcatcgaaattccactcgttttcgattcgaaaatggcaattcgaatgctccaatgggtttaagtccgaaggaagaattggtgaaaagcccaacgatcagcaaagaattgccaaatgttgagccgaaaacgaagttaggcaaagagccgatccgcgatttgggcacaaatggaattgggagagaaaaaggacagcagcagaaaggagggagacgaaacgccaaacggacacttcgccaatgttttgcatgtaaagcgacccgtaaggggacactttaaatagagaggaaccaatcaaatcagttaccttccgtccgtctgattactgatcaacccactttctcttccgttcttcagaccctctcggcgtctttctgtcgtccctcccgggcaaatgcgtggtcctttgtgcttccgcgcttctcctttggctgtctttggcccgcggcgtccctcttctgtccaatggcatggattaccgtcgccttttgcctgacgattcggcggctcttcgcggctttgatcttatggacgcagttttgtctattttctttgaatttggtaatttgtcattcacagatttggatggattttctccaaattctttacataattcgtcgaccaccaaactttgaagacgcagagcaattttcgaaatttaaagtcagaattggctatccatttgctttaatcaattgttggtgccgttaaggagttcctttcggatgccacttccatgccgcaggcaattgccccccgggcccatcagtcttggctttttgattactttcgcgatcagctcggctccgaccttttcacgcagctttcttcttcccaacgttccttcgaaagtggcgtcaacatgaccaaatttggctctttcatcaacggatttccttaccgggcctggcgcagcggtgtccatttcactctccgcgaagggtggccaaaaaaataccggggggggggggcacggggaagtcgatcgattaataatta

SEQ ID NO: 33799 - DNA, 708 bp, Heterodera glycines
cttttaatttgtcatatttgtgtttaatggtcttaaaatgcccttaaacagcataacaaatattgaaatgggatttattcgggcgtgatcaatgcactaattaattaaaatattaatgaagtaatcataaaaatgataaaaccactctttttaactgccccctttaaatgctggaatgcaacactttcgatgggtttggcggtgttttcgcgtaccatccacccaccttttactgctgaccgagaatgatgatgttgttgttgatgacgcctctctctctctctctctctctctctctctctttcccttacttttgcccttttctttctcattctctctccactttcttctttcattcattgattgctctcttttctttactggctatatagttatttttcaagctctctgagttctctctctctctctctccttggatttctttctctctcactctggctctctctctctgcttttactctctctctttccttctaacctccttttggtttccaacctctccccttcttttattttcccactctctctctctctggtccctcgcatcattttctctccttttcactcctattttcttttttttatcacatttgtatatttgattcccccccccccatcctcttctcccttccttttatcacttgcattatttttggtttccatcattacaaaatcagcgccgcagtt

SEQ ID NO: 33800 - DNA, 731 bp, Heterodera glycines
cccccccccccccccccactgccccattgtccatgtatgatgaaatggacgtacgttgggctttggtggtgagatttggaattggatgaggccaatcttcgccttctccacccgcgccgggcctccgtggcccatcgacttctgatcgatcagcgctccctcaatgagctgcgactcctccaccgtttcgcccaactttttcacgactttgatcagcttcagattgacacttgagtcctccggtgaactcatcagtttcttcactgcctgcaccgccattggggccaaaagatgggaatgttgcgaaacgacctgaaaaaaggaaaatcgaaggaaacaatgggcaaacgaaagaaagtgaactgaggaccttcgagttcaaactcgtcatggcgagcttcaccaactcgtcgtcatcgttaatgtcaatgggtgtggccatttcctcgagaactttttcagaaaatgtggccgcccgttggaatgagtcggaaatggtggtcggatgaattcctttaaaaacaaaagtgctaaaatttggcgtataaacgagtctaagtgacctttggcaagaagtttttctgcagcgtccaacaaggacccggccaacaccacaacagttgtggtcccatcgcccgcctcaatgtcctgcgctttggacagctcgaccaactgaacggtgcaactcataaaagaaaacaagcaaatctcgccatttttgcggagggatg

SEQ ID NO: 33801 - DNA, 918 bp, Heterodera glycines
ttatttattttatttatttatcgaacaaaccacaaggtgctatgcactctaacagtggcgtaaaaacaaaataaaatgaaaatcaaatcaaataaaaacataaatggtagtcaaaattcacaaaaataaatgtcaaattaaacaaacaatagatataaatcaaacaagtcacaactctcaatagggaaaatatgcattagtgcttaattattccttttgctatttctcggaattttttggggtcatttatttccataatatttttcggtaataaattccatgaattaataaccctaaaggctttcaaaaaaaggtcattctcatcattttcgttctactaatttaccatttttcgttctcccatttgccctttttcttcctatttcgttcattattatttcgccagtttttcgtccctaaaaattcgtgccttaattactcatcactctctgcccccccccctccccccttttatttaaattcgctttctgtccatttttaaatttaaattgcttaaaccaaatttatgggagcgaaagcaatcgaagatttgagagacgggtgagaggaaaagcagtgactgtaacggtcattcattgtcagctccacatttcatccgccccatggctttcattttcattattcatctcatccaaccgccaccaccaccgtcccagccccaaacccttgtcttgtctgtgatcctcgccctccattcatccctccctcctcctcatttcttctcctcccttcccctcctcttcttcctcccccttatccgtctttcctctctttctcgtccttttccaccttctttcccttctcgctccctcctttcttattcattccctcctcctatccttttcctcttcctccccacttctcctcccctcctccactctttttccccctctctct

SEQ ID NO: 33802 - DNA, 825 bp, Heterodera glycines
  misc_feature (710)..(710): n is a, c, g, or t
ttcacgtaactcatgtgaaacacgctgttgctaaaaataaatgtcatattcgtgatcagcgtcaaaaattaagctaaaaaaaattattagaaaaaaaatttgaggggggtgacaaaacctagaagtaccaaaagaaaaaggtcagtgattaatatgactgaactcccccctttcgcaaatttaatttgacgcaacttacaaaatgctcttatatttttgaccggcgatgtccttttgagtctaaattccattaaaacattcagaattggtcgaaatgattgtccgattccgattcatgatcagaagggctgctaattttatgtaaatacatattttttctggattctccatgctctaattaatcggaaaaacactttctttgttttgtgtttgcgaacaaaagtgggacttttatgtacatattttggacttttagtacatatttcgcaattttttcgtacattttatttttattttttacatattttgggattttttgtgaatttataaaaaatttcttaagaaaaatttaaatttttttttgaaaatttacccctaaaaaatcgttttttccaaaaatcagatattactaaaaattgattctaagcctcttttggtcctttttatggcattttgtgattagttcactttttacgaagaattttttccaaaaaatgaccatttaaaaattttatttacatattttagtnacatatttggaggttttttacatatttcataactattttagcatttttatgcatattttatttacataattcgcaaattttctttacataaaaagaagccctagtaatacataat

SEQ ID NO: 33803 - DNA, 970 bp, Heterodera glycines
tcttgatagaaaatggataaagaaaaggtggtttactgtaaaaaatggtgttaattcgcgtgcaggatctataaataaattaatattattttaatcattaaaaatattttagttatataaatgataaatcgaaatttattaatgctatgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcaagtgattttgatagaaaatggaaatgaaaatgtggtttattgaaaaaaaatggtgttaattcgcgtgcagaatctataaataaattaatattattttaatcattaaaaatattttagttatataaatgataaatcgaaatttattaatgctctgataaaaaaagcatttgataatggattcaacagttcaaatgatgcgacgtttttcgcccgaaaaactgcaaccggcgataacagaagaaaagaggaatgaagtgaaaaatgttgggaatatggcaatggaagagggctacgaagaggaactgatggcactataacagtgaaagaagcgccaggaaaaccaccattatggtcccatttgttgttaatgttgttgtttatgtttattgttatatataaacaaataataatatgagaaaggcaacagagatggacagcaaagaacctaaatacgatatgacaaatgccatctggtccctcctgttcgcagcgtcacaagaaacgcaaggcccacatgccaagcacaccaacggtcaatccgaacctgaacaataaatttgtggtattacggaagaaaaaacctatgcttacaattagcgtctaggaatttgtcattaatttttgcgatacaattaaatatttttc

SEQ ID NO: 33804 - DNA, 975 bp, Heterodera glycines
  misc_feature (854)..(854): n is a, c, g, or t
ttcgaagtcataattcatgagcttcaaactccaacgatgaagtcttcgtgccgcaaccacgggcagctcgccttttggtccaaaaatcctttttaaaggctcgtgataagtctgtagaatgaattttctaccgtacaagtactggttgaatttctccactccgaagattactgcgcgtccttctttttcgatctgcgcataatttctttcggctgggctcaaagttcttgaagcgtacgcgatcacgccaaactttccagttgttccatctttgtggaaaaggatcgctccgactccgtagtcagatgcatccgttgccaaataaagtggctttttgggatcaaaatgggccaacagctcgttcgacgacagcataattttgatctgttcgaatgatttttgctgttgttgtccccaatgccatttggtctctgatcggcgtagctcgttcaacggctccgaaattgttgccattgacggaatgaacttgcgataatacccaaccatgcccaagaaggatttcaattcctttaagtttttgggggctggaattttctgtatggcctcaactttgtccggcgacgttcgatcccttctttgtcgatgatgtgccccaaataagcaatttggtttttcataaaggaacattttcctttttgacacgcaatccaaatttttggatgcgttggagagtcatttccagccttttcaaatgttccgcgtcgttgggggctgtcaccacaatatcatccaagtagacggcgactccgtcgattccacgaaggacgtcttccatcacttgttgaaaaatggctggcgctgacgcaacaccataaggcatacgcgtaaattgntataagcctttatgcgtgcaaatggtcaggcattccttggctttatcgtcaacatttaggtgaagatccgcctccttcaaatccagctttgaagatttgtcgcttccgttcaacacgctga

SEQ ID NO: 33805 - DNA, 970 bp, Heterodera glycines
  misc_feature (952)..(952): n is a, c, g, or t
ttgattgcctttacatttattggaaaaaacatttcgtctttatattaaaatattttttaaatagttttccatatgaatttattttaactagatttttaaaaaaaatttttattacatatttcataaaattttcatattaaaattcttgtaagaataatttacctgatgcttaatcatttagtttattttctacatttaaatatttgttttgagatattatgaataaatattattagtaaattaaaattatttatcgatatatttttataaagcttctttgtttccttcaataattaagcatgaaccccgacaccgtgattggtatttcttcgtaaaaatttttgtttaaataattattacaaattttaacctttaaactttatcataaaaattattttattatttgaaattcttcaatattgaaaatgattatcaaaatttataaattatcagctattaaacaaactatatgtttgttggataagggaacaaccctattgattatattttccctttcactccctctcttattgtctctcgccccgccccttgaccagccccataaatatgtctccctttccctcactccaggcattctcccattcattccaccatttcattattttattttatttatttatttcctgctgtcctcctccatatttatttgtttaataaattatttatttatttattggacaacatttgctttggttaaaaaccaaacatttttattgttgtagtaaatacacaacaatttggcgcagtcagaaacaaaggacctgctctacatcttcgggtgagaaaaggcatcaaattttgtttaaggaccaaaagccgatacggcaaaacaactcatcaaaaagccgggattggctctgagtttttgtaagccgagtcggccatttttcaaaaagcagtaaaagaaactgctagcgtctaaagccgagtncgctcatcaaaattcgtc

SEQ ID NO: 33806 - DNA, 1060 bp, Heterodera glycines
gggaaaaattcattccggtgaaaaatttggaaagctagtttttccaatgtaagccctggctgtccctttttcatgaaatttgttttaactgatatatcagggatgttgcaaaaatgaaaataaaatacgagacacgagatacgagaaaaacacgagacgagaattcttttatataaattaattaaaaatttttgattgttcttcttatgggaaaatgatcgggccggaacttttatttcaaatgggccagaaataaaacgacgaatttttccaaagaaaaaaattaattaatgatttttttcaagttaaaaaattatattgacataaaataaaagcgttttctttaattttagaaaacaaaaaacaaaaacaaaatccatcttaaaatttaaccaacaacaattaatccgaaatcagtttattttctatttttatatcaaaatcaaaaataaaaaaatcaatttatttaaaattttagtttgttaaaattccttacttttgctgagatctatttctggcgcagtattttttcaataattttgctgagtaaaaaaagggtccggcggtgccgataggagccgcctttttttgaagattagagtgcaatttgttaacagattttgtccataaaacgatacttttctggctttttggttttatttgtttttgttagttggattttcataaataagttttcaaaaaatatctcatccgttaggagaaattcgtggaaagtcggtaagcagcatttattaacacaaattcaaaaaaaaaaatgatgtggaaaattgaaaataaaaatttcctaaaaacgggttgtccctccgtcgtttctcctcctttttttcatccaatttctggttttgcgccgttcgtccttaataatacccggccgttggcaccacttttgcattctccggcctcaccaaatgattgtcggcccatttgctgccacaatgcgattatcattagcaattgtgctgttggtcaacagccattttttggcccattttggcacaaaatcgccaacccaaagttggccgaaatgaattgttcgccc

SEQ ID NO: 33807 - DNA, 1454 bp, Heterodera glycines
  misc_feature (286)..(286): n is a, c, g, or t
actcccattttgcgcaacaggtgactccgaagtgcagcgcacaatgctcgaattgcttaaccaactcgacggttttgagcctaccaaaaacatcaaagtgataatggcaacgaatcggatcgacattttggacccggcactgctcaggccaggtcggtgccaaagctgccaatgtttgtataattttatgaaattgctaaggtcggattgatcgtaaaatcgaatttcctgcacccgacgagaaagccagactggacatcctgaagatccattccagaaaaatganatttgatgcgtggcataaacatgagcaaaattgccgaaactattcctggcgcctcgggggcagaagttaaggcgagtgtggccatgggggatggctaattgatacggctaatcactgtaccttcgtcccttcccttttaaggccgtttgcactgaggcgggaatgttcgcattgcgcgaacgtcggatacacgtgacgcaggaggacttcgaaatggcagtgggcaaagtgatggccaaggacggggagaaggacatgtcgctgaggaaattgttcaaatgagcggagaacaaaggacgaattcgaaatggagagaggagaaaccgaacgatcggaccttttgacctaatggatgaatgaatgattctccgaaatttacgttttgtaagaaaatatttttttcccctcccacccaacccagattggctcttccagagagggaagataataatacatgctgtattcgatgtattactgtcgcaagaatattgtcctacattaattcatctaaaataaatattctactcaaaatgcttttcaggataagagactgcagatcatcggtcataagtatgaagaatataatcaggcatatgccagtaagttatgaggtacacatcgatgttgtatctcaaagttggtcacgtcatcatggtgaagtggggtacattggtaagtgaaattgggataatcatattaaaattatatctaatgtttcctcccagataaagagttcggtcgctttggggctgtcgcgactcatcaccagagtttcaagtttgcgggctgtgcgtcagtggagagaactcggccttaatccggtcgcagagaagatatgcagagtgaggagaatgtgggagagttgtcgatatattcaccgaggtaatttgggtctcagagaggagtctcgggtgccaagcaatgcttgaaatcttcattccttaaccattattcttacccaagcttcaatattgtaatgcaaagatcgtcttggatttaatgccgaaataaacttcttaggtctcgcttcttatctcagcgcattcccgaaatggttagtctgtgtggtgattctgcggaagcggctgcggaagcacttagtcgagtgggacatcgggcgcgataattattacatcatcgatctatttactatctccatcatgagtag

SEQ ID NO: 33808 - DNA, 872 bp, Heterodera glycines
gtccgccagattaaacattaaaaaaggcatttccatatttaaagctattatattaaattggcttaaatgatgccgtcttatgaataatattatttttttttcatttttatgtcattggatattttatttgctatactaactgatcgagactctttctttgtaagtgttcttctgcttcttctctccctccagcagcaggggtttcccgtccatcgtaagtctctgtccccgagaccgaatcggttggggtcgccctttgtaccatgaccattggacaccaaataaagactgctattgttggatattggataaataagttaagatattggcaatattatgtccttgggcaccccgcccccctgccctatccaaatattcacaatgtttcgaatcattcatttaaaagtaaaatatgttatttggctgattagcgtccattagttgaaagataaggaatttaagtatttagtgagcgtaaccaaataataattaacaataattaatcagttcattaaataatttaatgctttcggaaccaaaaactgagtcttcaagtcagcaattgcttttcattaactataatttcagctgagtctgattctttaggtccgatcacttctccggacaacatttctcagctttgcactccgtcaaacccctcaccccctcagggcattttaagccttccggaatttgccaattcgtaaaatcaaacattctctcatcataatacattttctcataagctaccaattggacattatctccgcgttgcgaggcaatgagcacgatttcctgtcaaaggcagccattgcggacgcaattcgagcagttcacagtgatgatgacaatatggaactacttgatatcat

SEQ ID NO: 33809 - DNA, 1216 bp, Heterodera glycines
taattaaggcggggatttttattttgcttaaaaatcccggaaatataaattctttcggtattttgaaaataaatttttaaaaaattgattttaggaagtataattttgcatttttcttaattttttttacccatttttcttctaaatacccaaaatatgtcccaaaccccgaaatatgtgtgatacatttttatgtgccaaaacaccaaaatatgtactcttatctaattcaaaatttttcggagaaaatactattttgggcttctctcgacataattatatcgcagaaaaatatgttaaaacataaaaatcccatccctaatagtaatttagcactctattataatttatcaaattcactttaaatatagaatttcttaaacatgcgaaagtgatgatattttaatacctgttgtatatcgaataagcggtttgttttttgcggtctgaaacccggcccggggggttctgaagtggtggaagggtcttacaactttttgaggagaattcgggaaaactataggtttttttctccgagggacaactgagtcccagcggctcgaaaactgactttgccgtcagtctcagtgttacgaaattttttgcttttgctttcagagcttagcggaccccaaaagcgaaatgccccaactatggcctacaactttgccagcaaaaaatttttgatcagatcaaaggcctgacctgtaggttaggcaacgtaagaatcacttttttggacacttcagtaccaggcgaatagctcgtaagggtttgctcggagcagggggtcgccagcggacttattgtagagctcaatgagctcgatttttccaaattttaaaatttcgaaaattttcaaaatttttcgagttaggcctaaaattcggtttttcggtttttgaattttatgattttttaacgatttttccagggaaaactaagaccacttccaaaacatcgttttttgagctctatcgattagtgatgtttttagaaaattttcgattttttccaggaaatagaaaaattttttggcctaagcgggacatttgagtcccggaaaaataactcgtcgggggttggttctagccaaaaattgccttagggcaaaattgtagagcttttaaagttctaaagaatggtgtactaaatgttcggaaattttcaaaaattaaagagctaggccccctagaaattttcggaaatttttttt

SEQ ID NO: 33810 - DNA, 1206 bp, Heterodera glycines
attggatattggccgaccttatggccaaacttggaaaatctagaaggaaaattagaaaaaatttgcttatatatattttggttattacctaccgaaaaaattggaaaattaacgcagtaaaatttgtaaaatgaactacctcacctcacacatactttctcaaagtagcataaactggttaaggcacccagccaatcaattaattaattgtagcaaaacgatcaagctaattaattaattccagcaattccgccaagccaatgccaattaattaattaattccaaatttagatgactattattagcatccgtacacaactgttcttgctcgcatagcccaatgggtttttcaattaagacatatgaagaataaaagagagagaaaggaaaaggaagcgcaacaaaagaaaaagccaagcggcggagataatccatccacgaaaagccgcgccgcaaaggcccctgagcggaaaaagcgtgcgactgccaacggcaaactgccaatgaaagtgatccctcagcctagcagagggcacacaacataataggcgagaaattggatgtgagaactgagagagagagatgaaggcagatgaagataagaataaataattggagatattgaaatgttaatgaaagtgtgtataatagtatagagcatttattgggtaataaaatgatgcggcattcattcaacgagactcaggcaaatataaaagataaaaaagtgaaatttcgtaaaaatgccaattttacagatttttcaagaaaaattcgtcatagctttttttaaaaatatagcgaaattaaatatttttgatatagctcttggattgctctattagcatgaaaatctcagaaaatgttatttaatttttgtttccaattttattatatttgctttcataaatattttttttctagttttaatagaacctctgacaaaatgagttccgctgctgctgctggcgcggctgtgatgatgagcaaattcattttttggaactttgaaatgcctacattttttaattaaattaattacttgaaatattaagcccctacaatcttgcaattttaaaatttattttataaataatttttggttttaataaacgcagatttcattttttttcagtcgaatcatttttgttattgaaactgtcaaaatagaaaaaaaagtttttaaaataagtaaaaaaatttaaa

SEQ ID NO: 33811 - DNA, 1347 bp, Heterodera glycines
cttaggcgaaatttgtcgaccatttgtcgctcttcctccagctcctgctcagatttgacctagaaaacaaaatgttttttttttaaatttttagcgattttttcaaaaactttactaattgtaagccataataaattttaaaaaagtcgctgaaatttttttttccttgaaatttcctaaaaaaaatttctagtatttttttaaacgatttttaagtttgaaaattaaaaaaaatttttaaattcggcgacgaaattttgtactgaccgtggaaaattaatcattgttttttttgtttcttgccccacttcaatgacgtcagtgctttgacgggccaaattgttgttgaccattttggtgctcatcatcacattcttcaaaatggactccaaatggaagtgcttgtccaacagcgcgtgctccaacccgaaacatccctcgcgaacgcgtcgaattcggcggggactcgccatggtgtgcagacagcagccaatctcatgcacaagcttcctgattgtagatgaaacaaattttttaattttccgggacttttttttttgcttctctccgacctttgtaatatttttttcgccgtgattttttttttcaaaaatttttgaaggaaaaaaactatatatttttctatattttcctttttttgttaaaaatttcatttttcggtttctggggagtggggctatagaccactcattgaaaaattataggaaactgaaaaaatttcgaaaattttttaaggcctcaaaaaatgcaaaaatttttcataaatttaaattttttaaaatgttccgtacacatattcacaattatagtctctttcagaaaagagaccatatattttgaaaaggaaatgaatttggaaaaatttgcttttgcattcgctccttccgcaactcgtcatcataaaaattggacgaattgggtacacaaattgaatgcagttcgcccggtgggactcgaacccacgacccatccatatcgtggaatgctctaaacgactgagctacacgggcactccttctaggaggttcttccacattgtatatttttttgaacatttaaatttatttttttaagtgctggcatacgccaagggtaaaaaattgtaaaaaaaatcgtgatttttttttttgtagagggggggggggggttggctaggccctgatgacacgccctggcacaattaccgcatgaatgggcattgctcgccagtgatttgcacgttgattttgaagtttggcgaccgaaaatggaccaaattaatgtcataaatcagcgggctgccgagcacttttggccgaggggcgccccgtcgggccaactcaaagg

SEQ ID NO: 33812 - DNA, 615 bp, Heterodera glycines
taggggtgtattttttcgtttttgtaaacctcaatatttaggggtgtattttcgtgtgttttttttaattgaattgattgcattagacgcgttcaattgtaaatgatctgtttttttcatttcataaactcgtttgttatttttacaaaaaaaattaatataatatttaaaaaaataaataaattttttttcaaaaaattctgatttcggggggggttttctctcatatcaccactattttcacgcatacattgcatacacacttgctaaagctgtatttatgaatcattatattttgttgttgccacaattattattcgtaggttgcagtcgagaacgaagaatgtcattgaaattgagttaagaataatcctagaataattatactgcagatgctatataaatacactattatgacaaatccttctgcagaattagtattgaagtacaaaagtcaatattgtatacgaaccattaatgttgcaaaaacaaaaataacaaacgaaagcaataacgcgaaagcgaaatgaccaaaaaaagcgaaaaaatgaaaaggtgaaattattttccaaaaaattcctctggtgattgtgagacaaatgtaaggatcaatta

SEQ ID NO: 33813 - DNA, 980 bp, Heterodera glycines
tttcaaataatcaacgcctttttccatttgtccttgcttttccctaccaatttgtctttgcgttttccgttgccttttgtccgtttttcgtcctctttgtctttgtgctgttcccttttgtccgattgtccaaatgatgcaatgttttgtgctgctcctcctccctcttccaatttaagtgttgtgtcttcgctgaatgtgctcaattcattttgcacaatttcctcgtaaagtctaaaaatataatttaaaataataattattattatttaatttattttatttatcattttcattttctttgatcacctgtatatttcggaaacgagttcagaagtgaaaagaatccccgtgtgaaggccaaactataaaagggagaaaataagaaaaaacggaaaatgtgcagaaaaatgaacccatcgaagcgcaaaaacgccgccgttttgagaaaattcgccaacaaattgccaaaaatctttttctcccctaagggtactaaattttaatggggttcttaaaacccaaacggaaggacctcttcctacttaatttttgcaaattttgctttgccccaatttttggaaaaaggaaattaagttccaatggctgggccccaaacccacgggcaaaatttggggaaaatttaattttttacccccaaaaaaatggaaaaaacaaaaaaaaaaccctttttttggggccccaaaaaaaagaaaaaaaggagagggcccccccccccaaaaaggggcccccccaaaaaaaaaaaaaggagaaaaattttttccttttattttgaaaaaaaaaaaaaaaaaaccccccccccccctcggggggtttttttctccccaaaaaagattttaaaaaaaaaaacccttgtgaaaaaaattttttttgttttgtttggctggtgggggcccccccaaaaaaaaaaaaaatttttttttttttttttttaaaaaaaaaaaaaaaatttatttttt

SEQ ID NO: 33814 - DNA, 111 bp, Heterodera glycines
attccagactcagttccagtctcacggctatcctagcccctatgcaccaagcccaccccacggtatgtgcctcctccctccccgctgctccctcctccgtcccctctccct

SEQ ID NO: 33815 - DNA, 1026 bp, Heterodera glycines
ttttaatttttaaaattacgttgatatttaagttgacggtgtaatgtttgttgatttaaataaatatcaacattgaggttgattctccgcaaaaaaaatatttctaagtgaaaaatgttgatttgccattctctagagtggatgcataaattcagtctctcaaaaacagtgatagataacgacgacgacgacaacattaattaacaaagtttttttcactttataatttatacaaagatattttacatttatattttaaaatattaatgtatcttattaaaaataaattgtaaaaaaagaagatcttttaaatatatgggattttaaaagaatattaaagaaagtgaaataaattaaaatccaccaaaaaaaattttaaaaattttaaacattaattacactcaaaaatcatcaattcgaggaaatactgttcagtgaaaattattttaaaaaataatattatttaacaagcatcaaaatgggaaaaataataatgaagtaattctttaatacaaattaattaagaagaaaattttgcaaataatgaagaaataccttaaacgtttgcatcaacggctcgccttggaaaacgtcaggaattattttatttctaaatttatataaattaaattatttattttcaaataatcagctttttaaagtagaaaaaatattccttatttacaaaaataccagctaaaaatattaattaatgatatattaatgcataaatctttatcaaattaattttaattaatcatgtaaaactattgctttcaaagattaaatattaaaaaccaacatatataattcacaaataaccaggaagccgaaaacctgaaaaaaatgtaaaaatattctgccggtcttcggttttttgaaattttatattttaaattcaacaaaacgtaattatcactcaaaataattaattaaaatatctttttctgttttttgattgaataaattaaaaaaataactaaatagcaatatcaatggtttttagagttaaatttattttaattt

SEQ ID NO: 33816 - DNA, 778 bp, Heterodera glycines
tagggatcggatttatatttgtacttattttttctgcggctttaactcgacgagaaatgcacgaaaaacacattttttgttcgaaaactttgcgttttacgcccttattcgaccttagaaatccttattttgggtcttcttcctttaaaatccttgttttagatgttcaccattaaaataagtttttgtccttatttcgcgatttttttaaatttttcatataaaattaacaaattcttgaacaaaaatgcaattaaaaaaatttttttgacgcgatcacattttttggcaaatttacaaaaaaaaattcaacataaatttgtttttttgttaaccaaattttttgtaatatattttctttcttgatcaaattttggtttttgaaattttttaaattttagaaaaatgcatacaaatttcgaatatttttaattatttgcattttaatcaatgaataaaattgtttgccttaatttgaaattattttcatatacattaaaaaattatacccttaaatatggaatttttcgaccttattttcgctcttatttcgcacttttttcgcccttatttacggccttattttggactttttcgcccttaaaaatccgatccctacggataaatctttaaatatttcaaaagtttaatgctttttaggccagtgttgtgcttattgaagaatttccaccctcttgttgcgctaaagcatttacataatgaaataataatatttctcgcggattacagcgattgtcatcaacgatccgtctttttt

SEQ ID NO: 33817 - DNA, 839 bp, Heterodera glycines
tgtgaagttatagcatccaaaaaaagctaatctttcaaactttgttttgaaatttaaatgcgaagcgttagaaaaaaaagaaataataaacgtacagaatttctgaagacatttgcagcaaaaaaatgaccgggaaatacaggaagaatacctaatgagagaatggaatgaggcggaggaggagaaaaaaacacatttttatactaaaaaagttacaaacaaatacaaatgttaaggtgctgctgcgcaaaaaatttgacgaaattcattttcaatggcacagcccgtggaaaaaaagaaaaagcattcctccgccgaccatcgcttcatttgtgaagattccgcttgggggtggggttcccaaccgggcaacgactttttttgcaccacttttttgcggcatttttccaaaaaaacttttggggaaaggtggggtccggcggtgcccgccgagaaatttttagtgtttttaatgcgatttgttaacgaattctgtccaaaaatgacaatttagcaaattttgcaccaaaaaattaccattttatgcttttaagccaaatttttaaagaaaattatagacgaaagggaaaaagttgattttagtcgatcgtaatttgtgtttttttttaaaccggcaaaatttttggatttttctatcccctcttctcttacgatcgacaattttcctcacaaatcggtattagtcgaccctaaaaatttggaacttttaatgaaatttattaagaaataaggcaatttttcggattgccaatgaaaaaattttatagagtttctgttttcatattaacgatcgactttttcgcagactttttgttctc

SEQ ID NO: 33818 - DNA, 761 bp, Heterodera glycines
  misc_feature (56)..(56): n is a, c, g, or t
tagcatcaaatcaaatgtcccacagaggtaatcaaatggtcggtcctttcttcttnttctcaatggccataggttcacaaattggcgcctttttcgctgttttggtcggcgggcggagacaatggcctaaaatttgaattcgaagaataattagttaaataaatttttgaaaattttttttgaataaaaatcaaagagcggagaacccgaatctgatattaatttcgagccacgtcgaatcccgaacccggatttgagcaaaaactcaaagttcaaatttatgaatctcgcatttttgggagaagattttgattcacccccaccgctaaacaattaccaataaatttaattaaataataaaaaatagggtcaatggcaactcgtacgaaaatcacttatatatgtattacaacctagccaaggccagagcaagccaaagccaaggactagcctaaagcttaggcctaagcctaagaaattgtatgagttgttgcattttgggtactttcctgtatttaaaaaatcaacaaaagggcgcataaaaggaagtgaccaccaataaataaaatgggtgatacaagccaggggaagtcttgaagaccacttcgatcagtcaattcccacaccaatcgaatagattcattcattcatttcttctgctgatcactcggcccgggagaagcggcctcgagaagaagactgaaaaaacgattattattctattgcaaattaaaagtcaatggcattttatgagtccaact

SEQ ID NO: 33819 - DNA, 950 bp, Heterodera glycines
ggggcggggcggtgggcgatcagttcaatttgggtaatgggcaaacgctgaaggcatttccacgcaccgccgctcatttggaagtgcgacgcggcgaattggtggaacaaatgaaagacgtgagagaagcgaccgatcggctgacagatcgaattgaacaagcacagaagaattacgcgtactttcaggtgggccaaggaaaagcgtttggtcaaatggtcaaataaacttttgccaatttgaaaatgccataggaatttcgtcgtcttatgttttggtctcgccaaatgtttgcgacaattaccggcgaattgctgccgcgcgaccccccggggtgcgaagcgctgttggcacggcacgcggagtacagacgcgagttggagacgaaggaggcggaaaaggcgaatttcgtgcggaaaggcattgaaatggtcgccgcgggaaattcgctgggggccgaaattcggacgcgactcgaaactttggaaaaaacattcacacatttggcacagacatggacaaaacggcaaaaggcaccacaaaatcaatgggaaaaccattgtgactaattggccatttgaggtgtacgaagagaattcggacgtacaaaaatggatggcaaatgccaacgaattggagcggtggctgtcagagagggagcaattccttcgcgacgattggcattcgggcgcgaccgcagaaaatgtcgaaggcgtcgaacttcggattcgggttggccctgggggggggggggggggggcggtcgtcactttccgtggaaagcccattcattcctttgacagcactttgacgactttttggccactcttgaagcacaacaatcgcaatttgatgggttaaaacgaatcactttaatcgaagagaaattcgaacggatgagagaagaggaaggacgacggaagagaacgcaaagtgcggagataccgccg

SEQ ID NO: 33820 - DNA, 718 bp, Heterodera glycines
tttcgcattttcgcatattttggctattcgcatttcgctttttttttcatttcgcatttttcagtttcgcaaatttcgcttttcgcatttcgctttttatttttcaatttggcccatccctgaaacactccgtcttatttataaaatttattcttcgattttcttctcgacgaagaaatctgatttttaaccatcaaaatcaatgagtttttaatgaaatatgtagcaattctatagcaaagtttatgctctttccaacgataaagttccaaaattagtttccaacgctatagtttttttccgaaaatttatccgagtttcaacttattttattattcgtgaaaatcaatgtacctgtttaatttatatgttaaaattagggctccaatttgtaggctctaaaaactgccaaaatatgttttttttttcttaggggtgtatttttgaatatttcaggctcgattcttagagatgtatttttaagaaatttttcgggtcgttcctcacaaaggaggggtcgtcaagtgaccgtgggatttccaaatgaaatttggtgggagggtaaatcacccctaggttctattgtgaaattttaaccatttttgccaaatgagcatgagggccgagatatgacgtgccaaagtttttacgctttttaaattagaaaagatataattctttttgggcaagaaagaagccattggtggagaggaaggga

SEQ ID NO: 33821 - DNA, 1346 bp, Heterodera glycines
atatatattaattgttatgtttaattcttttcaggtccttcattatgcggaggaaatttacgagggtatgaaagcgttccggggtgtcgatgatcggattcgactttttcggccggaaatgaatatggcacgaatgaaaaagtctgctgctcgtgctgcaatgccggtttgaaaatgattttcaccaaaaatgccaatttttgcgattttaagccaaataatttgtaaataaaatttaattcatctatcaaataatattatttatatttattaattttttttttgaatgccagattgcttcttgggtggatatttatcatttcatttatattataaaggattttgatgcggatgagttgctgaaagtgatcattgagctggtccgccttgatcgcgattgggtgcccgccaagtcacccgcttcactgtacattcgtccgacactgatcggcaccgacccagtcagcccggtggacccgccacgatcagtcaaaatgttcgttttaacaggtaatttgaaaaaaatatattgaaaggtcccgttcccaagaactgagaccaataccgaaagagtcatctagttaaacttgtaaattcataagtacaatatctttatttttaattaaaaaaattggaaattttttggagtttttaaaacaaaattttaaataaacgactatcgcgaccgatactctcgagcatctattactcaaattcatacctgtctactatattcaggtcacggtaaataaaaaagaagtgaaacttttttagaaaaaaatttgcctaattaattttttgactgtttttaacactttaattattgttcatggagtaaacatgaaatttaattaatttttggcccggtcggcatgtactttgccgtcacacagcccgtgtcactgtatgcggacccaagtgttgtccgggcattccctggcggagtcggtggctttaaaatgggatggttagttgaaagtttcaaattttaattaatgcgaaattttcggggtctgtgcattgtcggggaatggaaatttacatcagaaaaaatgcattaaattacatagattattaaattcgaggccaagatggagatttcgagagtcggatttgttcaaaaattaccaagatttacggggtattgggtgtgaaatatgagatttctgccaacaatggcgaaattgtcagggagccgtcagagacggggacttcaagaatcgggttcgggcatttagccaaaaaaaatgacgaaatttgtcaaattctgcaggagaaagatattaattatcttggatttaccccccattggacgtaaactttgtgaatccggaattacccataaa

SEQ ID NO: 33822 - DNA, 911 bp, Heterodera glycines
caaccagcagttgagcacttttggcacgttgttttgaagtggagtgaaaagccatttggccaccgattgtccatccgatgccgcggcaccgtcatcgcatgggaattcggcgaagagatcaccggcataaaaaatgacaaaacgaagtgatggacaatcgctaagaattgatggcgccatttgtcgcaaaagatggaaaaatgaggcggacatttcaatgtcatggatgtttttcccgagcattggccaaatgttgcgcaaaatgagttccgagatgcgatcacttctcatactgatggacaaattgatttgacaggcggcgaaaagtggacgaaaacggcggagaaaagcgatggcattttggtcgatgtaactaaaaataacatgaattgagcctaaattgtttcttcataattgaccaattttacttgatatcgatgcgttcgaatccggtgactttgcgtggcatttcaatttgcggaattggcaatggtgtccaatatttattgacaattttcattttcttcgtgccattctctccaattttgctccaaattcgaataagtcccaatgtccatttgcgcgttttgaagtgttcgtcgacgtaaaagtcaaaacggtggctgatcattgaaatgccaaggccaagttgtgacggctcaagcaaatcgaagacacaaagccaacagtcggcggagatgaaactgaaaaattaaattaatcaaatttttgaaagggttatttttatttttacattttcttttttggctttttgaaacggtcccaataaatccaaagaatggcacaaccgccgacaaacattggcactccgaacagactaaaaaatgagaacgaaaaacgttaaatgtcgatacaaaaaacgtacagaatcattttttaagacattgtca

SEQ ID NO: 33823 - DNA, 993 bp, Heterodera glycines
  misc_feature (975)..(975): n is a, c, g, or t
gaccctaatttaccccagaaaaatatttttcaccctcctttttcaacccaaaaaaaatttttgaaaatttctagggggcctagctcgaaaatttttgaaaatttctgaaaatgaagtaaaccgttcgatagagcttaaaaagctctacaattttgctcttaggcattttttgtctaaaaccgacccctgacgagttatgggcccaggactcaaatgtcccgctcaggccaaaaattttttctatttcctggaaaaaatcgaaattttttcaaaaatatcaccaatcgatagagctcgaaaaacggttgcttgaaagtggtctccgtttttctgggaaaattcgttaaaaaatcctaaaattcaaaaacccgaaaaccgttttttaggcctagctcgaaaaattttcaaaattttcgaaattttaaaatttggaaaaatcgagctttcgaagctctacaatagtgccgctggccaccctgcgctcaggtcaaagcctaatgagttattcaacggggactgaactggacaaagttggtactgaatttttgtagaagcacacagaccagggggttagagatagaggcctggaattttttttaacttttagccaacacttcaacttagggccctcacagcgagcattttttgatttgagttttaggaaaaaagttatgggccccaaactgcgagaaaaagtaagaaatccttccctgggactcagtcgtccgcgctgaatttttttctatagttttcccggatgcgccgtgaaaagttgtaagaccgatgcacaactttcagacccctaccgatagccgttctcgagattttggttttaaggatgagttgccttgtcaatataacatatatactagcgggtgcgtgaaccgtcggctatttagctgggaaaaagcgcttcgcgctttcggagcttcgctacctaggctgttacgggggaagaggtacaaccacgggtgngaaggtacaattgtgatc

SEQ ID NO: 33824 - DNA, 921 bp, Heterodera glycines
tttttcccctattggtgtgaaaaaagaagactgaccttttcttgaatgaactgatcattttccatcgaattgagtggcaatacgtttttcgagagagtattgtagtttatatgcgtgcataccgattttattgtttgtatttcaatttggtattaagtattttccaattaattactcaatatttgttgtaggagggacaaattaattttgaatttctcccatgtgcattttaaacataacgaatgcggtctttttgcacgagtaattcgctgagtgttttctccaaattttcgtttcattcaaaaattggtgagagtgctatatgacaatttcttgcgctgaactcaaattttcagctgtctgtgctgcgaaaagttgcaggaaaatgtcatctgagtcaaatatggagaatttccccgtcaaattggacatggattatatcaaacggttggcacgcatcgaacggaccggccctaacacttttaggtttctttgatgaaaagggtttcgaaagaattcatttttagtgccaattttcttgtggcaggctatcgtaaggcggtgaatagggacgttttcgggggacaaatgttcgcgcaggcaattgccgcggcagaagcaacggtggacggcgacgaatttgcaccgaacgcggcccattcgatgttcattagaaaaggtatttcattccggacttttcatttccccaaggcctttgtctttagcattcattgaccatcccatcgaatatattgtcaccagaacgcgcgacgggcgttcattttgcactcggacagtcgaagtgcgacagaacggcgaaaccgttttctgtgcgcagattcactttgcgttgtgcgtttacttttccgccgcaaaaccgcgacttttagaaggacgctcttcattgacacaaacagaatg

SEQ ID NO: 33825 - DNA, 1517 bp, Heterodera glycines
  misc_feature (1466)..(1466): n is a, c, g, or t
aaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctgttctgaaaaaaatatttatgaattaattatgcaaaaaacaaataaataatgaactctcttccttaataattttcctgcaccgaaggtactcactcggccgcttcgcggcctcgtggcgggccttcccccccgcccttcagagcacgacaaatatttcaacaaaaattttgaaaaattgactatagcaatcgaacgctaacggacgacctaatggaaaaaaatccccgaaggagagaatttaattaaatccattccttcgagagaccgtgccgcgtgccgcgatttaatcattgctgtttcgatacatcacatgaccgatacatttgcttagaattcaatcagaggattaattgttcatatcttacggtggatccatgaatcacaatgatacaatttcatctatacggttactgatttactcattaaaattccaaaagccgatttgacggatagaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaacaattatttcttcccgtgtatccaacaagagaagcagagaatttcatttacggttcctgatttactcattaaaattccagaagccgatttgacggataaaatttctaaaaattcaacaaaaggactaactattatttcttcccgtgtatccaacaagagaagcatagaatgtcatttacggttcctgatttactcattaaaattccaaaagccgatttgatggataaaatttctaaaaattcaacaaaaggactaactattatttcttcccgtgtatccaacaagagaagcatagaatgttatttacggttcctgatttactcattaaaattccaaaagccgattcgacggatagaatttctaaaaattcaacaaaaggactaactattatttcttcccgtgtatccaacaagagaagcatagaatgtcatttacggttactgatttactcattaaaattccaaaagccgatttgacggataaaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaagagaagcatagaatgtcatttacggttactgatttactcattanattccaaaagccgatatgacggatagatttctaaaaattcaacaaaggact

SEQ ID NO: 33826 - DNA, 705 bp, Heterodera glycines
atatctttgccatcatccgctcgtccgtctcgtggtccattttggcctaaatccgtgtcatcaacagcagaacggtccattcggccttctccccgtcgcttttggcctttgccttctctcacttttctctccgtcctcctcttcctcctcccgctgtttttgccctccgtcggctgttcgtacttttccgatggccatgtaacaaccaatgcttctgaatcgtccgcttcgtctccaccgtttctcgagggttcccccgccggcgtcaattcgtccgcccctcttctcaatgccaatgtctcactcttcgaacttctcgtcggccctaaccaatggaatcaaagcgatgccgactcagtctctttgccgttccttcgtttccgcgtattttatccgttaattttcgttttaactgtttgccttgccttagctctttacgctgaattggcagcaaattgccactccgtttggtgtgtccttttggctccttttggccagttttgccaaaatccgtaagactctcccaattgccctcctaattggctaattaatagttattaacctttccctcagtgttcaacatgaacaaaggcattgccgaggctgtgcccgactcggcgctgctcattgcgctcggtttggtgctcggttgggtgttgcgaacgatggacatggacggggcggtgttcagtctcgagtccgtcc

SEQ ID NO: 33827 - DNA, 516 bp, Heterodera glycines
ttttttctgcggtggaaaaatacgttgatcacgaatctgagttcaggttttgcaaaatcattgattttgtctatgacttttcatcaagtacttgattttttccaaaatttgttggaaataaaaactattcaaaggagttgtagaactgaaaaagagcttttgaatgagctacttactgagtgtctggagaattcaagattttagttttttatgaatttttcaaatttaaatactggtccttaggggtcacatgaaacggggtctggagttcgagcccgcttggctgcaattgtttttttcatagacaaaatggtggcttttgtaaaagctgcgggttcttatcccttttgtgaccccccctgaaatttttttattaaagaatctgagactgtttataaatgctgttagttaatgcatcactgttttataaatagttgatcatcacaatataaattattgatcctcgaacgggggctcacacgcagactattgagaggctttggagggctgcaaaaa

SEQ ID NO: 33828 - DNA, 946 bp, Heterodera glycines
  misc_feature (15)..(15): n is a, c, g, or t
  misc_feature (25)..(25): n is a, c, g, or t
gggggtgcggcggtngcgataggcnccgccggggttaaattttgaaaatttgagtgtaatttgttaacagattttcaacaaaaaggacttgtttcttgggattattagactcaatttgtacggattcatttaaaaaaggataaaatatgatcaattaaaaaactatgaggaatcatattttgctgataagaaacccatcagtatacaaaaagaaaattcaaaattattttttccctttaactccaattttcatctctaatttttccctcaaacccccattcttaccagtgcttgtttttcccggttgccctagcgggaccggaaaataaattttcaaaatccgggaccgggacctcggaggaccgggaattcccggcccggtcccgctcaactctactaataacttttaaatttaaggtgtataaaatctaagttttaaaattttatatcaaaatcaacaaaattacgccaaaccagtatggagataaatcatttttaaattccaccttcaaatcgaaaatattggcctgggcgtaagccaagaaaacattgcgcaatttggagaaggaaatttgtaaagatgggccgtcaaggccaggaatgttgtacttattggctaaataacaaaataattaattaattaattaaaaaataaatccacccgcgtaaagcactgccattgcgttgtctccattcaattcgctcaaatcttcaatgtaaatgaagctcaacatcgggtgcttctataaaaagttatggcattgatcataaattgatcatttatggtgatcaataaccccctagggatttcgaaaatttccccgattttcagtgtattcgggtgtcccggtcactaggaaggagtgatctgatcaaatcggtgtaagaaacttttttgatcagcaccaaaagttatgcaagcgtgaattatttcaagtttttaaat

SEQ ID NO: 33829 - DNA, 662 bp, Heterodera glycines
tcgaacaatagctacgaaaagaaaacgaaaatcaattaaaagggaattaatcgccatgtgaataattcgtgcattaatgcatcaataatatttggcccccccctccgtccttcaaaattttgaaaaaaaaataaaataataggagcctcagaattttgaaaattttttataaaaactgatgacaagctaatgtgataaaacaggttaattcttttcctttcagtatccctgcaaagtttggggcgcttgtgataagtttgtgaaaaaaagttaagcctacattttttggcatatttaaaaagcaattaaaaaatttttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatagttaaaaatttttaattcctttctaaacagcccaaaaa

SEQ ID NO: 33830 - DNA, 517 bp, Heterodera glycines
  misc_feature (502)..(502): n is a, c, g, or t
ctgctaaatcaacgcagagacgcctttccttgacctttttaggcccatgcaaaacctggagcgtttctaagcactactcgaaaaatgagtgatttaattttcactaaaaagttaagcctaaacattttggcctgtttaaaaaggaattaaaaatttaattcatcttcctttttgatagaaaaagcatcagagagccttattaacttgtaaataaaattaggtgcgtttcagagcactttctgaaaaaatattcatgaattaattttgcaaaaataaataaatagtgaaactttaaaaattcttagaaaatttaaattcataggtactactgctaaatcaacgcagagacgcctttccttgacctttttaggcccctgcaaaacctggtacgcttctgagcactactcgaaaaatgagtgattgaattttcactaaaaagttaagcctaaacattttggtctgtttaaaaaggaattaaaaatttaattcatcttcctttttnataaaaaaaacatca

SEQ ID NO: 33831 - DNA, 935 bp, Heterodera glycines
ctcgtggccacccaattgattggtttttcactttttaattatttaaacaatttcaaactaatagcaattgctttccacttctgtttctaaaaaataattggcatgaaaatattacaatgccattctgtgggatgccattgccaaaactcaggaacccggcagggttaaaaaaaaaacttggcacttccccttttcaggcaaaatggcatccctttaattcatccattatctatattttaattatgtttatttatttctttttaattttcaataacataaggcactgaatccaggctggtccgatgaacaactctttcagacaacacgacaaattgtggtcgcgcaattgcaacacatcagtaattcattttattaaataattataattaatttttcataaatatgcccaaaattttaccgtccgtttttagcttatgaggaatggcttccactagtgttgggccgggaacgatggcttcgaagcggactcagccaagagaaaggccaacaaaagggtgggcggggagagggtaattaaaaaattaattaattaattttaaaatttaattttgaattcactgtttctgctggcgccaataagagactctcgaaaattggacataaagaaatttaaaattaattataccaaagagcagagagtaattaaaaagtaccaagtgccataattagtaattttgctatttaattgaatgaatattaattatttcatttggcaccggcaaatggctgagtattaaataaatccttgttaatccactcaatctctccaaacatttccatttggtatccaaaatcctccccaaaaaaggatgggcttatgagagaataaatttaagaaaatttaaatctttcagcagatgccgacaatgactacgacttgaatttggacggcacacactgaacgaatcgcagca

SEQ ID NO: 33832 - DNA, 950 bp, Heterodera glycines
  misc_feature (861)..(861): n is a, c, g, or t
  misc_feature (874)..(874): n is a, c, g, or t
  misc_feature (897)..(897): n is a, c, g, or t
  misc_feature (899)..(899): n is a, c, g, or t
ttcggcgacgttgacgaatcgacttgcttaagtcggtaaagccgcttgtgcacagtctggccttcgtacaacagttcggcagcaatgccggtcgaagccatgggaaggaagttgatgccagcggacttggcgattgctctggattttgagcagctgccctgtcatcaggagcaggtggacgtcgccgatagcgcgggtaagcatgttcgttgtagacattgtcgtacgaaaatggcttctaatttgaaatgcttgagtacaagaaaaggcaagtaagattttggctaaccggaaagcgtttgacacatttgccgtcaacaaaacatcttcgcgctgagcacgtgtggatgtgcttcatcctcagcgttttgtaaagctcacgcttcaacaacaagtcggatgagcggcccggtgggttgtccgggatttctgcagagatgtactgctcgatatagtcttctggcgtgttgatggtgccgccacttcggattctgtcccagtccaaaatcagtgcgaaatggacatgcgggaggccactaaaaatgactcataaatattcaaaaccaaaggactcagtttaccgtttctgatgctccaatgagtagaaccagccacggacgggccccatacctccttgacggtaaggtcatgacgcagctctttgaatttgtcgacaaagagacgacaaatcacgtccggacggtcgtaccactgctggcggtggccatctgggtcagttggcagcatctcttccagttcatcacattcgggatccatcgtcagagtgatcaaaaggtccggctttccacttctctgcagagggtcatgcagttggcgtactcgcgctggtagtactgccgnaaccccgcgaagntgctcgtcggtcatgtagactcngncaatgtctcccttgtaccctaatagcagctatttgattataaactcgaaat

SEQ ID NO: 33833 - DNA, 857 bp, Heterodera glycines
atagatattctcagaaaatggctatctctttttttctctccgttgtacatgtgggttttccccaaaaacgcattactatctgcggttgagccctacaaaaggtcgggttgaaaattgctttctcagaagaatagatattctcagaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaatgggttatctctttttttctaccccgttgaacttggggggtttccccaaaaacgctttactatcgggggtggagccctacaaaaggccggtttgaaaatggttgtctcaaaaaaataaatattctcaaaaaatgggttttcctttttttctaccccgttgtacatggggggtttccccaaaaacgcattactatctgcggttgagccctacaaaaggtcggtttgaaaattgctttctcaaaaaaataaatattctcaaaaaaagggttttttttttttttcaaccccgtggaactggggggtttcccccaaaaacgcttaatttttgggggtggaccccaacaaaaggccggttgaaaattggtttccccaaaaaaaaaaatattcccaaaaaagggttatccctttttttctaccccgttgaacttggggggtttccccaaaaa

SEQ ID NO: 33834 - DNA, 581 bp, Heterodera glycines
aaattgttatttttgaatagggcagtcaaattgtaactctcgcaatatggaactaaattgcaaaatgtagggctttctctattgcacaaagcaactcaatttgggtctgttcgacaatattatttttttaaagaaagaacgccaaaattttaactttaatttggattttgagcgaaatcaaaaatcagaaaacgaacgtatgcattttgtcgacgaaaaggagagtactgtgataatttcataaaaaaatcaacaaaaaaaagtcttgctctcccccatgccctttttcctctttctctttcatttccactcatatgctcaaatacatactatacaactaaatgcttttacatttttttaaatgatggaaagaagacaattctagttgtcctccttgtctttggtgttattgttttgataatactggtttgtttgcatttgtttccttaaaatttgacccctaatatctttaggaggccagatcgaatttggcgaccgacgaagagggagaaggtttggaggagcaccggcgaatgaaggaggagaatcggaggggccgccaggagcggatggaagctaat

SEQ ID NO: 33835 - DNA, 866 bp, Heterodera glycines
tgaactgaaaaaaagatatcaaataaatgcggatggaatatgaatgagctgaatgaagaatttaagaatttttgggtaataaatagtagggtttgtcacaagtttgaaaccaaacacatgaaaatcgaaaattttgaattttcgacttttgttcgaattcgggtccggggctcggaattggttgaaaggatgccgaattagtgatcagcaacctcgaaaaccctttataatatattttcatgatttgaaaacaaacaatatttttttcaaaaaatgggggggggacaaacccatactacctatcaggggtgggacaactctcgcctctcgtctctcgccaactctcgccatttttggtactctcgcctctcgtctctcgcctctcgttttttgggacgagaggcgagagttgaaaatacacccctaaagattgaaattttgagcaatcagaaaaattttcaaatttacgcgaaaaaatcataaatctctttttctcattccttaatgtcttctctatttttggataggttcagttcaaatatggtctggtggctaaaccttcttcctttcattatttttctcttgggttcaattccccaacggtacagaattttttttataatttctttaaattatttttcaatttttcaattgaaagatcattttttgacaaattctgttaacaaatctcactcaaaatttcaaatttttttttccggcggcgcctatcggcaccgccggaccccgcacccgcccctatgtaaaacagcgtcacaaaaaaagcgagttacagactaaaaataaagttcgtttgtataatagatatatttcatgaaaattttattttattttcatgaaaaatttta

SEQ ID NO: 33836 - DNA, 828 bp, Heterodera glycines
tcgagaaacttagctgaaacgggtttattttagccattagtggtaatatcttttgttaaacttacttcccattttgctgacaatataatttaagtcatccttcaatttaaagtggggaataaatcaagtctaaaagaaaaggaaattacaaattaagtaaagcttgaaataaaataatcacagggactacgatcaaaagaaaatagatttaatttatatgctgtaattgtatgtgaggaaagaaggaagaagcaggcaaaactgaaagcgaatgcgcaaagcattgggcgtagaggaaaagctgcaaaaactgcaattttttaaagtgattaaaaaaattaaataaattcaaaataaatttatttgtaaaacaattttttgggctttgcatacatttcaggtgcttccgctcccgggaataattgaaatcttggcaattccttaaaaagattttcaccaaaatagccaccaattttgccttatgtattcggtgggcacccaaattcaaaattggacctttcaatcgttggatgaacttgagcagttgcgcatttcggagaatgccaagcacataaacaggccctctacgccctattcaatcccattttctgtatatctttgcagttcaattttcaggtttcagtccgtgttggctgaacgtccgggcattgtcagcgacgactttttgactgcccgagaggaaacagtaatttgtatgaattgtaagcgaatccgggataaggtgaggattagttatttattcacccagtaaaatcatttaagatctggtgacgattttaagccgagaaatgtgaccatcgagtgcgc

SEQ ID NO: 33837 - DNA, 1599 bp, Heterodera glycines
ttatccttctttttaaacgaaaaataattattaaggccgatattaaacaatgaatttggaccgcaaattggccaagaaataaaagaaaaatgattggcataaaaatacactatttgcttttttgtaaagaagacagggtttctatcgcgaaaactcaaaaattggaataaaagtttatagtataagattgaatttgtgtgattttacctattctgccttttctaggagaaataattttaattcagcatttatatacgttacttttttttacaattatttattttttactgtatgttttaaaaaaacaaaaaaaaacacgagaggatcggcggtgccgataggcgatgccggaaccaaattgtaaattttgttcctatttctgatgagtcaccaacaattgtcaattttatggatttttatatcaaatcttatgtctattaagtgaaaataataattcaggcaaacccaataaaaacccgacaattcaaaaaaaccgggcacgggtccccaagtttacacacttattcgaaatctcgaaacagtgatagtataagatgcattttgcaaatccataagtaaaatcattttattcatgttttttctgcaactctctaccgttgtgtagagtcgtaataccatcgagtgaccgccggaccacataccgcaccttaaacaatacttttagatatatacagtttccagacgaaatccggtgccgcctagctcggcacggtaacgcaccggcgcgggttattggccatttttaaacataccgtacttacagaaatagacctttcaccctgaattagaccctcgtccctaaaatatagccagctcctctcatcctccctggaggtcgagggagggggggggggtagaaaaatagagcccccgggtggttctaattcagtaaatacggtatattattgaaaaatagagcccccgggtggttctaattcagtaaatacggtatattaccgcaaagttttacctccctttgccggtagagaacatgtgtaggctgtaaaagtgtaaaattgttttttttccattaatttaaaacaattattaacttgatgcagatttagatatttattcttttgttccaaagtgctgaccagaattaaataagttttttaaaaagtagagaattttttaatcaataactaaaaaatcaattaatatattaaattttggtgttcggggccatagttcatactataaaattaacaaaattaactcattaattactacataagtaattgacgaccgaatcggcattgatcttcttggcaacatttttaataagatatttcttgttatttttaaagtgaaaataattttattaattgaataaatcaatcggaataaatgtgaacagattagatatttaattgtaaaaattgcaaaaatgtcgaattttacgaaacgcccgaaggtggcgaattttacgaaatgtcccagcacggaattttaccaccattttttgcggcgctctttttcaaataaaaaatttggggaacaaagaggggatgagcggcggtggtgttaggacccaagaggaaaattttttttttgaaaatttgcaatttgttacat

SEQ ID NO: 33838 - DNA, 950 bp, Heterodera glycines
tgagcttttttgtggaacgactcaccacgcaattaacgaatttgcttagcggtgacgccaaaaattcttaggctttttatgatttttctaaaattcgaaaaaacaccacttaactcttcaatttaatgcccatatttgtttctagaaaccctattttgtgaaattttgccttaaatttgggccttttgcattttttttgagtttcgcctctattttggcctttttgaaaaatttctttcatgaaaatgaaccccctaaggatttctttatatcctttgaaaaatttataggttttttaaagttttgcactaataatttgctatttcgtcccgttttttgccatttcatttgcctttttttataaattcagtcggcaattacattgtccaaaaatgtgtgccggaccagccaggggccagaaactattgcaaagacttcaacaacatttgccaaatgggctttttcggcatgccaattcattgctcatcttgtaagggtgatctgtgcaacgaagcgcgtaattaacaaatgatgagcaaattagtcaaattaataaactaattaattaattaaactggaataaagaaccgattttcaaattttatgtttgataaattattttatggctattgttgtattcaaattcaattcaattagaataaaaaaattgcccatatttttttgtattaaatttgtttggctggttaaaaaataatcggggaataattccctcgtcggggagtaatttttcgtaaaaaaaaagtggaaaaagattaaaataaattcctttatcagggcttaaccctaagattagagcatcgaaaactttcaaaaattttatggcatttgcgcccaaaatggcattgcatcaaaaaggacgcgttttttgctgtttattttcggcgggagaaattctcgggctttttctgtctcggagtcgattttgaagg

SEQ ID NO: 33839 - DNA, 1292 bp, Heterodera glycines
gatgtgcctaggtttcgcttttcgcctttcgcattttttggcgtttcgcatttcgcttttttgcgcgaaacgcgacttttacacccctaagaattggattaaattcccataaaatttttcaaaattttaccaaatatattcaaaattgacagccagccaagggcaaaaaaggtgggccaagcaatcaatcacctgccgcgggttcaacaaccagcacagcgtgttcaacgccttggctcctttgttgccgccacttttcgggttgacgaacaccagcagcggttggatgggcagcggctgcagttgggccgcggttgcccagcggctgtacccgttggcgacgccgtgcgcctgcgcggacgaacagcgcgaggcgggcggcggcttaaccacaaacgcacggtatttgctgcgccgtcgggaccgtttctgtgccacgtttttcgcgtaacgttgctggaatgacaaaggccagtgggtcctgcacgtcgacgtttcccagcaactttttcttctcatgccgcatcatttcagtcaacgcattgttggagctcatggcaacataggcttcatccgttgctgatcgcctcactttagccaaaagtcgtgtgggcttcagacacggctcggccaggacactttctttgattttctgtcgccttgactctgcctttaacaaagcattaattatttggttttaaatttatacaaacttgttgtttctgaggtgctgggaggtggttgtgttctttttgactcaaggttccactagctccggtttcgccgttgtttgtgatgtttatatatgctgagcaacttgatttgtgcatcttcagggatttggtgagaggtgtgtgagacaaatcctgaatagtatggaaactaaatttattgcggcgcattagtcataagatttgaatgtgtcctattttggcgttatgtcgagtgaggatttgagcagttgcggttgacatgtcgataaaattgtcggaaaagggaagatcgtattggacttttcctaagaaagagtctgttgagttatcgcgcgagttgtataggataagattcgggcatatggcatcgattccgacaaaaacagcaaaattggagttaaattttgagttcaaatgatagacagaagtccatatttgattcgcagtcaagcagcaaatgaacgtcttgtggtgaataacgacagcgtagcgttcaagcgcaagctcctctcagcgatctgaatcagaatcaacacggcagttacccagtcccagaaaacagcccgcctttatttcatt

SEQ ID NO: 33840 - DNA, 885 bp, Heterodera glycines
aaagacaatgtaaaatagacagtttgccagctgaagagtcttacagagaaatgggtgaatgaaaatatggctatatgagagcacacattgttgccaagtgtaaaatggcatggataaagtgcattatgagaaaattatatttacatttacaaatttgaatataagtataatttatatatttttataatgtttattttaaattttaatttgtggttattttgaaataacagcattaagacttgccaaaaatttctcgaatttcctagggcgcgcatatcttcgccgccgagatcacctttcaaatttttgaagaaactagccaaaggcagcatgacaatttcacaagaccagcagaacaggttggtgggccctctaaaaccctggtaattaataagaaaattgcacaattatttgatgaattcaaaaatcctaaaatggattttgaataattttaattttataaaagctttgatgaaataatttattcaaccataacttaaataaaaataaattcattttggcctgaaaaccactattacgcttatgcactttatttttaacatatttggaccaataggaatcaaatttttgcgcgagtttagaagaaatgaacaatgaaagatgaacaaaatgatcaggaggaagccggatcccatctgattatgatgtagagctggatggagtgggagatgacgatgaattgctcatttgttagcattttttactattgtgtttttaaaaaaatggtgtaataaataaaaattccatttatccccacggggggataaatggagacggcgggattattttcaaacgcctcagaaaagggggggggggctaattggagacggtgggattaatggagacgggggataaaaagagaaa

SEQ ID NO: 33841 - DNA, 1072 bp, Heterodera glycines
  misc_feature (18)..(18): n is a, c, g, or t
  misc_feature (145)..(145): n is a, c, g, or t
  misc_feature (1013)..(1013): n is a, c, g, or t
cgtctcacatctgtgaanacaatgcgcgacccctttggctcgtcgttgcgccgttcgaagttcaaacatgtgatattatgccaatgttcaagtgccaattcgatgaccctttgttcgcgaagtgcttaaatgggccaaaaaggcnaaagttcgcttttgcattgcttcgcttactgtgcgacccgtcgaaactgtaaacgatcggcttcattacatcccaacgacggacctaaaaacaaaataattaatgcttttaaatcaatcgcttcggagatgggcaattaatgcccatatggaaaatgacaaaagtaaaccaatcgtctgcaattggtcagctgtaattttgagggtttttcgtttttttaaatgtttttaattgattgtcgtctttccattgcccaccttcgacccaatgaatttccttttggccctccgtcgtcgtgcaaatgtttcctcgagaagggcgtccgcttggtccgcacttagcacgatgtcccctggccatcactgttccataaacccttcctcattctttcctccaataaaagaggtcctcccctctttcatataaattttataggataaattgaaaaatgcccaaaatcaaataaatttgagaatgccatccctcgtccgtccgtcccctccgtttgtcccccttcccctctcaccttcgaagtgtctcccgccttcctccggccattcatcggcgccccttttctttgtcgcgccgccatcgtcgctgactctgcgggcactccattcgcgcaactctcgccactgctcgtccgtctgaagttccgtcccttctcttttcccttcccccctttaccatttcttctgtttcccctcctttcgctgttccttcgccatttctttgattctgttttctttgaatttttccgttcattttctcttcttcctcaattccttcttttaatctttccattgccaagcgaattcttaaaatttattttttattttttgcattttaattttatttatttttctantttcaaaacaaatttcccaatccttttccgtgccacctttccgtctccgcttcgctttg

SEQ ID NO: 33842 - DNA, 856 bp, Heterodera glycines
  misc_feature (823)..(823): n is a, c, g, or t
ttgccaacgaaagtgaggacagatcgtgcgatgcgcgaagtcccacggagcgcctttgcctggccaaccaaacggcggtgctcggcggctttcaccatttgacgcacgactgccattgcgtgcagccgtgcaccggtacggtacatgccacagtaggcgatgccttaggcaacccaagcgtcttactgtaggcaagaaaaaaagatatgcaaaccgtacccagaaaattaacaaacgaattacccatttgggatgtactgttgccccgttcagagcatgtcttcgagacggcgtattccgcggccgcgtggcccgcgtcgaattttaacattggcggcgacgattgtgccattgttttgggcgcgaattttacgagagaaaattgcaccaaagtcaaaaaaaggggagagaaagggaatcaattggcattccgttcagtatttcgccaaaaacacggcactcatcgagatttactatgaacaacttaactatgagaaactgaaggaaacgccgggctatacggtaactaagggaatcaaaagggtacggtaacgaggggcttttcctgtttaagttggtcaatttgttctccgacttgggcggcaacattggcctgtggatcggcttctctctgatcactgtgatggaagtggtcgagctgatcttcgagtgtttcaccttcggctgttcgaatttcactaaagccattcattcgccgattcattttttccttaggtaaaaagtgcgttttccgtcctttgcgcaaaaaggcatttgcccaccggcaccacgacgatgccgaaacggaagaatttacgacggnagatttctggctcatccaccggaggcaaacggc

SEQ ID NO: 33843 - DNA, 217 bp, Heterodera glycines
tataataacgctgcggacatctacatttttgaattgaaaaaaaattggtaattactctctctttttctccatattgaccatcatactcacactcttgacagtttaaactcgaaggcgggaaacgacaatccgatccccatcaagctagctcgctcgcaggtcctcgctcgagcggccgcccggggatcgatccccgatctagtaacatagatgacac

SEQ ID NO: 33844 - DNA, 1235 bp, Heterodera glycines
  misc_feature (76)..(76): n is a, c, g, or t
catgtgtggcaaaagactcgtcgttcttgaagcgtcttgtgacgagtcgctaaatagcaaatcgtcgggataagtnaacggagttacactctgtgcctggtgtggacgaaaaggagcgcgagctgtgcaagccgaacagcaagtcgggccttgtttcgcccgaactctctccgccggtcctttcgctgtccattccgccgattccgatccaaaatcacagcaaaaggaaatgcacaaatttcagtggcctctttcccttccctttccgagtcctcttgtcccttctcaccatgctaatgcgtacccacgagtgaatgcggttgaagaagcggcccaacatccctccgtccccctcctccgcttcctccgcccctttcgctttttcctgtcgctgttcgcttggcctccgcgacggcgtccgactcagtgtttggcccattggcactggtgccgaagaagcattcgtcggatggtccaactgctggcgttgtgttggcatttccctgcaattccaccgaatatttcttcctttttcggtgtttttcattcgcacgtttttttggccatttgcgtccctttgctttctttgtcgtttcgatgctcttttgctccatacttttcttctccattccgccagttttgaacttcttgcgcgggttgtgccgaaatgggcgacgagttcgacctgttccgatggcactctttcaaatttccaactgccattttgccaacatttcgcccattttcgccattacgatgagagttcatcgaagaagcatttctctgaaatgttaagctgaagttaaatgtcaaatccttttttccatctgagtaccgtaaccccatctttgttttgaatctcttccccccccccccgccaattaccattattttcaacggttctcctcccccctcttttttgcccattgttttccggtttgcgattatttgtgaggttgtgtccgatgccgaaatgtcagcggaaggagaggcaattgccgaggggctaaagtggagaatggaggaaagactttcttcgttgaaggcgccggtgcttagcgaagcgatcgcgacggagtcgaagggatcctcgtgccaatcgaattcattctgttcgcaaggaaaagcccataatgaaatgccaagttcttgttgacgattcttttctgttctcacaccatttaaccgcccccccccctctctctctctctctctttcctcctctctctctctct

SEQ ID NO: 33845 - DNA, 863 bp, Heterodera glycines
ttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacatttttcgatttttgggttggggcccaaacgaccccggggcccaaaaacgggggcccaaacgaccccggggcccaaaaacgggggcccaaacgcgggggcccaaaaacgggggcccaaacgctctggtccctccggcgggggagaaattgaaattttgaccatttaaagttaaagacattatgccaaatagatatttttcaaagaaaaacgaacaaacgtcaaggttttttggttgagaccaagccggaccggatccggtcaaaaattcgccggaccggaccggattggcattttcaaaaatgaccggattcgggatccggtcaatctatgtaatccggtcaatccctatttttccaaaaaatcgccggaccggattccggatccaggaaaatccggtaccggatccggtccggtccgctctttagtaaaaataatgatttttcattgaaaatctgttaaatatatagccaaaatttcaaaaaaatttcccggcgccgggtatatatggaaccggccgaaccttaaaaatctttaattttcttaaaaacttgctcaatttgcaaaaattggtcattattgaacagaatctaacaatgtaatgtattaaaattttcaatttttttcccggcggcgc

SEQ ID NO: 33846 - DNA, 487 bp, Heterodera glycines
taattactctttcaatttggcggccaaatgccgtggcgagtccccgtgcgcattggtcacgttcgggtcggcgcccaggcagagcagcaagcgtgtgacctgcaggttgcacttggacaccgcaaaatgcagtgccgtcattttgccactgtccgctttctcgccgaggccggcaccgtaggagagcagacacatcaccatccctggaagtggatgaggataatggcaaatgattgtctttttaatttttagctcaaaaattgttaaaaattgaaaatttttagaaaaaaaaaactttttttttgaatgccaattttaaagaaacctcataaattccgtgcgttcttaccaagatcttcacgcatcacgaactgatgcaacggggtgaagccggccttgttcttgacgttcaggtccaactctttgtgcttcagctggagcaggctcatcaacgaggccttctggttggctgcgtgcaaacactgtt

SEQ ID NO: 33847 - DNA, 428 bp, Heterodera glycines
aaaaaaaaaaaaaaaaaaaaaaccccccccccgccccggggggggtttttttttttttttttttttttttttgggaaaaaaaaaaaaaaaaaaaaaacaaaatccccccccccgcccgccctattttttttttttttttttttttttttttttttttttgggtggggggggggggaggaaaaaaaagaaattatttatttttttttttttttgctttttggttgggggggggggggggttttgttttttttaataaaaaaaaaaaaaaaaaaaacaccccccccggcggggggggggggggtggggagaaaaccccccaaatctttttttttttttttttttttttttttttttttttttcccccccccccccccccccccccgcccggcgggcggggaccacaaaaaaaaaaaaaaaaaaaaaaaaa

SEQ ID NO: 33848 - DNA, 1441 bp, Heterodera glycines
cagaaactgtcgcaagtccattcgatactcgaaactgccaattacacgcatttgcctgacgaatacggtcagtctgacaatgacaaacggagtttaaccaaacaatttgttttccctccattttcattgtcagatgtttctgatttcgtcaaagagttgatgctttgcgctgtttttgttcaggcggagatggcccccttttgtgcccatttcgcagaacaagtaaaaagaaaaaaagagccttttaaatcactcctattttaattaaactcaatttttcactggctttaaggttttggctgatattgtcaaagtgtctctggaacagctctttggccaactttcgaaagtggatttgtcttccacggagcgcaccacccaaaccatcgttgatctaactgcttttgaggaagcctttcaggaattcatcacaaccgaaatgcggtgagtaattgcggaaatacctgaataattcggctaatttgcccaacatataatttttcttttcagttctgccttgaaatcaatcagagctcgtttaatgcctcgaatggataatgagtgagttgaatttttattttcaatttataaaaatataaggaagggattaagcgcattcggataagaataatctgatttgacataggattttccgaaatgcgatgttcaacttccgttcggggatgatgatggccatggaaagtatacaacagtacagcaataactcaaaacaaaaagatgctaattctgaagtcgacaattctgttcaaagcttaaccactacaaaacaatgattgataatttgacactgtcaccataaaatattgtattatattgcaataattaatcctgttaagactattttaatcaaattttctttctttttttaaatttttttttgcataatttccataacaaaagacaatgcaaaataaaaactgagtcaatttagtcagtctcatgactcattggattgatcaacaaaacaaccgaagattggtgttttggtggggggagccgaaatgattcaccattgccactacccttgcaattagtccttttgtacgaccatcgattcatttaagagaaatgaaatggattttctgcttttatttttcaatgatttttggatcggaatgtacaaaattttaggaatgtgatgggcaaaaattccattgaataatttaagcgtttctttgagaaaaaatcaaataaaaattttttggtcaaaaaatatttaaatgggaattccatctaaaataaataattaaatttatcaaatttaattgattgattgtttttgtttgatgatgttcttgtaacagctgattagtgctttttacatatgaaacataaaaattttagctttttcattaattaactaacaattcgaattcgttttcaacaatttatttgcaatggtcactcaaatccgttcatt

SEQ ID NO: 33849 - DNA, 1457 bp, Heterodera glycines
  misc_feature (1200)..(1200): n is a, c, g, or t
  misc_feature (1276)..(1276): n is a, c, g, or t
  misc_feature (1286)..(1286): n is a, c, g, or t
  misc_feature (1296)..(1296): n is a, c, g, or t
  misc_feature (1324)..(1324): n is a, c, g, or t
  misc_feature (1344)..(1344): n is a, c, g, or t
  misc_feature (1375)..(1375): n is a, c, g, or t
  misc_feature (1387)..(1387): n is a, c, g, or t
  misc_feature (1395)..(1396): n is a, c, g, or t
aatttattttactaaccacactaggaatattgatttttaattaccctaattaagcaacctgttcaaccacaacaacaacatgcactcattggaatgttttcaagtcactttcgctggtaatttttgggcacattggcggctttcttctgatgtatgtcttcggcatttttgtgatgccaattttaatgcaaaattcactaattatgacttggtacggcgtcatattttgtgtggttccgttgaatatcagttccatttcaattgcacctcttttgttttttactaggtaaaatcgcataaaaataaattttaatatttggaatttaattattcttataatgaaaaataatttttttttttttttgaattaaaagaaataattaattagttaaaaattgatgatagacagaaatgttgttaataatttttctttaaacaataattagttttaaattaaaataatcaactaaaaaaattaaaaggccttatcaatttatttaattactttattttattaattataatattaaaatgccaatttttagcactgaatatcacaatgcttttacaaaagaatgggcacgattacgtgctttgttcgtcgggcttcaaccgtcaaacacaatttttgcaacaactgtacaacctttgcagccgatgataatgaaaatgaacaatcaaaatcaatcgccaactcggattgacaattttttaccaaataattaaaaatcatttagcataaatagggctaaatgtatgataatatatataattatattttgtaatcattaatgaaatgaaacatataaatatacaatttcttctttaaatacttcagacttgatgagattttctaaatgtgttgatgagttattttaaaaagcgataagacgaaaatatcatatttatttatttataacaatttgtggtttttcaataattggtttaagccaataaatattttataaatttgtcaaaaattgaaattggatcattgagggcatgtgcatttgctttcatcaattccataatctttgcagcactgaacaatgcgagaaggcgaaggtgcaatccaactcaattgactaaataaaaaatatgaaattatattaaaatacaaaatattaattagaaatataaaaaattcgaaaaatctgtaggttaccaagcttttccgttggcattcctcaaatccgccangccttttttggcacagagtttgcaaacgcttaaaaatttaaaaatataattatattttcaaaaagatatattttanaatgccttcntttttgatgngaaagcagaagatagaaaaaggcaatanagaaaataggcgcatattanatattctttttaatatattaaataatttatntttatgatgaantattattnntgtaaaagttttgccttttaaagaattaattacactttgtgaaataaattttttcatcatt

SEQ ID NO: 33850 - DNA, 926 bp, Heterodera glycines
  misc_feature (53)..(53): n is a, c, g, or t
tgaacgcccgactttggtacttcactaaactgaagaaatcttataaggagagnagaaaaatagggaagaagatgattatttctaagttgacatataatcagcatttcaaggaatttaaaagccatcgttttgattcttaaattctttttaaaatagggaaaaatgcatggcagacccttcattttcagaatcaaccgtttgcataattctgttttttaaaatgctgaatgcctcccaacaatttttgtcctccatatccatcgagcgcatttgagaagcccaccgcagcaacacaggataaagaatagagcaagtgtttatcacctgatcatataaatatttaaatgctgaaaaataatagtgacacttttttctgcacgataactccgctcgactggtcaaccattgcccaatttaaagtcgctatcgctcttttgaacacttccgtgtcttttttgctaaatttcactttaatcaattaattaattattttacagttaagcaaaacttaccaagccttttcaataaaagaaatcacaaagcaacggactttctgttctcgttcatggataaattgtaccatctcgtcaaggaaattgtcaagaatagaagtcccatcttgtttcagaattaattcctccgctttggccaagtggataagcctttcatccaacggttttcccgacacttgtaaaccctcattaatttcacgaccaatctgttaattcgggaattttcaaaatatcaataatttgaaaaactcacttcatcatatgctaaatttcctgttccaatgtcatccatctcatagaacaaagctgaatggagaaatcataaaaaaagaaaagaagaaagacgaaaagaatttgaaaattcaagatttttgatttcaattttcgaaatagcattttggtcaaatcagttta

SEQ ID NO: 33851 - DNA, 1513 bp, Heterodera glycines
  misc_feature (502)..(502): n is a, c, g, or t
aagcgggggaagagaagacggcaccgatgccgaccttccgaaaggcacctcaaaaggggggagacaaagatacgacgaagaggaagaaaatagtgggagagacgaaagacggagagagctcaaggacgagtgataaggctgaagggagagagacagagggagataaacacaagcaggaaaaagagggaggaaacgaattgaaagagagaggtacagaaaacagagagaaacgagacagtgttgaaaagagtgacggtgatcagaatcagcagactgagagggaaaatgctgatcagcagaacacagagacgacgaagcagcagcaaaagggaaaagagagtgtggcaaaaggggagaacaaagaaggcagagacagcgagacagaaaaagtagacgaaaaacaaaagcaaacgccgaataaaccatcgacggtgagggatttgatgggcttaaacaattgaaaaacgaagtcatttaaactccgatttttaatcatttcaanatttggtttcagttctccgatcagaacaacggacaaaatttgttactaaatgaaattgcgacaacaacaaccgaagggcaacagaatgaagaacaaatgccaacaatgccatcgatgggaaagaagcagcagaagacgaccaaatcaaaagcaaaaacggaaacggaaacaatggcagaaaaaacgaacggaaaaagcggacattcgaagtcgaaaccgcaacagaaaaagacgacaccgacggcatattattcatccacggcatcggcacaggcacagtaccattatcagccgaacaacaataatcagcaacaacagcaattccaacaccggccagcatttgtcctccatcgttgtgcctccggcgatgggcggcggagtgtcgtcgccatttggcccatccaaattcccttcgcttcagcaatggttgctgcgtatgcgccatttttgcagaattttatgcagaacggtggtgcggcaacaacttccgcttatgcggacgcatccggtacaatttttgcactgctccaacaacagaggcaactgccgacgccgcagcaccagcagcacaaaattggccaaatgtttgtcggcaaaatgatgggaatggcatcggccgctgccgcaaatgccaggcaggcggagggaaagtgccgacgacgacgacagccgcaaaaagcaccagcaacggcgtaagtaacagcaacgaatggcactagcggcagagggatcagtggggggggggacggagcggaaacgggggggggcgacaatccggagaattttaattgtagaaaagcgatgccatttcatttagcttaaaagttaaaaatgctaaagaaatttgctgaggttgagtcccagtgattgaatgctggagggttgagtcccggcgattggaatgttggtggattgagtcccgttgattggaatgttggtggattgagtcccgttgattggaatgttggtggattgagtccccactgattgaaatgctggtggattgagtcc

SEQ ID NO: 33852 - DNA, 918 bp, Heterodera glycines
ttcgacatattacatatgtacatattttttatacatattttggactttttcgcaatttttcgtacatattttacaatttttgagaattttttaaggaaatttttattaaatgcccccccccccccaaagtctaaaatttcgcaattggcacatattttgcgcatttttgaaaattaaaaatgggttatttttattgcattttatgcctatttcaccctttacgaggaattttttccaaaaaataaccgttaaaaaaattttatttacatattttcgtacatatttgggagtttttgcacatatttcatacatattttagcattttttatacatattctatttacatatttcgcgatttttcttacataaaaatggaatccctgctaattaagcttttgcaaaataatatatattacatacatatacaaacaacaatatgcaaatcggcgcagtcgcaggtcatccacaggcaactcatacacagtaactcatccacatttctcacggataaaattaaaattaatgggttcaaatcagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagcgaaattttttctacaactttttaatagttaaaatcataaagcaaaaatcattttttaaaattttattccaaatttaaaaatcaataaaacgcttttttgaggcgcactttttccaaaaaaactttttggaaagagggggcaggcggcgccggcaggcgccgccgggataatttttgaaaatatgattaagatccgtcgacagattttcactaaaaaatgaaccaatttttgtgatttttatcatt

SEQ ID NO: 33853 - DNA, 995 bp, Heterodera glycines
tggcagggtcaaaaatggggcaaatcagcaggcagcggtaggaagaacgcaacccgaccccgccggttttgaaagcggcaggtggcaggcactcggcacaacagtcgagtttttcgcttttttcggtttgcggaagagaatttaatgggacggaagtggcgagcattcctatgaaaacaaaaatgtatgtaaaaaaggcataataagaataattaacagaggggtaagaacagaaaataaagaaaaaaaaacaaaaaaagggggaaagaaattgattcaaatgatttcggcatcgctggacgacgacgatgaatggccaatcacagaaacattgtcatcggtttggtaaatgaaattatggcgctgttgcaggaagagaaatgactgataatcggggaaagtttctgatggaaagtcactgctcggaaagccgaaattcagcggagaaagggaagagttgtcgactaaaagacgccatttatttgcgaatttggaagagggaaaaggaaaaaaatgggaggacaaaacggacagacagtgaaaaagacaaattgaaaaaacaaagcatggccaagggaagcgaaatgtactgaaaaagactaaagggagcccacagaatgcccttttaatccgttttcagctcgcaaacaaatgcgaattgaattgataagccaaaaaaaaagtgaaccaaccgtaagggtcggtgatggaaaagccacagattgtttcgatctccgtccatctttgaatgcattcgtccaacgcaatttttatcttctccattcgtgctcttaaaattatgaaatgtctcgttttttagcatggaatgtaaaaaaggagcggggcgggcttacaattagcaattaaaattcaacgacgtacaaaaacatcgtttttacacacaattaaaaagactaaaaattaaccattcaataagtaaaaactttgtttagattttaaattcaggccgtgaattttctccccccccccctttc

SEQ ID NO: 33854 - DNA, 731 bp, Heterodera glycines
agaggagagagaatgggaggagagagagaggagagagatctttaggagagagagaggagagagaacgggaggagagaaagaggagagagaacgggaggagagagagggggcgataaagagagagaaagagaacggaggggagagagagagagagaaagagagagaaagggaggagagagagaggagagagaacgggaggagagagagaggagagagaacgggaggagagagagggggcgataaagagagagaaagagaacggaggggagagagagagagaaagagagagaaagggaggagagagagaggagagagaacgggaggagagagagggggcgataaagagagagaaagagaacggaggggagagagagagagagaaagagagagaaagggaggagagagagaggagagagaacgggaggagagagagaggagagagaacgggaggagagagagaggagagagaacgggaggagagagagggggcgataaagagagagaaagagaacggaggggagagagagagagagaaagaaagagaaagggaggagagagagaggagagagaacgggaggagagagagaggagagagaacgggaggagagagagggggcgataaagagagagaaagagaacggaggggagagagagagagagaaagagagagaaagggaggagagagagaggagagagaacgggaggagagagagaggagagagaacgggagg

SEQ ID NO: 33855 - DNA, 961 bp, Heterodera glycines
tgaaataatagcaaatcatcaccttctttttccgctaaccccttggccaaccctttccccgttttattttccttggccaatcgttgggccaatgcttcttccacatttccttcctttcccccgtttttctcccctcccccggtcattatttcgtcatttcgttttctcttcccattattcacacgtcgacagcattcggcggttgaaattggaggtcaatgggctgccgacggtcataaaaaatgggcgcctgcaacaaaatccaagcggtgccgcaaaagcagcaaagagcaaacagaacgaggaacaaacggtccaaaacactgaaagggaaaatgggaaggaaaaagggacaaaaaggaagaaaaagggaaaaaatgtaaatgatggaacagcaaaacatatggaaaaaacagcagtcgaatcgggcaaatgaatgggccgcaaaagcaccgacggaccgactgacctggccacgtatttccagtcctgggccaccttttggtcgcggtcctttcgccgcagcaattccgccacaaaacaaacgttttcaaaagccttctccacttttgggcacctttcaaatgcaaaggaatggcatttaaaccaatgaaaagagagggagaataaaactgttgcgattggacagtgttaagccaaaagaaaaacagaaaaagtgaagtccgctttttgtcggatttaaatacgattattctccattcgaaatggaagtgagtgccattccccccgttctcttcaccggtaaagccttctcagccgctcgtccaacggcggacggcacatggcctccagcggagaatgacgaagcacgcgaattgggcccagcgaatggtccaaccgttggtgaagctgagcgactggggaggaaaagcaaccgaaaatgaccgaccaatccaagccattttaattttaattttgcacccgttcgattctctctttt

SEQ ID NO: 33856 - DNA, 939 bp, Heterodera glycines
  misc_feature (877)..(877): n is a, c, g, or t
ataataaaatttaatattaaaatcttgatttttagcactccccctcgaaaattctcaaaacaaaattaattttaaaagaaccttattgacttttgccaataaaattttttttttttttaattaaaattaatccaaaataaattttaccaacaaaataaatttatttaaaaatattattttcattttaaaatatatatatttaaaaaaaacaatacattccacagaagaacaggccaacagtggtgaaaaatgccgcgatggaaagacagttgatgaaggtgaattcgccgtggaatgcgtcaaacatttttgcaaattattttatattttttgccgtcaaattttggatgtcaaaaatggtcaaaaaattctgctcgtgccgaagtggccgcggtcagtcgtgaggacggtgagattgaaaaagttgtgcgttgtacggctgagtactgctcggcacacactttttggtcgcgagttgcgaacaccgaacacactgtcggaggctgactgtgtctggaaaattcaggcaaattttaactggggtaaatttttgaaaatttacaatacagtaaaattaatttgaaatagggatgaagtggatgaaaagcaattaatccaaaataaaagccaaatttctaaagcgcgatgcaattaaacaccgtttcattttcctcggcacatttgaaaaaggattaattcaagttttgcaacttttttgttgtgggtaatgaagaatttatttgatttaataggacataaatttggagtaataacgtgatctgattgcacattgataccagcaaaaaacgttgggggaaagggtcgaaaaagaaatgaaccaaaattatagtcgagattcgagaccggatttgagtgnggttaataatttagaaggagaccagtttagcccagaacaaatcgaaattgctttgatcggat

SEQ ID NO: 33857 - DNA, 724 bp, Heterodera glycines
atattatgaaatctctgtccagctttgaatgaattttctgaatttttattggcgctaaaattactataggatttgctattaaaaatgattatacacttaaaaattcatttttatgttagcaatatttatatattttgctaaaaattgtaacggaaattgaggatggaatttcgtcctctgtggcatcaaacattcattgcgaaatgctcaaaaatttaaaaataatttcaaatgaattttgcctatctgtttacccgagtaaataataaaatttctttagcatattattcaaagcttttttgtaaggttttctttttgttctgcggttgtttggcttagaaaatgtaggaggtgaatagagattaattaattaaattttcatcacagttatttgaagctgttggatatacgttaatattatgaaatctctgtccagctttgaatgaattttctgaatttttattggcgttaaaattactataggatttgttattaaaaatgattatacacttaaaaattcatttttatgatagcaatatttatatattttgctaaaaatttgtacgtgaaattaaggatggaatttcgtccctctgtgtgcattcaacattcattgcgaaatggtcaaaaatttaaaaaatattttccaatgaattttttgcctatctggttaccccgataaataaataaaatttcctttagaatattatttcaaagctttttt

SEQ ID NO: 33858 - DNA, 1419 bp, Heterodera glycines
ggttggtgagtgaatcaatcaatttgtgtaatcatatcgtgcttttgatgtgtccatgtcgagcagttttggtggacggcggttacgattcgaccgtctgacttcgttctgattgtgctcgtccgggaccggttgctcttcaggttgttcgtccgcgaaacgcacgtgacgctgaggagtgttcggttctgtcgcgggttcttggtgaacaatttgaagatgttgctgctgatgatgtgaaccttgagactgttggggaattaggaaaaaagtgacgcatttgattggtatgtctacgcacaacggcgtttaagattggaacatgaactttccaaaccacacctgatccttcaacaactttaccatgtaaccacgttgttttgttgttccgataattgattatcagaacgtcgtctccaatcgcgaaagttcgacggcgaactccattttggcgattgaactgttttgccatgttgttggcgtagtctttggtgccgtttgttgggtgtgaaacagttggtttcagcaaggaaagttctgtgcgtggaggacggccaagaaaaagttcggcaggaatgcgaccattcaaagcgatgtttggcgtgttgcgataggcaaacaaggaattggtgacccattgtttgtccttgcctgcaccctttttcatctcctttttgaaaatgtccacaaatcgttcggcttgtccattgctcttcgggtgataaggcggacaaaaactttgctttattcccttggtcctgcaaaaatgggaaaaagcatttgaatgaaaaggtgggccattatcggtcacgatttcacatggaaaaccgtatcgcgaaaatagccattccaattggacaatgacgttgtcggcggttgtgctcttgactgagaatatttctggccatttgctaaaagcatccacgacaattagatagagacgtccatcggaacatggtccggcaaaatccatgtgtagacgctcatacactttgtttgtggaaggccatggacgaagcggcgcttttggcggtgcttttgctgcaagtgcacattcgtcacagtttcggacgcacctgtcaatgtcgaggtccatgcgtggccagtacacgtgtcgctgtgcaagtgccttcatccgaacaatgccaggatgagtgaaatggagcgcggacaggatacgttggcgcaattctgccgggatgatgacgcgctctccaaacataagacatccattgacttccgagagtttgtaccgatgtgtgaaataagctgccaattttggggtaatttctttggccaaccattttgacaaaattcggaaacttccctgagagtttcgtcgagttgcttttgttcggcaacttctttggtggtgacaagagagttgatcaattgttgccatgaacacatattcgacag

SEQ ID NO: 33859 - DNA, 348 bp, Heterodera glycines
tacgactcactagtgggggcccgtgcaattgaagccggctggcgccaagcttctctgcaggatatctaggatccacgaattcgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgaccctctagtcaaggccttaagtgagtcgtatta

SEQ ID NO: 33860 - DNA, 744 bp, Heterodera glycines
  misc_feature (654)..(654): n is a, c, g, or t
  misc_feature (665)..(665): n is a, c, g, or t
ttgaaaaaatcaataaattgcttgggaacatctaaaaatttctaatttacaataataatttgtttttaaatatatttaatcattttttgaaaacttgaaaaaatagtcacttgaaataataaattctaaaattttgtccaggaaaatccaggttttttcctgttttgcctggacctggatttttttcacatttgacctggacctagatttcctggacaaaaatccaggtttccgaaaaatggcctggacctaggaaaaatccaggcctggatccaggtccaggccgatctctaatttttagtttcaacttttgtggtcaatttgccaagaagagttgaccatcgacgccgaattggagaagacacgcaaacaattggtggaaatgcgcaaaaatttcgacgctttggccaaagcgataaaagtgaaggaaaaaacggagggaatggtaaaaaaaggaagtgggaaatgaaggaatgaaagtcgtaatttaagcaagaaatgcgaaaaaagaacatcgacgaacggaagaaacatttgctgacggggacgggcattggcgaagaccaaatgaagaaggcgaagcgggagacggacgaagcgacggcggaatcacaataagcactttgaccacactgataaacccccacaaaccantttcaatgttncaatgcttctccctcttttcgttgtttggttttttatcttttcattttattcatttgcctccctttttgatgttttttt

SEQ ID NO: 33861 - DNA, 670 bp, Heterodera glycines
agaccatataattagaagtgtcaccggtggactcagaaataatgtcaattttggtgccatcataagacttaaaaaaagaaaaacaattgccaaaagttataacaattatcagatttacccatgaagcgaatttcatcagacaattttggaaatcgaaagggtaaaaacggacatcttcaaaacgaagtgggaattgggcacaaattttgaacagattgtcctttttaccgagttcgcaactgcttttgaaaatgccggctatggaaagactctgcaaaattaaaaattgaccattttatttgcctcttttgtctttacaatatttccgtcgtaattaagcttgcgtggtaaatttcttttacccatagaacaaaaaagaatatattaaaagctataaaatgaattttattgaaaaaatcggatgtataacctaaaaaaatatttgatacgttcgatgcagaatttttttctctatcgatatgcaaaatttggtgtgtatttaacgtgcaggaaaaaagttaaacgtcacgaagtgaatgttgtttttcctaataatgaaaatattagatagtacgccaaaaggagacaaaaaattagagaaaaaagataatgtttttctctggcattctctatttattggtacacatctcgttttttgggatggtgtgta

SEQ ID NO: 33862 - DNA, 912 bp, Heterodera glycines
tttcagcaattagcacttcaattagtgtttgtgttccacctgcaccaccaaaacgggcacgccgcactgaacgtaagcgaccaattcgagcagcgaaacgagcgaagcgccgcaaaacagcacaaccggaaggggttgccgctcggtggacggcgccgaaggcagcaaaatgggactgatcggagcagagagtggcgtttgaggggcggcggacaaacccgcggaggacacgcgttcctcaggaacgccgatcagaaaggctattgaggaggggcgggggaggggggagatcagagagaacagcttgaatggggctttgctttgttgttttgctttgatcagtcattccctcagtgtttttcggcttttcctttgtattccctccgttttcgctccctttttggcacctggcggcggatttgccaatttaattgctgttgctgtgcggaacaacagcatttgttcttcgggcggttcatttctgctccacagcacataaaatgtgttcagacgcgcgtcggtcatcgacggagacggccgaacgacggcggcggaagggaccaacaaaggggcggcatttgagatggaatggcgctgaaagggaaggcatgccaaaatgggagtggaattggacacggaacagaatcactgaccacgtcgacggagttgaccacgatcagaagagtctcctctggggaatcggactgaaatttaggtttaaagagcgtgggggtaaagacggacaaaaaaggaaaagcatcggggaatggggaaaagagtgatcagtcagtcgtgatcaaagggcgaaagagaggagacggagaagaaagagaggagaggagaggggagatagattatgtaagtgacaactgatcttagataaaagtcagatgattttcaaaatctgagctc

SEQ ID NO: 33863 - DNA, 1042 bp, Heterodera glycines
taataatttttaaattgaaatattttttattaattaccttttcaattgaaaaataatttaaagaaattatttaaaaaattctgtaccgttggggaattgaacccaagagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatctttaggggtgtattttcaactctcgcctctcgtcccaaaaaacgagaggcgagagacgagaggcgagagtaccaaaaatggcgagagttggcgagaggcgagagacgagaggcgagagttgtcccacccctgatatatatattattttcacgtttggaaaagttctttgataagttagagcagactttggatcagctaagatcatattaataggatcgtgatttcgaaagattatgaaaaaataggaaaataacagttttgagccaaagaatttgcaaaaaaaaagtaaatattcaaagtttagcagaaaaagaaagtttcattattttaacaataattaatttgaacatatttattgattaaaagcagggctcccagatgtgaggctttagcctcattttgtggttttttgataggtcaatgaggctaaattttcaaaatgaggatttgaggctttttgtggttttttgagaaattttgaaaatttttgaggtttttggggaaaattcgtaagattttttaaattttgatttttttgataagttggcataatgtttgacaattatttagtaatttgggtttttaatagagcatcaaaacgaaaatagaaccaattttttccaataaaaaccaaaaattaagaatattttcaatgaaaatctgctaaaaatatgtacaaattctcaatttttccactggcggcgcctaaaagtcctttattttcttaaaaattgctcaaaatcacaaaatttggccatttttgtggacaaatcttaaca

SEQ ID NO: 33864 - DNA, 301 bp, Heterodera glycines
aaaatgattgctttctccctttagtgaactgatgacgagtatgctatgtcccaaactgcgctcgttccgcccccacgtctacagcccagtccctacggtcacgtcgactgctctctctttggtttagcttttccttccgctccccctttaggcgcgtgttcatccgccgcccttcttcccctcctcttctatgccccctttcgtttgtcccactccgtcccaaaggcttccgtttgcttccgccaccctcggccgtttgcctccgtccgcttccgcgcccctccaacgacggcatttgttt

SEQ ID NO: 33865 - DNA, 69 bp, Heterodera glycines
aattaaatccatcagtgtgttcattaagttacataatcagagagtaggacagtgaaaatgcgacctgca

SEQ ID NO: 33866 - DNA, 956 bp, Heterodera glycines
taaataaaatacaaccaaataattaaatttgagatgggacaacttaacagaggacaaactcaaaagactttgatcagttcgatgatcggagaaagtcatccacgcggaaagtttggggtgaaaagttacggaaggggcgaagagaggcgggagaccgctaataagaggtcattcatgcgggaaagagggcgaggggggggggggcaatgttttgggagtaattggaaagactttggaaagtccgatcaggaatattatttggatattttggtattatggaaaaggcaaacaaaaaggagaaaaaaggggacggaaagtgatcagagaaagaattgcactgaaagtgatcagcagacccttaaaagaaagagcgtccggaccacataaaagtgtctgccatacatacaatttctaacccggttttagttttatttctctcgctttcctctctttctctatgttttcattatctctttctatctctatttttatatatatttttttaatgactgattaatgatgtgaaaaaattatggagtgtcaatgaaattgaaaatagaaagggtgagaaggaggacgcatcggtggccgtctgctgaatgacgccccggggaatttaaaaaaaatggtttaaatgagaaaagaaaaggcaccgcaaacgacggaaggagaaacgtttaacatttttaacggttaattgaaaaaataaatacgaaaaaacaaatcactgtaagagggaggaaatgagtcaatcggcggcaaaagtgtacgctgttggggaaaaggggaaatagtgatcgagtgatcggttagcgtaacagggaaagtcgaatgcattcccgaactcactcactctcgaagcaattcaattcaatatggtattgattattacgtttttcaacaaacataaacagaaggggttaatggaaaacaattagctttcccccaatgaattt

SEQ ID NO: 33867 - DNA, 1019 bp, Heterodera glycines
  misc_feature (27)..(27): n is a, c, g, or t
  misc_feature (43)..(43): n is a, c, g, or t
  misc_feature (46)..(46): n is a, c, g, or t
  misc_feature (52)..(52): n is a, c, g, or t
  misc_feature (57)..(57): n is a, c, g, or t
  misc_feature (60)..(60): n is a, c, g, or t
  misc_feature (66)..(66): n is a, c, g, or t
ttggcaaaatgatcaaaatgaataaanttcggagatcaaaatngcnaatgancagancancgaccnaattcaatgataaacaaaaatgtgaaattgttcataaatttgacgcaataaaagaaggaattaagaaaagaggaaaatattcggcaaaaggccgtggtaaaattgagcaaaagattggcgtaaaattgggaattaatcgactgaaaatttacaaatggaaaaaagaatttgggttaaatttaaaaaaagataaacattattatgaaaagaaaaagcaggaatttgttgaaagaattgaagaattcaaaagaatgtacaaaaatggaaaacagaaacaatttgcgaaagaattgggcattcacaaagaaacatttattaaatggaaaaagaaatttggcattgaaattggcaaaagtaattttaatttaatttttaattttaattttaaatatttcaggatattctaatgaagaaaaaatgaacaaaatgtatgaatatttgaaaatgaagaaagcaaatccgtctttgagtgataaagaaattgccgaatttttgaaaatcactcaacgcaccctaatacgatggaaacaaatatttgtataatttttttttattttttgatattagcatatggattattgttttgttttatttgtttttctccttttatgtgtcgtctttttcctttttaattgtcttcttaaagcattcgataatgttatttctgaattttataattttgtgccgaccggtaaccataaattcggttttggtttttgttaacgatcagacaaattttccattttttttttattttggaggagaactgaactaggattgctattttagcatattgtctttaacaaatttttggaaaattcagtccttaatattataaaaattcccaacagctctccgttaagaaatctgtgtcgcggatcgaggtaaaattcattttttatttatgctttcaataaaactgaacgaatatttttaataatttaaatcaggaa

SEQ ID NO: 33868 - DNA, 945 bp, Heterodera glycines
tgctggaacgtcgtcttcgattgctggcacttcgacacatccgaaacaccaacatcgtggacatggatctcaaataaccggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaactcgtggacatggatctcaaacaaccggcacggcatctgcttctaagcgtatgtttgatgcaccaaatttctatttgatcattcaccattcgtttttaaggacgccgtggcactgtgcgcactgctggaacgtcgtcttccattgctggcacttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaatatcgtggacatggatctcaaacaaccggcacggcatctgcttctaagcgtatgtttgatgtaccaaatttctatttgatcattcaccattcgtttttaaagacgccgtggcactgtgcgcactgctgggacgtcgtcttccattgctggcacttcgacacatccgaaacaccaacatcgtggacatggatctc

SEQ ID NO: 33869 - DNA, 895 bp, Heterodera glycines
  misc_feature (879)..(879): n is a, c, g, or t
tctaactggtatttaattgtatgaaagtttttgtttggggaatcgcgtgaaaaaggaaaaataatattttatattataaatgaaatcactagttttatgaaatttacaaatttgagtcaataaaatatgacatttttcaaagaaaataaaaaagtcaattagcgacaaacggacaaatggccaactttgtttttttacgcactaataacgaaaataaaacccagattaagcccgaaagcacaagcaataaatcaaacgcatcaataaaagacaatgaaagggccgcttgatcggtgctgaaaagtgcggcaatccaaaggagtcaattattttgggatggacagtcgaactttttggctaatattgattatgtaaaaagcaaaaaaaaagaagaaaacagcaaataccaaattaaatacgaattgaaatttcatatggacaaagtgaaaaaaatatgtgctgagtcgatccaaaaaaaaaaactcagtgattgataaaataataaatttaattatataaatcggtgtcaatgaattgatttatatgattaatatttaaatataaattcaaaaagaataatataaattcgcatttttgttcaaaatttttagcacaactatcttttgtcatccatggacggaaaatggaaaaaagggtatgcttacagcattccatctccgatcaaaaaaaatattaccgatacgaaaaatttcaatcacctctttttgcagtcaacaagttcatttgtataagggattatatttttaagatccattatccatgaaaaatccgctggttaggccttaataagccgtataaaccatgttttattcaattccctaattttaccggttcaagaataacctcgaagtaaataanaatttttattcatttc

SEQ ID NO: 33870 - DNA, 896 bp, Heterodera glycines
  misc_feature (886)..(886): n is a, c, g, or t
agaaaatgctctgaaacgcaccaaattttatttacatgctattttaggcactctgatgctttttctatcaaaaagggagatgaataaattttaaaaaatttttaattcctttttaaacaggccaaaaagtttaggcttaacttttttttcagaaactgatcagaagcgcaccaaacttagcagggatactgaaaggaagagaaataacctattttaaatattatctagtcagttcatttaaataatttttatccaaaaaaaatttttttttggatttcggggcagtaccctgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcacaaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgngtgataaatg

SEQ ID NO: 33871 - DNA, 1012 bp, Heterodera glycines
tttcacacttagaaaattatcaaaaaaaaaatcataaaatttttgaaagaaaattcaaaaaaaaagataaataaataaatctcgtaaaattccctcaccgttggtgtaaaaagaaacatttaccataaaaacttttgtttttttcacatgctaagtccccccacctcagaatcgttgtgatgccatccgccggggaaatattttttgaaaagcgccggaggcacaaagtcgtccaaaagactgtctaaaaatgagtttttattacccagtggtaatcatgggcaatccaagcacataatgttaaagttagccaccgattttgtgctgcttccgccacagcaacgagttcagcgtctaaaatgatttgaagcattgaaaaaggcataagtgaaattatacaaaatcgaaaaagtggaaagccaaaagttggcatttgtatgagattttacggcacggtctattcaacattaagcgtttttaccagttgcgtggccttttgcacgtcgaagtcgcgggcgcgcagaaaacgcagcaaatgcgcgtcgttcggcattttgcccttgtgcatgctttgcagaccgtacttcagttcgcacagccgactctcctgggaaaggtattttcagttttaggcactggtggaaaagcgcacacaaaaaaccacacaatggcattggggaaaaaagagatgagaaaaatggcaacaaatttagtgattagattgggcaactaaaaaaaatctccccgatttatggccataattggttttagcatgcaaatggagaatatttagaggaatcgaatgatccaaggttttcaaaaattatacacttttaaaatttaaaaatgtgacgtcagagctatgatatggcggaaattgaaataggccctcctggttaatggcccggttactgtaccaattgtcaatgaatgtaccattgttactgtacctcgagcggtgtcagttggcccgaaaaaggcgttggatgtactcactttccagcttcgactc

SEQ ID NO: 33872 - DNA, 262 bp, Heterodera glycines
cctcctcatcgtccggtgtccgttgatgttttgctgttttcattggtggtgggggtgtagaaggaaaaagacacctttatcaccacaagggtcacttgtcggacgatgtctttggagaattctgagaaatttatggccatagattttcttagtgataattattatttcaactggtttttgatagtgattagctcgactgataaatagagacgctcattttattgacacatctgaataaatatatactttcaatactgtaaaa

SEQ ID NO: 33873 - DNA, 1009 bp, Heterodera glycines
tgggttgagtcccagtgattgaaatgctggtgggttctttcccagtgattgaaatgttggtgggttgagtgccagtgattagcatgctgttgggttgagtgccagtgattgaaatgctggtgggttgagtcctggtgattgaaatgctggtgggctgagtcccagtgattgaaatgctgttgggttgagtcccagtgattgaaatgctggtgggttgagtcccagtgattgaaatgcatgagaattgagtgccagtgattggaatgctggtgggttgaataccagtgattgaaatgctgttgggttgagtcccagtgattgaaatgctggcgggttgagtcccagtgattgaaatgctggtgggttgagtcccagtgattgaaatgctgttgggttgagtcccactgattgaaatgttggtgctatgagtcccagtgattgaattttggtggtttgattcccagtgattgaaatgcaggataattgattgccagtgattgcaatgctgtggtctgagtttctgtgattgaaatggtggtgctctgagtcccagcgttttcactgctgattaccccaattttaatattgtgcaccgcttttttcctttgtgtctttttacgtcatcatgttgcgttgagtgcaaccgcctccgacgatgatgagcagaggaacgccgagtgacttgacgatacggacacattccctgatggaatgaatgtggaagagtattccaaggcaaattgtgcagatggtttggccatagactttttctcaaccactctctcctttctctctctctctcccccttttgtgccattctacacatacccgaggccgtcaaagctgaggttaaaacagacaagccgatcggagcccaacgaatcagcgccacattggagaacaatcaccgaacgattgaatttgtccacgacggtctgtatgacgggcttaaaactgaaaatgccaattttacaaattgccaattttgataaataaatttgccattacc

SEQ ID NO: 33874 - DNA, 1825 bp, Heterodera glycines
  misc_feature (88)..(88): n is a, c, g, or t
  misc_feature (302)..(302): n is a, c, g, or t
cccgtgccatgtcccaattcattcgatgggagctgaacctgaccgaacttgtccgacgaatgaatctgattggatacggacgggacgnaatcatgctgatcactttgcactcggctgatcagctgaacgcgccgggcggcttacgcagacatgcttcaggcagaagaatggcagagacacccgtttccttgaccaggtaaaattgtaattctcgtggcttttaccataatcttgacctataatctattggccaaaccctaaaaagtatggcaaatactcaaataatgttggaccgactccanaaatggcacagacagaaaaaatatggcattctccccatataaatgtgtattagtgccatactctgctgagcgggttctacaaatattttacattttccacctcttttggcacagggaggctttatgggctccgcacgcgttttgcccctcgcacaaatggcggcacgccgtttgcatttttggcgtcgaagacttggcccgactcgtcaaattcccgcaccttttcttcaataaattttggcccgccttcgattttggcgctttgttgtgtgtgtacgaacggttgttcaacatgacccatttgcacacctgcggggaacagttggccaaaatggcaccggtggtgaacaaatcgtttgtccaacaactgcccaatgtccgttggtttggtgttggaaaaaagagtgaaatacgaaaaaagggaaaaaatttctttaaaattttccaatatattttttccttaaaacacttttaaaaaattgaggacccccaaaaaaagataaattttagaaataagaataatacgaacgatgaaaaagaaaaattatttatttaaaaaataaaatggggaaaaattctaaacatttttttttaattttaaaaatttttcttatttaggtgcgatttcaacaattcaagaaggaaatattgtgtgaacgaagtaaagtgcagataatttctgatgaccaattgacatttaatgagacaatgagctttaattgtgatggtgaatgaggagccgaaaaagaagaatattttttaaagtttattataattttatttatttgtaaaaatatatttattttcattttattagtaacatcgagattagtttaacagcctgtctaattattaagaagatcgctcaaacagttatttttaagaattcctatcaaaatattccaaaaaaaaaaactatttttatgaataggaaatacatattgcaaattgtaaatttaaattatgaccaaattcttggaaatcatgggcacgaaaaatggagattgtatgccatggattttgcaatatttcataagttgcgtgatcataagtttatttggtagtgtttttaacaattatgtgccgattttttgcactctgctcgtgatggtaaaactcaccttttaaatcaaacagatcgccattcaaattcgacatccgccttctccgtccgtcatacagttgtaccatcacaattctttacgtatttctcctcacaacaataatagcagctgcacttcgttttcattacgcaatgcttgccgaaatacaaattggcacgccgcaaagttttgattgccggggccgcatttggcatttgcaataaatatttcccaaattatttttttaaattcccatcagcaggtcttaatttcatattactttcaaataaacttaaatgagcaacgttggcatcatatgaaagcaacagtgtcacgacgttagtaaaaaaaccatcaaattgaaaattttgtggttttttgcctaaagtcacagcaccaaatcaactatatactgtatgt

SEQ ID NO: 33875 - DNA, 677 bp, Heterodera glycines
ttgccacattcatgctgagctttcgaaaattcgttgccaagtttggctccccgtccagtgtttattgcgacaatgcgcctacatttcacgcatttgccaaattttcccaatctcattttccccttaaatggcaattccgaaccccagcagccgcgtggaaaggcggacactacgaaaggctggtggcccttattaaataccacctccgaagagtcctttccggccaccgccctcgtgtgctcacaagggaacaattgggcacaataatttcagaaatcgaaacagttattaactcccgcccgataacatttgactcatctaatccagcggatccccgcccactccggacaatatactttcttcacccacttggccaccattcccaaatttatccgttactatatcgtccaaaatacagcgccaagaattttccacctctatcatgcattcaattttgtgcgattgtacattcgcgtttgcttaccttgacgacatgatcagtgaccagtcgatcacatgaggagcatcgaaaacactaaagaagttttcaagcgaatcggaaattttggattcctgatcaaacccgagaagtgctctttcaatcagaagaagaccaaataccttgggatacgtcatagaaaaaaacaggaaggcgaccggatccatcgatagattaa

SEQ ID NO: 33876 - DNA, 1813 bp, Heterodera glycines
ctccgcacctcagctcaaagtcctgctgagcgccaagcacgtgcattgatgtgctggtcacctccacccccatcaatgacatatgtgcgcgttcgtttcgtcaccgttgcgcgatggggcgacttgcgcagctgcggaggcgccggctgaaagtcttcagcagacggatggggtcgcttttgctttagcgggtgttgttgttgctgtttttggtacggaggccgtacaacagccgcagcagctgttggcgggagagattgctgttgttgttgagctaaattttaaaagggggttatgaaattttgtacctttgaaacctaagcccgtgaatttttaacagattttgtcattagaaaccaaacacgcgtcagcgacggtcacaggatttgggattttcgggcttattgttagaggagtaaccgctggaaaacaatgttttttgggacataagtcggcttttccatggcaaaaaaccctaaccattcgtcctctgtgttctattttgatagtgtctacccctgttgttgttgctttttggggtggcgtcaaattgagccggttcggccatgtgtctggcgagtacggctactgctgctggtgggggtgggactacggcacgcggcgttgcgtcacagtcgtagtccaccggtggctcgggcggtggcaaatcgaacggttcgagcggttgctgctgttgttggtcaaaggacgattgatggtgggcaatttctgctgctcttttcatccaagacagttggtggtgaccatgagcaccgttagcctgcacaatttcgtttttaaagcttatggctcctaaatagggataaaaatgactttatcctcacattttttgtctctcgactgccgcatttgtggacgatgacgacaacgaagaagctgaagttgaggcaattgccatcagagatgcagcggatggcgcgcgttcggcatctgttaaaaaaaatgaatgccattaaaaaaagaattaatggcgctgaacggaacgctccaagtcaccgtttgataatggaattaagaataaaaatatttccaacgccggtccgcttggaaatggaaaaaagggtggagctaaggtacgggacaaaatctcgccgtccgaaataattaaaaattttctaacataattttttttgtttataaaaaatttcggagcgaattttggggtgccccggggagctagccattttttttcttcatggcatcactttgcacttgtgacgacgacggtggtaagaaattgaccctgtcgtcggaaaaaataatattttgttgttggaaatcatcgtcgttttcgtcgacagatgtggggcttcttttagaggatgtaatttcattaattggtatatgatttttggtgagggaatcattggaacgagcggaggaagaggagtggtggtctacggtagatgccgccgatgtgttactactgtcaccgtggctattgtcattggcattaatggctgcttgtggttgttgttgtttttggagcagttcaccaccacccgcgccgttcggcatggcggacaaaaccgtactttgttgcaccgagacggtggttgtgctattgatggacacggtggtggggagaatgccattgccgcgtatgttcgtcaccacgccctttttgtcctcgctgctttttgtgttgttgtaattggcagcactgttgctgctggacatgctgctgctcctcgtgctgctgctcaaccgactgccgttgctggtcgtgtgccgcctcctctgttgctgttgtagtgccatttcgtctccctccaacgccatgcgcagcaat

SEQ ID NO: 33877 - DNA, 891 bp, Heterodera glycines
ctcggcacttgggagggccgtcccgaggagaaatggtcatccttgtgtgttcactgcttcaggtgctcatttccatccaggtaatttgtcaattaaataattgggtaattaagctcaattcatttgcccattccctataatttcaatttgaaattattttcaattccccagggcctcattttcgtccgccatccctacttcaatgagcccggctttgagaagctccaagggacgagtcggggcgacgaattgtcgcgcaaatacaatttgtgcatcgaaaacgccacacttaattatgccatttatgagcagtggaagaacggatcgccgtattttacggtgagtcaattaaaaaaagtgactttttatatccccaatccaaggggaaaggcaactgacgcaaattaaacgacggaatatgccaaaaaaagaagcaaaatccattttgccaaaaaaagaagcaaaatccattttacaggatgtcattcgacggcacttttggctgaaacggcacgcggtcattcggcaggcggaacggtggctgaaggaagtgacggagaacgtgcggaacagcggaaagatgcaattgccggacaccgacggaatggcggacggcgttttgtccagccaaagccttcaggtgggaaagaatatcggaaaaaggaaaatctgatcaaaaagatgcaaaaactgatcaaacaaattatagcgtcaaaccgtgcgcaaattgttggaagaatttcggaaaatggaaaaccctttgaaggaagcggaagcggaggaggcgaaaaagggaggaggacaagcgtaaaaagggaaccgagcccaaaacggtcgcaatttggcaatcactacactaatcatcttcagacagacaggacaaagaaaaga

SEQ ID NO: 33878 - DNA, 524 bp, Heterodera glycines
cccaggcacccacaaagacaggcagcggaccaagacaacgcggaccgcagacgccacaacccgcaaccccaaccaacccaacggcagaagaaagcagcccgcagccaagcccacgcagggaacaagacaccgcccggccaccacgccgcccgaccgcgcacgggaagaacacaccacggcacaaacggcaaacgagcgaacgaacaacggcacggaagccgcgcaaggacaacccgcagcaaaaaaagacaccggaaaacaccaaaccccgggaaccccagcgagagcgcaaccaccagccaccacggagcgaccccacagccgcaaccacgaaggacaacaacaaacagacggacaacggacgcgcagaacagcgccagaaaagcacaaaacgacgacaacggcacgacaccaaagaacaaaacgcggagcggaaccccgacgaggccgacgacgaaccgcaagaaggaccgacaaacgcccagcacccgcccgggagcgggacgcaaggacaagcggaggga

SEQ ID NO: 33879 - DNA, 819 bp, Heterodera glycines
tttaatcacttattttaataaaatgtttaaaagtgggctcctatttccttttttccgttttttctcaaatttcccaaattcctccgcttcccatggcccttttttgatctgccattggatatcgtcgtcagaatgtttatttttggcacattctcttttcatgtgccgttttgacgtcaatcgttttttttaaactatgccaaatggtttttcccttgagaatttttaataaaatattaaatatttttgtgctttgttcggcaaaaattgtttattttcttggcttttcttttctctcttttgacaatttttccctttttattgataaattggccattttttgcctgatttggtctaaaacaacagctgccccccccctcgggaatttctttgtgtcttcaccaggcaatttgtctttcctaattttttctcactcccctcccccctctctcatctctcctgctatttctctctttcctctttctccctctccccttctctctctctctcgtcctaacttttctctctctcctctttcccctatctctctctccctctcgctctctctcttcctccccttctctctatctctctccccccttccccctctcactttggcttactttcgcactctttcgatttttgcgtgggacgacgatcattttccgatcatttttgtccgagatcactctcttccccggggcaacttaaactgatcaaacagccagcagcaaagtccatccgcttcgattggcttttgcttgaacgacacaatttctccgggagcaatgaatgacgaacgattagtctgccacgcct

SEQ ID NO: 33880 - DNA, 822 bp, Heterodera glycines
  misc_feature (757)..(757): n is a, c, g, or t
caaaatttttattggaaaaaaccgcaaaaaaacaaattaattgactttttgcatttggaataaattttttcaaaatgctgatttttgaccctaaattctgatttttttgttagcataaatgctgatttgaaaattttcatctggcacctctgctaatgcatattactgaaaaaaaacaattgtcaaccataatgtttttcatcattccagcatttttgggtgaaactatttacagatttagtccaaaaatgggcgattttcgaagtttattacctaaaaaagtcaggcggtgccgacaggtgctgccggagaaatttggtggattttagcctgatttgtgaaaagattttgaactaaaaaaagcaaaaattcaaaatgccaaaatgtttattaaaatattgataaaaagatttaaaaaatttgtaagtattttatttataaaacgcaaaatatttttatatttatggaattaacgtttttaacgtaatatttatgctaacaattatgcttttcgtgtatttctcattacataatgcagaaaataaattaattggcgttctctctcaacaacaattaatccaacgcatttagcaacaagaaatttacaaaaaccccgacaattgaaataatttgacaaattgtttaattgctcgcacagagcactaaaacttgtgaaaaaaacaatgagaatttagggaaataaaaaataaaaaacaaagatagtttatgaaaaactctgttagacaaaaatataagnggagagaatgtgtagaccagagaaagatatcgcttccttaaattttaaaatctaatttaactcat

SEQ ID NO: 33881 - DNA, 614 bp, Heterodera glycines
aggcaaacgaaccgcctgtggaaaaaatggtaggtaaacaaaaaaaagattgatggcagagttcagaccatttattctaattttgtacaagatgaaaaaccccatcataccgacagttatcagtgtgttaataacggcgaccaaatgacgatttgcttctctcatttcctgggagatacgaaggaattagaaaaatacatatattccaacacttggcttacctttccaaagtcttgcattagtgaacgatttcgtgaaacatcgacagactttgtcatctccgcatatttcaaagcttcctggaaaaactcactttagaattgtttttcattgcaaatttcctacttgtctttctcgcaactgttcaagcctttcattaaaaatcctttttgcctcccgttgttcctcctctttctcttcagccgtttcattcggtgagcatggccgaagtgattcgacaaatcggaagaattcaatttcggggggcaaactgtcgtaaattgccgacacatcggctgcactcaaacgattgcgctgtttcaacaaaattgtgcttttctcttttcaaccaattgtcaccttgcaaatttcttcgatgctcctccgatttgttg

SEQ ID NO: 33882 - DNA, 603 bp, Heterodera glycines
atggacattgttgaccgaccaagggctcgaatttaaggcaaaagaggttcaggaatatttcaaaaataagaacgtgaaaaacttttttatgtacacctcgccgcgaattcacgcagggatggcagagcgggccaaccgaaccatcaaagaacgcctttatcgctatttcacggaacggggtacccaaaaatgggttgatgtgataccggcgattgtgcgtgggattgaacacttgctacaacatccgtcattgatggcgagaaggtggtcggaaactcataattgatggagagagcgcccaaccgatcaaagtacgaattgtagtaacaaatcgtgaccttctgtacggcgggagtggaggagactcggacgcctcttctggtgcaattgacgtggcttccgatgcaatggaatgttggtggtggctcgggatgttctgaggcgaatggacaaattccttgagctggggaggcttgaacgcccaggaaagtgacaaggatggccatgatcatggtcgcggtgggaggaatcgcgaaaagccgagaattttgtcgcgcaagaatgccgctgcgcttactgaccagcggatctctcgaaagtgaa

SEQ ID NO: 33883 - DNA, 254 bp, Heterodera glycines
tataataacgcatgcggacatctacatttttgaattgacataaattggtaatcactctttctttttctccatattgaccatcatactcatactccccccacccttttcttcttccgccacccacctccccctcttgataggttaaactgaaggcgggaaacgacaatccgatccccatcaaactagctactgcaggtcctgctcgagcggccgcccggggatcgatccccgatctagtaacatagatgacaccg

SEQ ID NO: 33884 - DNA, 601 bp, Heterodera glycines
cccccctcctcattagcaaaagatgatgctgttttggttctctacccctcactttgtgcacaaaattttctctgactgtctgtctccccctactctctcactcatttgtttgtttcttctctctctctatctctccctccctctcaccgtttcactctctcacttttcccttcactctcttctctttctccacgcgctgccgtccctcgctgctgcgctgctgaccagcagccccccccccttccatacaacaaatcatcaatcacccccatccttagataaagctttatatgctcaagaagccttataattaacacgaaataattttagcaatataaaaaagtaataaagaaataactttaatattttgggattgttgggaattattgtgtgataaatattcattataataatagtcaaatagccacccaatacatacaaaacagaatcttcgaaaaatgttaaaacttactaatgaaatgattacaaattaaaacaaataaacaaactaacaatcaaacaataagaggataacttaaacttattctcatgaaagtgcgtgcgcgtaatactcaaatgtcttaaaggaatgaactgaacc

SEQ ID NO: 33885 - DNA, 953 bp, Heterodera glycines
  misc_feature (10)..(10): n is a, c, g, or t
cgtaagttcntggatttatggtatcagtaataggttctgtatttggagagtccaaatttaacaaaataaaaaatgttctgtttaccgaattctttataatttccttcagtttcaaagtcgccacttttggtttcttaaaagattgattaattttaccaagtttgagctaagttatgatttatttttagcaataaaaataaaataattaaatttaaatatttcaatcattgatacttttgtagcaccctatgtgttatacaacttttttgggcttgctttttcaatctttggccattactcatcgattttggcttcgttttcgttttccattttgtctgttggtcccccgtattcaccctcggggtgttcttcgtcctccgccccccccttttttcttttttcctccaccatttctcttccctttccctctcttctcttcttttagacggtccatgtgcttggaatacacagcacaacagcagtgaatgaatgttttgcttctgcttttttgtcccttttcccatcgattagcgttcattccgtaaaatttaaaattttttgctcaattttttcaatttttgctaggtaaatttatttattttttaaggtcaaaggaaaaaaaagttgattagtgcctttagcaagggcgtaaccgaggggggggggggggggagagggctcgaaatccaaaaaagtaaaattttcaaaaaatggcaaattttttgaaaattttaagccttaacaaattgtattacaacttaaaatttccagttgctaatcttgcttttagccaggccttagacaataaaatatctgtcaagaattgtctttttcatttggactaatccgttttgcgttaagtcagaaaaattggtctaactctaatgcctatgggcataatgaacatttacgaaaagcaattagatcactaacatcctttgcaacattatata

SEQ ID NO: 33886 - DNA, 725 bp, Heterodera glycines
aggccaaagaaaaaagtaccagacatgcagacacttatttgccttaggcattttctaaaggaaaattgattaaagagcggcagattaaaatcaaaaaatcaaaatgagaagaaaaggcaggaaaaagtacgggaaacagagagaatgagaggggaagaaagtggaggagagagagaaggacaaagggagagaagagagagaaagagggaaataaagcgagaaaaagcgtaaaatgacaggtaaagacaaaggagaaaaagaggaaaaaagaaaaggaggaggggagaggaaaaatatattaattatccttttttaaattgttttcccgttcatacagtatctggttcttttgccatcaccgttttacagtatccaaataccgtacatttggccattgggccgtaaaagtttccttttacttttggttgttcggcctggcatttgtttgttcatctttcgtgttttggcctttgtttcagttcgcttttttggcttcgatatttcgccgtcgttttttaattgattctctccggccaattaattatttgttcgatcgatcgattcaacgccaattaaaaggatgtgctgttaatcactctcttttaggcttttcctcgtcctcccaattcattcacttttttgtacgatttcaccaatgctatcaaatttcgtctgtcaccgtgaccaatgataagtgatttaagcgagtgacgatgcactgatag

SEQ ID NO: 33887 - DNA, 1350 bp, Heterodera glycines
aaaaaagaaaaaaaaaaaaaaaaaataaaaaaaaaaaaaaaaaaaaagaaaaaaaaaaaaataaaaaaacaagcggaagagaggggtgggggaatgatggatatgggaggaaaagaaagatgggaaagggtgtgggttaaggatgggtgtgaaattagaagaatgggtattaatttgagaattatcgtttttttggattgttaatagtatgtagaaaagttttttgaagggaggattgatagtgcgtgtaaggcaagaaagggaaaagttgattaatataaattaagatgttttaaaaatttctttttattttttggagagtttcccaatgtaaatattgtcatcagtgagggtagggggggggtggcgaagtgggggaattggtttcgacaaaggttggcctggccggggttaaagttacaatgcaaccagattcttacccatggtgataataggagagactttatttggagctgtacaacccccccccccagttcaaccttaatttggacgggcggcgggaagtgccggtgggaaatagtatcgctggtaccccctccacccaccacttttttcaaaaaaaaaattttttttttctggaaatagtcattttaggggttttcaggatcggagaaaccgattccaatatccattccgaccttaaatgtaatgaaacaaactaaatgccaccaatgcctcaacaaaaaacttttaaaccgatgttttaaagcaaaaatgcgcactacgaaaatgagttctttttttttttgttcaaaatcggtccggggttcggatttgagtcggaatggatatcagaaacgaattctccgccatgaaaaaccctaaaatgactatatcgagaaaaatttgaaatttttgcgtaaaagtgggggtacctttggcacgattaccgaagtctgggttcttatgaacttaaaaccctgattggcagcctaccggattcgaatagtcgtaacatttgagaggggcggaacagctgaagcggatatgggtgtgccgtcaatcaaaaacgcgggtccaccatcggattcaaaaattatgagttccatggtcaataaaatttgtttttctaaaattcgaataaaacaaaaacattttttatttcttaacaaatttcattcaattttacccgccccacccccaaaaagaaaaaatgccgagtaaaaatgtattggtaaaaattgatcataagaaacccaagagagagacgggaccagagtcccgcaggaatttttcagggctcccgtagcaatgcagagcccccccccccgcaaatttttgccagtctcttttcttatgtgcactttcctaaatgagggcgctcccgat

SEQ ID NO: 33888 - DNA, 874 bp, Heterodera glycines
aggcctggatttttttttgttttttagaaaacacttctttttaggttcctaccagcggaaattttttgattcagtttttagaaaaaaagttatgggctctgaactgtgagaaaaagtgacaaatcgcttcccgggactcagacgtccgcgctaaattttttttggtcgtggcaaacgccaccgaggtgctggcgcgaaaagtgatggaaagaatggaaaaagaaagaggaaaagaaagatggaagagggagaggagggcggggaggtggtgggagcggaagcggcaattcaggccgctgtgacactattaatttttttttgattaaagattttgttgaattttgaataaatttttgtataagtattttttttgcagtgaaatttaaacaaatttataattttaaaaaaattcaaattcattatcggcagagctaggattttatgtgctaaaatccctgaaatatgtacgaaaatatgtaaataaattttatatggttatttaaaaattttattaattattaataaaaccaaaacatttaaatttattaaaactaatgaattaactaaaaaataatagaaaaataatgcacaccacccgggtccgaaccccccccccccctcataagggtgcctcagaatccccatcacacagggattctgaggtcttaacgatgtcaaaagtgaaatctgatttgatattcgtgatcagcgccctaaaatacccctaaagacatgtttctggaaggtttctggtgaaaaaatttttccaccaaaaaatcctggtcccccctttggtcccgaatctcaaaatcacttttatttttatagcaatttgtaagaaagtgataaaaaggtgaaataaaattttttataa

SEQ ID NO: 33889 - DNA, 893 bp, Heterodera glycines
tcactagaaatgatcctattttggccgcttttatatgcaataaacttgtaaaaatagtggaaaatggaggtccggtacccttttttataaaacttattcctctccctttttgatatacaaagcatcagagtgcctaaaatagcttgaaaataaaatatgatgatgcttcagaaccctctcctgaaaaaatatttaataattattttctgaagaaatgaataaacaccacagattcatattttctaacatttttgtgagtcatctagatgggccttcattgcattgcccgaaattcctttaccgccgagcatccctgatgagtttggcaaccttatgctcaattaacataaaatatgagaagatcgagttttcactatcaaagataagcctacctttgttgttatctgcatcaaactcttccccaatttataaaatttaataattttcccgccccgaatcgactcagtctccctcgtccgttcttcggatggcaagtgaaacgcagcaatgttggcaaatatctcaaccggattgccattccatttccaatttttaaattgccaggccggaccctaaagcagttttgcaaatcccctgaaatgaccatacgcccacctgcacaaacactgcgaccactcggtcccattcctcgtccttcaatcgtgttggattgtctaccgactcggaacggaacagtgacgccattctttgggatttgcagtaacagctcattctctcgtttactgctaaattgcttcttttcttcccgtgcttacgtaacgcacatccttaacataaattaatttataatatttttcaaatgaataaacctgcaaaatttccctgcgcattgtaaattgtgatgagtgaacttgcaccggcagggataatta

SEQ ID NO: 33890 - DNA, 974 bp, Heterodera glycines
atatgttgatgattaaataaattgaaatgttttttgttactgaataatttgtagcattttttttcttttttttttgtattagtcatgccttcagaattgattaaacaaataattatttttggtccgcttatgtaatttaaattcaccacttaaaatgaaacaatttgaaagaaaaattttgttttcttcaaaaaatttaaactttaaattctctctgagattacggctctagtttagaaaaccaaaacaaaatttcttttttatataaaaatatattaattttgaattatttaaaaatctattttttagaaatcttagcaaatattattattttttaaattaaaaaaaattcaattgatctctttttccaacaatttccttccttagcttgttttctcagctttgctttaccaacagaaagctgtgccctaactcgcggttgattaaaaaataatataaaatttaaatcgtttgttcatcaatatttaaaaaccataaaatttcttttgaatataaatcaagttttggtcagctttttgtacccattaaattaagaacatattttatatttcgtggcgcaacaatagtggttttgtaactaggggacccgaaaattttttgaaatttttgaaattttgcatgggattagaaattcgggattaagacagcagagatgcgagggattcgcagtcctacagagtatcacaaattttaattttaaagaataattcaaatttgtttatttgatttttaataaaagaaaaataatcaaaaataattcataattttttttgacaaatttttagttttaaaccaaataaataaataaatattttcggcatttttttggttggtgaattttatgggactcaatatttccaaaaaaattcaactcataataagaaaatttagataaaaattgaaatcgactcataaaagtgtgtttcattatttattattactttttgcattta

SEQ ID NO: 33891 - DNA, 681 bp, Heterodera glycines
aatcaaatttccctaatttaatggggttttcataattattgcctttcaagaaaaattttatttgaaaacccataaaaacccaaactgaaacccatcaattaatcaaagtaagccccgtcactgtcgatcagcagcttttgccacttttcccccattttcccatcaaatttttcaaataaaaatgattcaggcatagaattactgtacaaaaagtaccgccgtattactgtaggaacaatttccatcattaactaattgccctcactaattaaattctgaactggtccccatgatcatccgtttatttaaattagaagcataccttcgatatgacaaccggcacgtgatgggcgccttcggtgccgccataaaatgcaaaaatgaaataattaaaaaataattttaattgccttaattgacaggccaaggccttccggccccttcggcacgttcacactgcgcagtgccaattcggttgaagtgtcggatgcgggcgaaccaatggtcatctgcaacgaattcagttcctgctcgctgtccgcctgcagctgaacgctcagaagatctagtgggaccggaccatagaatggacaccgcctttggcattcatttcatttttggcaatcttgccgactgtagactggcgtttttcgccattttttggtcacctcataaaaaata

SEQ ID NO: 33892 - DNA, 955 bp, Heterodera glycines
tccccttctctctttcgcttctccttctgtttgtgtgtcccacccatcacgtccattcatcagtcaacagtcaagactctcgtccttcttcccctctctttctgttctggccaccgaccgctctgcatttttcatccgtaatgatacactaatgaatgatcacaaatcgtgatgaaaatgggacgaaacataaaaaaagaaatagggaaagagggaaagagagggaagaaaacggtgactgatgatggtaattaatgataagcaccccattcacacatccatccctctcatttgtcagttttcttttccactctgcccgtactaattacttttaataataacaaatgagcgacgataaccaaaaatgatacattcattcataaatcacccatagcgcactaatgtagaaaagagtcgcgcaatttcgctgtgtgtgtttgtttctgtggcgtgcgcaattcgccgaaagagatttttgtacgaaatgggagaaggggggggggatcaaatcactcgaaaaacaaatcgccgtccggccgatcacttattatccccgacacaacaacacaacgatcacacactcaactcacaatcagcagagagagagagcaaaaacgcaatttgcaaatatttatttttattttcttttccttttaatttgtcagagttttgcggcggcggtcgtccgccgtcagaagtgatcagcgtcaaagcaaagcccagcgcagcaacagcagcagcacacccatttcaacatttatgttaagcatactgctgctgctgcttcgttgctgcaacgttttgcgttcccccccccattcatttttcgcggcgctcaatcagtcagttggtccatcggcggtggtttgccttgtggaattcttctttttttggtaattgcgcgtgtaaaaatgcatgaaatttcttacaaaaattgtaaaatgagaaatgctca

SEQ ID NO: 33893 - DNA, 874 bp, Heterodera glycines
aaaatatgaatgaaagggatgaaaaaggtacataaaagccgacgacgattcgctggttattccctcccatcgatgggagttttatgcgccacggccaaaccgacactccgccgcccaaccgacgatcagccgtaaacgttctcctcgctgtaagcgatgtacatgaacaagtcctcctcgtggcggtcctgaaaaaagaattaattttgaaacccaagaaaaaattaaagcgatttggaaaagacataccaaaacttgcaacaaaaaaagtgaatcaaaagagaaaagcaaaggtccctttgtaatttgcccattttttgttttaaagaaccagtggggattatcggcacaactgccgattttgtaccacttcgaatctcgtttggcttccctcttaaaaccttttaaaggtcaaatggaaatgaacctggtagagctgtcccatggttgtcattgtctgaaaggaaatcatctgagggtaaacctcataaatggaaaacattaaagcaaccaaaacctgggggataacgctgttgataaagaaaaagagcgattcttcggggcgaagatggatcctaaaggggaagaggtatttggaagaggaataatcgtttctttttgcatttatcatggaattgttcctttatgataaaaggcattatcaccaataaataagcaaacacaaatgaccttagctctagttcgtaatgcgtccaattaatgaccatcctcagtttctttgaccatgtcattttttatttggtcaatgcctatattcttggtatcaactggtagcttaaaggctctgtataagtttttatattaataaaacaacagacaaaaaactcttgaatataggtactccaaaacattg

SEQ ID NO: 33894 - DNA, 1007 bp, Heterodera glycines
aaaaaatggcatggtcaaagaaactgcaggatggtcattaattggtcgcattacgatgtagacctaaggtcatttgtgtttgcttatttattgatgataatgccttttatcataaccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagactaaactttttgacctgttcaaaaaggaattaaaaatttttaaaaatttattcatctccctttctgacagaacaagcatcgagagtgcctagcctagcatgcaactaatatttggtgcgttctagaaccctgttctgaaaaaccatatttatgaattacttatgcgaaaaacaaataaataatgaactctcttccttaataat

SEQ ID NO: 33895 - DNA, 936 bp, Heterodera glycines
ataaatgcccatttaattgttccgttcccaactttttattctttcaatggcctttcctttggccatttcgcctttccatggcaaatcgacaaaaatgtctcatctgtttctcaacttagtgcttttgcttctgcttcactttctttctgtcgtttccactttcaatttggacttccgacaagcgcaaatccatcgtcggcccggcgcccattcggcgtttggctattctttggacttcgcctacagagaccaaagacggcacaaattcacttaagtttatgaaaacagcgtcacaaatggcaacaattattaaatgaatgtgccaatttaatttttcagtcttttggtcggtgcgccatttgctcagacggcgcagcggcgacttcagaaaacgggcgcagtgtacggctgcgaagtggacaatcagcagcaaaacgcatgtgcggagatcattttcgatcagaaaggtgaagccaggccaaacagagggaaagggaagaaaggcgggggatattaagtggaaaagcacaattaatttattttttaattacccccccccccaccgaccatttgagcaatgttaaagtgtccttaaaaaaagaaagatgggaggggaagggaagggggagaaaagtcatttagcaaaacaaaacaacaaaaaacacgcactccaaacaatcgccgccaaacgctcaaaagagagggatcagcagcagaaccaattaatccaaaacaaagaaacacaaaaataaacaatgaaagacaacaaaaagaaacggacggacatttaacagggcgaaaaagagagaaaagagatagatagagagagagatagagaggagaaagggagagagagatagaggggagaaagggagagagtgagagagagaaaaaagagagaaaaagagagagatagaggggagaaagggagagaga

SEQ ID NO: 33896 - DNA, 581 bp, Heterodera glycines
tcgagtttgggtccggatttcggaattgttcgaaatgatcgtcaattcgtgatcagcgaccccgaaaactccagaaaaaaaaataaaaattattttatgtggcgtaaagtgaaaaagtaccctgaattctcacagtttcggcctcggtctcttcgtcacgtacacaaagcgtcgtgtgactgtcgtcgcctccacttgcgcttcgtccgcgtcgtcatctccgtcccccgcggtgccttttgttggctttatgtccgtccgtttcccccctccctctctctctcagcttccctctctctctctctctcagcttccctctcccattcccctctctctcagcttccctctcccatcgcctcctctctctctcagcttccctctcccattcccctctctctcatcttccctctccctctctctctcagcttccctctcccatcccctcctctctcaccttccctctcccattcccctctctctcatcttccctctccctctctctctcccattccctctcccattcccctctctctcatcttccctctcccatcgcctcctctctctctcagcttccctctccc

SEQ ID NO: 33897 - DNA, 1465 bp, Heterodera glycines
  misc_feature (106)..(106): n is a, c, g, or t
gcccattccgccactctcttcgcttggtaatgtttggcgtccgtgcgtcccatgacaccccctcgccgtcttcactctccgcatgttccctcccccaaggtttggngcttgtttgctctgtctgtgctctgtgcacattgcgttgcctttgccctgcctttgctttgccttgccctacctctcttgttgtcctccgcccaccatagtctttcatttgctgtgtttgtcatcgtcaaaggccgatcgattggctccttcgactccatcgcccaccgtcgtcccccgggggggtggtggtaccctatggaacacatcaactccaaccccacaaacataacacaagaagaaagtcacagcactctcttctgacagaaaaaaaacttaaaatgtccatttaacgtttgcagaaacggggaatgtaagagcgaacaacgaacggttgaaccgttttaagcggtccattctctccgctgggataaacttttttaaaaaacggcaaaataaattcctttataaatttaaactccttaaagccgttaaattatatatttactaattggtactaatggacaccgatgctaatagtccttcccaaatgctcagccaaatttttggtcaccaaagtaaattgtccccactttgatttcaaaagctcaattggctttagttgatgaatcgatcagccatttgaatggatgcaatcggaaccaatacagagaggtggaacggttcgagacggaagatgagttgcagcagtggatgctctcccaggggaaaaagtgggggatgtgagtgaacggcgtggggaggaaggattacggcaccaatcattacgggttccgcaattggaaaaccttaattacgtttttcgatttccctaattgaaacccaattacgtccagccctgggggggggatggggaggaattaggatctaatggtgaaggcaccccaggagagctatattatttagttttttcaaaattttttttgtttgtttaagagttcaaaagggacgcgtgaccattgaggatgtgagtcggcactgatcaatcccatccattcatttccccgcctttccctttcctttctcagatcattgatcagtacgcgtgcgttttccgtcgccggaagggctacgcgtgcaaagtgcaaatgcgcgtgcggcacaatcggcgcaacgggcacaaagtggtggaagtgagtggccaattggacgaacgcaacgctcaaaaggccgaaggattttgcagattttggaactcgaccatgaccacacattttacggctacaaaagcggctttgagccggccgacggggccaaaatgttcgcttccgcctcgggcggccaattctgtgcgcaaaccgccgattttgggtcgggccaccaacaggaagagcagcagagcaaatctgcagctcaactaaatgcccaatttggtgcgatattgaaaacaattttgaaa

SEQ ID NO: 33898 - DNA, 852 bp, Heterodera glycines
ctcacatccgcagtggaaatcggcatcgtcctcgggagttgagtttgtgccaaaaacacacgtggaatggaaccactaaaaataaataaaagggactcaatgtttgtacagcacaccttgtcgcagtcatcgcattggacccaattgatggacatatgcagcggtctttggcattttttgtgtgcacataactccgggtctccattgccaccagtccaatcttcggccactgttgtcgtggccaagtctggtgaagactcgtccctcgttcggcctttgcgacgtcctctccgccccgtccctttcataattgtcgattcaccaccaccatttagttttacgtctctgctttcgctggccaattggacgtgctggtcgatggatgagtcgtcatcggaagaatcgccacttgatgacccatccacggcttttcccacggctttatgtgcacttcccaaaggtctcccccgtccgttgccaatgttccttcccaacatttttggttttatcgcggtgagagttgtgactgtcgacggagtgtttgccgtcagttttttggaagaatggactgccttccctttgttctgaaaaaggtaacctggtttcttccactcattcattctcttctttctctcacctccgtcctccctccttttggccccctcttttgttgtccttcgctgttccgttgtccaccatttgccattttgctcgttgtcgttgccacattattcataattgtcatcgctttcttagttcctggagcggatgagagcagttttccgtttcggcactgtcccatcgccgttggccattgctttggttgtgcttttcttctcccatttttttcct

SEQ ID NO: 33899 - DNA, 1460 bp, Heterodera glycines
cttcggacaattcatcgggccaaacgggagcactctttcgggtgtactagcggagagaatggacaaggtccttcccaaaaagaggaattactttgaattattagttaaattatttggattaaatatcataattttaatcattttaataaaatacatcgaataaacgccaaatctgaatggacaacaccaactatttttgattttaatttttacataatttcttatttcttaagaacgaagttcgcgacttgatgctttgcgtcctttacacgctgaacattcttccgaagaaaatattagcagccttttggaatgtccaagaagccattcagccaaccaaaacaatgccaagttgcgacgattcggtcacggaattgcctaagcaaccccaacaaaatgtccttgtcgactttgtccgtattttggaactttcgcttttgctgtttcgctacagagggcgaacgcgccacttaatgttacaaacaaaaaggtaaatatgacataattcgacagaattttcaaactttatttaaagaaacaaagcgacaaacccgaacaaaacgcccgaacttctgctgaagttcgatgggtcgaattcgtacggaatgagcagcaaattttccacactgactgatataaattttggaggtaagcacttaaatttaatcatttaattctttgccagtagaaagtttcgactcgagaggagtggcggacgaagaaggcaaaggcggcgaggcgacaagttttttgatggactgtaatttggcgcaagaagtcgcgctgattgtgttggagactatccaaacaatagccaaccaaattgccgtatgtttttgccattttcaaatttaccctttcattgttcaattcaggcaaagacgcgttacacctccaccagcagtttggatgtcatttttgttcgtcttcttcacttacagctcgaattgctcaacgaatattggcccgaaactgtccgacttcacactctctctgcgctcgctgtgtttgtcaatttggttggtcctcctaatttattttaataaacgggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgatatgagcaccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataa

SEQ ID NO: 33900 - DNA, 967 bp, Heterodera glycines
atgtcgatggatgtaaaaaacacgaatttaaaaaaaaaccaataaatgtatcacagtaggggaggggtaacctttgatttgcaaaaaaaaaaaaaaatttttttttgcaccggaagttggcatccattttgaccaaaccaaaaggatcgcaacaaaacaaacaaacaaaaaccaaaatgcactttgtgcgatgggtcgacgagaatgacttcgaagaatttgtaggtcgagtcctggcccacccagtacgaattgagcacacgaagttcgcccaaacggcggccggcacgggcctatgggaaaagggaaggggggaaaatcagtcagaaaatttgtgaaactttaagggttgaaataaaagatgggccgggctacttagcctgggatgacaaggggcgggtgaaattgtggcagctcccataccttccttttttcttgttaccgccaggtaaaatttgacgcattttttttttcattggttttcaatgcgctttgctctaaaatccccaagttttgaccattttttgggaaaaccgcacaatttgttaggcccatctaattgaaacaaacctccgcaacggcctgcaaactgcgcgtgttcttcagctggttgacgccatgcgttttcggctttccgtacgtttgccctttggtcacttgacgctttcgacccccgcggcgaatgcgcacgcggtaaatgagaaagcctaaaaaacagtaaaattttaacagacaaaaactcaacacggtgagttggccgcgataaattggacggttccccttttttccaaagcatcaattcatcacacagattggcacttttacaaaaaaaaaaaaaaaactgacaccatgacacaatgattgtaggattttttttttttctatgaaccaacttggagaccccgagtgttttaactagggctgaacgcgccaattactgctgggattaccttttatttttgaaaaa

SEQ ID NO: 33901 - DNA, 932 bp, Heterodera glycines
  misc_feature (874)..(874): n is a, c, g, or t
aagaggttttgctcactggataagaaagcaaattttgcacagggggaggaggagtaaatcaattcggccgcgtcagaggattttgccaacgcttaacctgtggattgagataatggcgtttaaatttgggctgaaaagctcaaacaaagcattattttattaataaaaattgaaaaacgaatgcaaatggagttgctgcgcattgccatgtatcatcgcttcatgccattcttatttctctgctttttgttgtgccgtggggccccggctaatgatgtaaaaaagaagaaaggtaggaccaaatttcaattcatttttattttatattaaataatacttttaaaatatttttaggggtatggaatattagtgttttatttttataaagccagtaaatttttggaaatttgataacagagttccgaaattttttaagaaaatgtttgggttcaacgtctaaaatatttgttgcacgtaattccgacttccaaaattttttattgcctcgcggcaacttcttcccttataaatactacattaatatttaaaattatataaataaatgcctggtaaatttgtttaaaaaaaaaatatatattttttctatttttctgcttttataattagggcccctatcacccctctacacccccccccccccccgccaacactcgaaaacaagtccctagtaacctgggcctggaaatttttatgattttaaaagaaaaccataatataaccaccaaaaattttttttacctaactatccagtgggtttcaggttttatgcgatacattggtgagagcgcaaaagcaatttcaagcgtggttggttcgacagttccattttggtggcggtcttggcttcccattntggcagtggtgggaccacttccggcacgccattaaggcgaaacgccagcagcggcgca

SEQ ID NO: 33902 - DNA, 892 bp, Heterodera glycines
caaaagcataacacgcattagtgtcttacacgaaagtcacagaacaaacccactaatgttttatcaaaagcatgacacacattagtgtctcacacgaaagtcacagaacaaaacactaatgctttatcaaaagcatgacacacattagtgtcttacacgaaagtcacagaacaaaccactaatgttttatcaaaagcatgacacacattagtgtcttacacgaaagtcacagaacaaaccactaatgttttatcaaaagcatgacacgcattagtgtctcacacgaaagtcacagaacaaaccactaatgctttatcaaaagcatgacacgcattagtgtcttacacgaaagtcacagaacaaaccactaatgctttatcaaaagcatgacacgcattagtgtctttcacgaaagtcacagaacaaaccactaatgctttatcaaaagcatgacacgcattagtgtcttacacgaaagtcacagaacaaaccactaatgctttatcaaaagcatgacacgcattagtgtctttcacgaaagtcacagaacaaaccactaatgctttatcaaaagcatgacacgcattagtgtctttcacgaaagtcacagaacaaaccactaatgttttatcaaaagcatgacacgcattagtgtcttacacgaaagtcacagaacaaaccactaatgttttatcaaaagcatgacacacattagtgtctcacacgaaagtcacagaacaaaccactaatgctttatcaaaagcatgacacacattagtgttttacacgaaagtcacagaacaaaccactaatgttttatcaaaagcatgacacgcattagtgtctcacacgaaagtcacagaacaaaccactaatgctttatcaaaagcat

SEQ ID NO: 33903 - DNA, 900 bp, Heterodera glycines
  misc_feature (867)..(867): n is a, c, g, or t
tttttcaaaaggatactaaaactcgggataacccattcagacactagtcaaaaaaaataataataggcttggactaccatactaattagaatttttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaatttttgtttttcaaaaaggatactaaaactgggataaccccattcagagataagtcaaaaaaaataataataggcttggactaccatactaattagaatttttagaatgtgtctgttaaatgcaaaactgttgtgaaaaattgttataactccattcagagaagagatagaaaaaaaaaaataaaaataggtttagagagcccatgaacagctgaatcggatgcaagtaccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaatttttgtttttcaaaaaggatactaaaactgggataaccccattcaaagacaagtcaaaaaaaataataataggcttggactaccatactaattagaatttttagaatgtgtctngtaaatgcaaaactgttgtgaaaaattgttata

SEQ ID NO: 33904 - DNA, 1162 bp, Heterodera glycines
aaaaaaactcatttttacagatgcacattatatggcctattgtcggaattctgatgtcctctattggtacgactttgacgattcgaatctcacccgatgtgaacagctttgaagtgctttcccaagaggcgtacattctgttatacaagcagaaagagactttggaagacgaggaagcgatggaggaggacgaaatgttggaggaggaggaggaatgggtggaggcaaattcatccgacgaaatggaaactgagggcggcaacggcacgtgaaagcactgcggccccccccccccccttattgtgattattcattatctttattacatgtagtaattatttgccgatttcgccaataaacaaatggacggattcattttgcgtcctttcccccccccccccccaattttcaaattaattctatctgaaaggacttcctttgcctttttctttctcgcttcggcattcctttcctttctcccgttttaagcttttgcttttggctcctatttgattgtgccaatgctttgaaaggactatcttttgctccctcgctccttcctggccaattttcatgcttccaccagtgacggcttcatttccgattttcttcgtcgctatttaattttagctacaaagctaacggagtcttccacttttattcctattttctgcggcttgttatgttagtcggattttcgaagttgttgtttcgaattttgaatttgaaaatcactcaccaattacttacatttctctttccttttctcccttcggacctttctctttaccttacattatatctcatctttattttctgaggcaagcgttgcttattctacaaaataaattgaaaaaagggaaaaggatcgggtagataacgaatagagggggagtaggtagtggaacgaaatttatttaaattcttaaaggcttttgatatcccaacttcattgctcttaatttaaattaatgataaaatatttgacagttttccctcggttcgggcgattacatgaccaaaatcggaattttcgcctacttaaagtaaaattggacgttttgccaaccgacaatttggcctactgaacagctttattaagtttattaaatgattccgaggaagaaggattttttttaaatttttttttaaattttttttt

SEQ ID NO: 33905 - DNA, 959 bp, Heterodera glycines
tggcggtcatggggaattttgcgaaaaatcaattaaaatgtggcacgaccctcgaaaaaaaaaatccaaaaaatcgaacaaggacaagaaaaaaaaatcgttttaaaggcctcaatctcaccgagtacacgtaggaatgcacaaaatagttgaggtaaatcgccccatcggttgaatgcgggcgtgatcggataggagtagaaggcgtacatcatggtcaaaatgtggtggtaccaatgcaggaacatcaacggccttttccggagcacctgtgacaattacggcataatgaatgccagcgatccacagagtccggacagaaatggttttgtcggcaatattagattttcccggattatggtcgcaatttgtaagaagaaatagattgccagatgacagagtacggcaatgaaaatatcggcagttttcgattttctcgggatcttggtccaattacgaaaaaataagattttgaggatactttgatccctttttggaaaaatgtggtgatcatttatagtccatcagtgaaaataatcgttgcctaatcaatgatcaaaattcaattagtaaaagacatattttatcgtataacaaaaagaaaacattagattggtcttgatgtgaacgcataaaattaatcgagaattttggaatgattaagcactttcccgacaattaatatgcagtagagtaaaaattggaagaaagaaaaataaacaaacaaccataccaggaaaacggtgtcaacaagctcaaactgaaaaaatcatttaagtaaatgtaaaatcaaaaatacaattaaatttattcgaaaagatattttttatagatatttttataaatttaaaaaaaaaataacgatttttgtattaccattttactggtgatgaacaccacacccaatagccattgttgccctcagtgtatttcaacacattgcaatatgatgctgaata

SEQ ID NO: 33906 - DNA, 1582 bp, Heterodera glycines
aacttcatggaaagtatgaggtgaattttcaggaatttaaagaagcattataatattcgaaaaaaggaaatagtcaggattttgttttagatataggctcagtttgtaggatcaaatcagattcaaagaaattaagattcaagcatattcgagcataattcaattatgcattgaaaacagatgtttttctctgaatgagtgtagtattcgtagtcacaagtgtccatataatcaagagtcagtatgtatttatccatcatttacagtgagcacgattgcatcgcagaattgaagttcatgctattttcaatatactttcgcaggattcggtctcttcataaatctggtcgcatcggttcggggcgcctgccctgtaatcaaaagttttgattcattcaagtgtcggtttggggtactcagacaattatggggagcagaggtccagcacagaattattgtccagtctatagggaagctattgcagaaggattcggtcttaacataaatatgtgcgcatcggttcggggggatttccccgaaattaaaaataattcgattaattcaagtgtccgtttggggtactcaaaccattatggggagcaaaaatccaacgcagaactatagtacagtctatacggcaggtgaaaacggcccacgcgaaaacggcctggcccgcgcaaatcccccccccccttattcagtccccccaaattttatatgcatcgtgattttaattaatttttatataagaaaatttttaaaaatggtttaaaaaattgaaaaatgcgcgaccgcgatttgcggcaatttttttgcgcgatccgcgaccgcggcaaattgaatccgcgaccgcgggatttttctgtgcgcgccccacccctgttttgaaccattggacttacaattagcctattttgtataaaaattatgttttattcgtgcaaaatttcaaaaatttttacctcggctcagaagtgtctgccttttttcaaaaaaaaacaaatttctctttttaagtttgaaatgccatgaattactatatttctgacttaccgtatttgctctttttatccccccggggggattatttttcaacctcctcagaaacggggggattattagatacggggggaaaaatggagaaggggggattatttttcgacagatttatttgtctaatatttttgaaaatttaaacatatcgacaaaaaatatcatcgcgtcaaaaaaaagatttttatttcatttttgttaaagaattccagaattttacatgagaattcccaaaattcttataatatttaaaaaatattgaaaaccccaaacgtttttttcctacccctagtaatgatgtacagaatattttagcacttttgtttttaactttatctatggactctttttgctgcgtttgtaaagcaatttacggaggaagccacagctgttctgtctgcaaattgacgtgccactcattctgtggcgattctggtggggttgaaaacgaaggcttcggcggaaaggtcgtatgccacaactgcgtgaacgaggaaggaaatccacagacagcagaaggttccgaaaa

SEQ ID NO: 33907 - DNA, 938 bp, Heterodera glycines
  misc_feature (853)..(853): n is a, c, g, or t
  misc_feature (905)..(905): n is a, c, g, or t
ccgacctcttctgccctaacgaggaagctgccgtcgatctcaactgctctctgtccttaggagcctgccaggagcgcttccccgaccactcggcagggagcgtcgaatgtcactgtcgagacctcaacctcgacgcattgcttgaaaacccggaagctcgactgcccatcacaactgcgagagttcggctccacaaccgcggccccaccatatttgcctcccacgcttactcccctgttcaactccacctcgtcctggccaacgtaactctacaactccggctggctgactcactatgtcgtgtggaggaacctcggctggtcgggtgttacagttgtttgaccggtgcacaactcgactatgtctgtcactccgacatggacaacgcgctcgccactgtttcttgtagcgacgggcaattttttgtcgctaactgcgcgccgaatggcaccaggagtcgtcaagttttaccttacgaccatgccgacatctcaacacaatgccatgttaaatgccccgcgggcgaaacaaccttccggctaaacggcacactgaggtacatcactcaccagcaccgatttggccatcggcaaagaacatcggaaaatctcatcccggaacccgaacaattttcgttttgggccgacctcagcttcgacaaattctcccctctcctttatttcggcaaaacccccataattctcgccattgtcgtcgctctcctaattggtctcgtagcgctatttttattcgtcaaatattcgcctgtgctcgccacttacagactcatcctccgattgtttgtcgggatttcaatgattaagtcggcaacttcactaccttcaaatttcancctcggtccacccctcccccccagaattaatccgaacgttcaacgaatcgtnccacccatcaacttcatattttgtcgtttttcc

SEQ ID NO: 33908 - DNA, 1000 bp, Heterodera glycines
aataaaataattggcgtggtactcagtcttaattatattatttaattttaaatacatttcgccaaaagccatataacagcacaattttaaacaccttgtcggccgagatttttaccaaattatgcaaagcaatgccctaagagctatttatgtcatcagcactgaatctgatttgtttgttgcttttattaaacatttcgccaacacgtataaaatttaacaaattcaaacaccatgtcggccgagaaaactccaaaaagtcaatgattcgacttgtgcacattttcgcattaacctaacgaacaaagattaaattaataaatatgaataaatttgaacgcaaattcaaggtgaaattcattaaaattgcccgacttattgaccctttctcaattgtttatccaatcattatctcttgcatccatttaggctaacattagcccctttagtttaatgtatgcgtcatgtacattgccccgccttcttcgcacccatcggtcaataaattcttctctccatagccactcattttcattttctgatttttttctctcaccatgctcgtttatgaacatttttcccctcttcttagatctaagcaaaaattaattccaacaattctcctatccccttagcctgcgggcaagaaacagaaaatatgaccggaaatggaaatgaattaatgagaacagaggatgacgaaaattctgttaatttcatgcatttgtttgataatctggaattgacggattctgaaaatctggccagtctaagggaaattgagaaaatagttgcggacacctcaccaccgccagctggtccatcgccaattgaaagctcagttttggggtttgtgttcatctcacaccccatactgtgggcactggtacaaccggacattttgggcgaacgaaatgagctatcggaccggaaaaatttaagcttagaatcggatcagttggtcttccaagtacacccagtatgtgacgactattacact

SEQ ID NO: 33909 - DNA, 934 bp, Heterodera glycines
aattttttccgaaaagaaaaaggccccaaaaattgagaaataggcacaaaaaaaagaatgaataattcgaaaattttccttttattttcaaataaataaaaaatgtcagtttttgattccctccaaaatattttttagagtttcaaattatgctttgataaaccatgatcatgaatctcctggattactgtagctccattgtatcccattcttccccatttcaatacagtatgcaacagtaacgcctttattccgggaaagaaaatcacacaattcttaggctctctctacccgatcggtctcgtgaacagatactgcccggggggagaggcccgatgtgatcatattatcatccatcatgttcaatcataactgatcaattagtgttgtagtaaattggttttccaatttttcagagttgacgatccaatttccaatttcctggcaattaatacatcgctcaatttctgatttttttcttttatttcgtaatattttctcatttttcttaatttagcttcatttgtatattgctcttaaataaaaattagatttaatttaactaaaaatatattcttactttgacttttatggtaatttggcaccaattcttttttccaattccaaaatgtcttttcagaaatgcccaattccttcgcaaattctttctgtttgccttgaccatataattctttaaattcatcaaattgttcaatgaatttgcgctttttctcctcataaaaactctttcccatctttttaattatatttaattcttttttccatttgtatattttatgacgaccaattcctaataaatttccaatttttctctcaattttgcattggtctttccatttgtattttcctttttccttcacttttctttaattgctttcaattttttaattattctctcttttgctgatcattt

SEQ ID NO: 33910 - DNA, 871 bp, Heterodera glycines
aatgggaagcggcacaattcgaacatcagctggagatcgatgacaaactgattgacccggctccgtttcagcttgtccgcagaacatcgagtgtacaaagtgagaaaacggggaacaaagaaatgccaatgccaagagagaaagaaagaaatgccaagagagagagaaagaaatgccaatgccaagagagaaagaaagaaatgccaagagagaaagaaagaaatgccaatgccaagagagaaagaaagaaatgccaattccaagagagaaagtaagaaatgccaatgccaagagagaaagaaagaaatgccaatgccaagagagaaagaaagaaatgccaatgccaagagagaaagaaagaaatgccaatgccaagagagaaagaaagaaatgccaatgccaagagagaaagaaagaaatgccaagagagaaagaaagaaatgccaatgccaagagagaaagaaagaaatgccaagagagaaagaaagaaatgccaatgccaagagagaaagaaagaaatgccaatgccaagagagaaagaaagaaatgccaagagagaaagaaagaaatgccaagagagaaagaaagaaatgccaatgccaagagagaagaaagaaatgccaatgccaagagagaaagaaagaaatgccaatgccaagagagaaagaaagaaatgcccatgccaagagagaaagaaagaaatgccaagagagaaagaaagaaatgccaatgccaagagagaaagaaagaaatgccaagagagaaagaaagaaatgccaatgccaagagagaaagaaagagatgccaatgccaagagagaaagaaagaaatgccaagagagaaagaaagaaatgccaatgccaatagagaa

SEQ ID NO: 33911 - DNA, 1270 bp, Heterodera glycines
tccaattcgtcaacagctccttcttccatgggcctcggcatatatctcttggttagctcggtttccttcatcttcggagtggtgggtttttgggggtgggggaaatcatttattttgtgtctaatttgtccccacttccctttcagtacgcagggctcatgctgtcaatcaagattattcgtgagtgccgccactaatcatctcgcacaaatttaaattttgtttttacagttacgtttggcacgtgaacggggcgtcgccggcggtgtgggcggagatactggtacagcaactggcagcactcggacaagcagtggacgcaaatctgacgacgacgaatgccgacaacaaaacggcgcctgggaatgcggccgccagcagctctcaagcagcgacagtgactgactgaatgacgcgtggtcggatgagccatgcatggtacaacaacaacaacaataacaacggcatggcatgaagaaaaatggcgatcggaatggacgagaattttgcagaggatactaattaaaaagcatggataattttccgcattaaagaaatgttgtataatgaaattaagcccgtcaaatccaactgatttgtgtatgaatttccacactaatgcatgccatcatttgatattaccaataaatacttttgaattggctttccgcatgttttttcatcagagtcgctgatcattgatcactaagggttgcgtggtattttgcttgtgactgtactatttctccagtaagagaatcagaatctgagtgcaaaagagagaagcgaaaaaacctcatacaagagagaaactgacgaatttatatatcgcttacaaattaatgaaaaccaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcggatttttttttgtgaaaaatggctatattagtcggtactcagccgtccgaaaaaagcgacaaaaacagcaaaaccgttttattttgtaaaagaagagtgtgtgggttggttaatggtacgagaatgcgacagcaaataaaaggggaaaaaagggagacaaaaaaagggtgtcaaaataaaaggaagaaatcaaaagaacaaacaaacaaa

SEQ ID NO: 33912 - DNA, 862 bp, Heterodera glycines
aattctctacaaaaatgctcttgcatgactttttgctaaaatcaactcctgacaagttattgcgccagaactgaaattgaggcctaccaaccaaaaattttctatttccaaaaaaattttgaaaattttttctgaaaatgacaccaatcgatagagcatgaaaaacgattgcttgaaagtggtctccgttttcccccgaaaaatctgcaaaaaatactaaaattcaaaaacctcaaaagtgacgagggggcctagctcgaaaatttctgaaaattttagaaatttaaaaacaccattggatgcagcttttaaaactgttcaaaaagtttgctgacgacgaccagctcagcccaacccccagcgagttattcccgaaaatccaaaatccggttttttgcttttcaatttttagtcacgtgtaccgggaatacggcaggtcgtagagaaaaatgtttgctggccaacttgtagagcatacttcaacttaaaatcctcccagcaagcattttttgatcagaccaaaacccatcgtttcataggctcttaaaaaaacgaaaaagccatttcagcgccgctggcgctcagttggccaccggaccggaatgcccctatttttcccggatgcgccgtcaaaagttacccatgcctgcaaaatttcagctccccccgattagccgttcacgacatttagtttttggaacgaaactccttgtttctttagtagtatataaactagcgtgtgggaattgacgggggcggcgtaggccgttgggttttggatgaagataaaatggacatgctcatttgttattttaaacagacaaacattaattgcattagtgtgaagttttaaagcgctatc

SEQ ID NO: 33913 - DNA, 1284 bp, Heterodera glycines
tgtgttgagtcccagagattgacatgctggtgggttgagtcccagagattggaatgccattgaaagttggtggttaagtcccagtgttggaatgccagagatttgagtcccagagattgaaatgctggtgagttgagtcccagcgattggaaagcctgagaattgagtctcagagattgaaatgctggtggattgagtcccagagattggaatgccaatgaaagttggtgggttgattcccattgtttggaatgccggagattttagtcccagagattggaatgccggagaattgagtcccagtattggaatgctggtggcctgattttcagtgattggaatgtcattgaaagttgttgggctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtgtttggaatgccggagatttgagtcccagaaattgaaatgttggtgggttgagtcccagcgattggaaagcctgagaattgagtctcagagcttgaaatgctggtgggttgagtcccagagatttgaatgacattgaaatgctggtgggttgagtcccagtgtctggaatgccggagatttgagtcccagagattgaaatgctggtgtgttgagtcccagagattgaaatgctggtgggttgagtctcagagattgaaatgctgctggtgggttgagtcccagagattggaatgccattgaaagttggtgggttgagtcccagtgtctggaatgccggagatttgagtcccagacattgaaatgctggtgtgttgagtcccagagattgaaatgctggtgggttgagtcccagagattggaatgccattgaaagttggtgggttaagtcccagtgtttggaatgccagagatttgagtcccagagattgaaatgctggtgggttgagtcccagcgattggaatgccggagaattgagtcccagtattggaatgctggtggcctgattttcagtgattggaatgtcattgaaagttggtgggctgagtccccaatgtttagaatgccgcaga

SEQ ID NO: 33914 - DNA, 1314 bp, Heterodera glycines
  misc_feature (119)..(119): n is a, c, g, or t
  misc_feature (128)..(128): n is a, c, g, or t
  misc_feature (222)..(222): n is a, c, g, or t
  misc_feature (1124)..(1124): n is a, c, g, or t
  misc_feature (1132)..(1133): n is a, c, g, or t
  misc_feature (1138)..(1140): n is a, c, g, or t
  misc_feature (1154)..(1156): n is a, c, g, or t
  misc_feature (1160)..(1160): n is a, c, g, or t
  misc_feature (1166)..(1166): n is a, c, g, or t
  misc_feature (1181)..(1182): n is a, c, g, or t
  misc_feature (1184)..(1184): n is a, c, g, or t
  misc_feature (1186)..(1187): n is a, c, g, or t
  misc_feature (1189)..(1190): n is a, c, g, or t
  misc_feature (1192)..(1195): n is a, c, g, or t
  misc_feature (1198)..(1200): n is a, c, g, or t
  misc_feature (1202)..(1207): n is a, c, g, or t
  misc_feature (1209)..(1209): n is a, c, g, or t
  misc_feature (1212)..(1215): n is a, c, g, or t
  misc_feature (1217)..(1218): n is a, c, g, or t
  misc_feature (1221)..(1223): n is a, c, g, or t
  misc_feature (1227)..(1227): n is a, c, g, or t
  misc_feature (1239)..(1241): n is a, c, g, or t
  misc_feature (1246)..(1249): n is a, c, g, or t
  misc_feature (1251)..(1254): n is a, c, g, or t
  misc_feature (1257)..(1257): n is a, c, g, or t
  misc_feature (1265)..(1266): n is a, c, g, or t
gaccacataatgtgggcagggaaagtcctaaaaaatttaaaaaatgtaaaattattatttaaaataataaaatagatatttagccaaaaagtacatactttcaaaaaatttgttttttnagtattatntacggaaaaaaatgaaaaaaagttttgcgcttctttttgtcacaaccttttgaaatttccgaaattttgcaggcaaattaatttaaaaattttncaagagaatttactctcattttaaaacgtttacatttaccatttgccacttgggtgttcaatttgtggctcaattccatctttgctttcccaatcgttgttaccagcaattgtataccatggcacattcaaactgccataattgtacactttagtaaaattctataaaaagaaaaccattggtatttatataaaaatattttttttattaaaaattcttttcccgtattaaataaatactttgtggtatagtttgttttataaattatccttaattaacaattaattacctgttcaaaacgctctgcaacatcctcttttgttacgccttcgtcgtaaaaattgtcgccaacgttcaacaaaaaatggggtgccatttctccagaagcaattttatacaattcttttttcgactttttagaagcaaacacttttgtaaaatcctataaaaacaatttgtttaatttttacaaataaaaattgataggagaaattaaagaatttttatatcaaaattttagttttttttgttgttaggattaattaattaattattaattacttttcgaggtgtcactccattactcgtagcaagcgaatccatcgcatttgccaccgctttttgtgccacagttggacgataatactttactaccgtaggatttttctcacaatcagccaccgttccttaacttacagtggtcacatatgcgtttaagtgattattgtatattcctattttattttctctcattttaaaatgttattttgttctccctcttcaacttaccgtgtccttccaccgtacactgctgctgtttgccctctaccgtatactcctccccaccgatgtcaccgatgacaaaaaagcgcaaaacatttccctccgcagaacagccattnttttgcgnntttgnnncctttgtgcctttnnngccnggttgnttttcggggtcggcnncngnngnntnnnnttnnntnnnnnntnccnnnncnntcnnnatgngtttcataggtnnnggtannnncnnnnttnttattttnnattcttaaagggtttaaatgcaaaatgaaaatttctgagtgaattaat

SEQ ID NO: 33915 - DNA, 791 bp, Heterodera glycines
ccccccccccccccattctcaccacggcgacaatcatttggagggattaacgggggaagaataatacggggaggaagagaaatgagtaaatggggattaatgatgaattgggaatagtgaagtgaatgaatgtgtgaacagttgacgggggacgaaaaggccccgcaaaatgaaaatgccatgcccaacttcagtttttaacaatttgcatcaaattttgcactttttcctaattgagaccgggccgactcgggcacccgacggactttttgccgtgccgcccaggcctgggccaggtaaattttgaaaaaaacaccgggccaggggctgcccagttaaacgagtttaggcttttaacgggcccggtcaaactaatctcatgctgtacgaacaattttcaggtaggctttccacttttagtccctcccgccatagacttttcagcggatttttgtaactcggttcagcattttcagaactgttcgaagcatttgcaggaagtcgacactttccaatgtatttttgtgcaaaatttcatgctttttcctgtatgtaaaattgtgactcactcaccccaaatccgtggaggaaagatgcggcggcgaacaccgtcggatgaaagggcggcggaggtaaaagggaggaggcgtatgaggaggggggcgaagaggcggaggaggacggagccgggaaaggcagcggaaaacgctgaaatgccgtgccgcgcattttataaaacaaaagaatgtttaaaatgccacctgacactccaacgaggggaacaacggacg

SEQ ID NO: 33916 - DNA, 1554 bp, Heterodera glycines
  misc_feature (1528)..(1528): n is a, c, g, or t
gtcagaacgccaaaatcgccgggtgccaatccgatcgcccgtttggacgtcctttactccagcgaaacccccgcagtgcgtctccaatggattctcgccccgttcgaatgcaatttaagtcccgaaactcactttttccaaagtgcaggcacataaacgccgtgttggtcggaggtttcgatgtgtttttcactgatcgctacgacctcgccgaaagcgaatggacccaccgacgaatccacgggaatgacccccaattgtcgttggactcgctcagcccttcgaccacttattttgttcgaatcgatgttcgaaattcggacggaactgtcgtaaaaagccaatcagcttatcgcttcacgacattcggttggttcggcaaaatttgctttaatcgcctattaattcattaattgaccttaaaagagactttgccgcttcgaagagattttcggcacatcgacacattggcataccaacaaattgggcctggccgaatgcaaatccaatgggaattgccggaagcagtaaaaatgggatcaaatggtaattttgaaaagggaaacggaaataaaaggatcatttagggatcgtcatcttctacaagtacgcgttcgttttccttctttctttttgattttttgcactcattctcagttcggacactcgcgaacctttggaccgatggcaccgaattgacttggaaaattccgaaacggttcagatcattggacaacattggaaactatgaagagataaaccaattaagcgatcacttgaattaattggcctgagagagaacgcggaataccaagtgcaaattgtaccgaagagcatggacggaatgccaatgtggacacacgcacaacgaatacagctaaggacaaaggagacggaagaagacgaaagacgaatggaggagatgaagcggaggatgaggcggatgtgaggatgaagggaaagagagattggaaggaagagagggaagaaagattggaaggaagagaaagagagggaagagagattgcaagaaaaggataaagagaaggaagagagattggaaggaagagaccaagagagaatgagttagagattgggatggaaagagaaacgagacgatgagagatggaagagaacgatgaacgaagagaggacgaagaatgagtgaaaaggaagatggaacgtgaaggggggaggggatggcattttatgtcatacatatcgaaaatgaattgtataaacaaactattgtaaagcaaatgcctttcttgggccaattaactaatccgctgcccaattagtccattaattaccccccccccccctctgcttttttaatctttccctgttttttcttatcagaacggtgcacaaacaatctcagatacattcattcaccttttcaagaggaacaaacaaagcaaattattttttgtattaattattatttttattttaattgcctttgcgctttttccgtcccttcgaattgccatctctcccgcgtccctcccaatggatgcccttnccgctgaactcatcttggccattttg

SEQ ID NO: 33917 - DNA, 1297 bp, Heterodera glycines
  misc_feature (117)..(117): n is a, c, g, or t
  misc_feature (328)..(328): n is a, c, g, or t
acctttccggttatctatgtaaaatgatctttttgagcatttccggttatttacatgaatttcctaacatttacggttattggtaaaaaaattatgatttcagaatttacggttatntaaaaattatgattttttacgaacatttccggttatttatatgattttccaaacatttccggttattgtataaaaatgatcccatttcgaatctttccggttatttatataaaaacgatcttttaaagcattttccggttatttacatgattatccgaacatttacggttatttgtaaaaaaaaatatgatttttcctaacactttccggnttattgtataaaaatgatcccttttcgaacctttccggttatttatataaaaacgatcttttaaagcattttccggttatttacatgattatccgaacatttacggttatttgtaaaaaaaaatatgatttttcctaacactttccggttattgtataaaaatgatcccttttcgaacctttccggttatctatgtaaaatgatcttttttgagcatttccggttatttacatgaatttcctaacatttacggttattggtaaaaaaaatatgattttcagaatttacggttattgtataaaaattatgattttttacgaacatttccggttatttatatgaaaatgatccttttttcgactaagggctatcaaaagatcttaaaatgtttgcactttaatagccctcttcttctcctcctcttcacccaaacgtcgtgctaggcggtgcggtgcatctatttgctcttcgcattggtcagttgaattgtgttgcgagaggagggattataaaattggggcagctgtcaccacagcctccattagtagctccatttgcattcctaccataattatttgctcttttcattcaactaatttgagatcttgcgattatatttatctgctggttgagcttggtcgcctactatttaaggtcattccttgagtcattgctttccatgacaaacattttcctcttagaaaagactaccagttttttaaataaatcatccaaatcttaactcaaaagctgttaaacccaaaaatattaaacaattaattatttaaagaaataaaaaggaaaatattcatttttaatactttcctaaacaacttataaataaaaaaaaaaaattcggccaaaataagagtttagggatcgcgataaagattaaacatttcaaaaattccaaacccccttactcaaattcgaacaaaaatttcgaaaagtccaaattttcatgtattt

SEQ ID NO: 33918 - DNA, 916 bp, Heterodera glycines
gagtcattgaagccccacttaataactttggcatttgcatatttttgatggcactttttatgtggtaaaatttgaaaataatttctattttcttagcattcgaaagttggccttgacttatttatgaattcattaaaaggtttaattaattgaaaatggttgaaaatgaatggaattgccaaatttatctttcaatttgccaatgttgttcgatgatttgagtttttgcttttgtcaattatttaactcgtatttgacagaatattttttcttctttttttaaatttttcgattaatttacatttttgctttaatgattgattatgcacccctaaatttgagtgttttccatttttggagcctattttagcggtttttagagcctaaaaatggagccctaatgcgtacacgccttaacgccagaattaaaaatattttacgcaaaaggcactaaatttaaaaatcaaaagaccattcgttatttgaaacggacgggacacttgagttccaccagccaaatttgatacattctaagcgacttttatattcgatcaatttctacaaattcggcgtcatttataagcctttcatctcaagaggataatgtataagcaaaagctaaaagatttaacagctcataaaaaattttgctaggcatttaaaattctgaaagttgattggtcaaggttttcagcgataccattttgtatggccaaccaaattctacaaacccaatatcattcgaaagcgctacatgtatagaagagaccaaaatgcctaattatatccgacatttcgccacctaattcttttttaattatgggcgaggaagcttagactaagtttttataagattttgagagatgtaagcctaggcctaagcaagcatgggcttagtcctactgtgccgagtgcg

SEQ ID NO: 33919 - DNA, 1497 bp, Heterodera glycines
  misc_feature (50)..(50): n is a, c, g, or t
  misc_feature (67)..(67): n is a, c, g, or t
acgatgtctatgacaccttgccacttatttttagtgtctttgggaatcgntagtcaacaatcggggnaaatgtggcggattgaatagaatcaccaattcaaccctccggggacggtggttttcttcgatatggccgtcaagcagggcttcagcagcaggaaaagtgcgctctcgactcggccattaaaaggcttatttctgcccattgtctgtcattcgttctttcactccaatttctctccgtcagccattggaaaatccacgggtgtccgtctattctcgaatttaatatttagaacaacttcgcgagagcctacgaatccaaaagcctctccaagtgtattggcccagaaattattatatggatacagtaggtatatattatgttgaattttttttgctctctgcctttttggcgttttgtttgcgtcccgccccctttttctctgatctctcacagggaaattaatcaatcaaatgctgacgtgttacgaaatacaaaaaagaggaggatgtgctgtgttacactttgcacctgtatcagcgatcaatgatgtgcgaagcaccacccagctcgacaagcgttgtttaaagtgaaaaaatcatacgaaaattccaaaaaatatatttttacggtaggaattctaaattttttatattgatttttatggtgccctcctcgaatttccaaattcaacaaaaatattaaaatgattgatagtgagtggactgttctttagcaattacctaattcgataattgttggtgtcctggtactccccctcccccgttgcaaactaactacctaatttgcataattaaattggggcctcttttcatgaatgccgccgattggcatgtcctaccaaaaatagacattaattaacacaaaaattaacgacagcaccaaatctctgttataataagcattttgagtgcaaaatggccggtatcgcagcaggaagactgacggaggagcggaaagcctggcgcaaagaccatccattcggtttcatcgcacgacagtgcaaaaaggaggacggcacattggacctgtaatttttttgttttgaattaatgttcgaactagccctaatctcatatatttggatattatacagtttgtaatccacttttcatctaaatttcaggtacaattggatctgtgccattcccgggcccaagtcgaccatttgggaaggtggtctgtacaaattgcgcatgatcttcaaggacgacttcccatccacgccgccaaaatgccgttttgagccgcctctcttccacccgaatgtttatccgtccgggacggtctgcttgagtctgttagacgagaacaaagactggtgcgcaacacatcgcggtttttaatccttggcttttgtttgcagaaatcgaaacgatttttcgggcattaaaatgaccgctcgtataatttttattaaatatatattttgtacataggttaggcaatatccaagcggtgcttatactcgt

SEQ ID NO: 33920 - DNA, 1293 bp, Heterodera glycines
tcaagatcatccacaaactgttccaattgttcatacaaggaattgcaacccgtacgtcttattcctcgtcactgttcctccggcgagacggaagggaaagtacagatcagatacccaaaaaaggaaaaaaccactggagagtcttgtcagatttgacttttttaaaacaacaaggtaaacaaattgctctacacaacaatatgtaaaacacgatttaatttgattgattgtcgttagccatgttctgatcatcattaccacttccgatcacttccaactgatcactgccgtccttattggattgatcaccgatgctcatgttctggacatggttgccaatctcgcccacatttgactgatcactggtgtccttgtttttgttgtcctttctattttcgatcacttttgactgatcaccgatgcttatgtcctggacttgattgaagatttcgcccacatctgactgatcatgcttctccattctggtcactttcaatttcgcttcttcacacggttcatgcttaatcatcagcaactgtttcgccttctcgggaagcccaaccgtccttggttcttggattttgtacttgtaagaccataacaatgagcccaagtggtgctccagctcaacataatgcttaaatccgttttgaatgccatttttcgtcaaattggataagctttttcttgaagattgaattttgtgctgaattaattgcgcattttcagccttttcatcaacgtgttcgtcctccctatatgcatcacatattgttgccatgtctaaattagagcccgaaattcggataaaatgcgattttttgggcttctttcgccataagtaagccgcaaaaatatatatatatatatacataaaatccggtctctacatataagcaaaaaatatttaattaaataaaatgcccagccctactgatcatggtaaaacttgcctaatcccaattcgttggtattgtcccatattttctgaatgcttttgtgaatccctgtgaaatttggcacttgagattgcttcaagtcgaacagttgccatagaaaatcaaacaacacaatacgaaattgttcgacaattctttgtcgctccatttgttcctttatttcttcgtatattccagcaaaattcgctttaaattattttttaaaaaatgaaaaaaaattgttaacttacacagtccaacattttgtaaaagttctgcctgccattcatccttattcgccaagtacatctaaaatttttgtaatgctcgaaaatcgaggtcgaaaaatatcgga

SEQ ID NO: 33921 - DNA, 1159 bp, Heterodera glycines
  misc_feature (121)..(121): n is a, c, g, or t
aataataaatggaaaaaaaagttggactgtatttatattgattttcaaaaagcatttgactcagtgccgcatgaattacttttatacaaattggaaaaaataggtataaggggcaaacttntgatgtggataaaggactttttgagtaataggacttttcgtgttaaaattggggatgatttatcctccagtaaaaaagttggctctggcgtcccccagggctctgtccttggacctttattatttttgatttatattaacgatcttcctgatgctttgccatcaggagtgaaaataaaattatatgctgatgatgttaaattgtatatatgctataaagcaatagcagatacagaaattatgcataaagcattgcataatttatcagaatgggcaaataaatggcaaatcagaatatcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatctactaggatttggattattttgtacaaaacttatgttagaccgttattggaatatgctcctgaggtttggaatccatctcttctaaaaaatattaaaaaaattgaaaaatgtcaaaaatatttcaccaaaagagttcttttcaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacactttaacattcccttttatagacttaactcgaaatataaattaggcaaaaaatttataccttttgcggggcgggtaactaaaatttggaagccactctataaaaggatcattgaaataaactcattaaatcaatttaaaaataaaattaaaactatctctattcccgtaaaatagaccgaaaaagttaaagtcgaagttttaatccattcaaactataagtgatttg

SEQ ID NO: 33922 - DNA, 692 bp, Heterodera glycines
  misc_feature (651)..(651): n is a, c, g, or t
  misc_feature (665)..(665): n is a, c, g, or t
tggacctggatttcctggacaaaaatccaggaaaatccaggtccaggaaaaatccaggttgccgaaaaatgacctggacctggatccaggaaaaatccaggcctggatccaggtccaggccgagctctaattgtcatgtattcatctcgctgttgtcatttcattcatttgtattttcacactaatataaaaaatttctttattgttttggcattgaattgtactgttcctatagtcaggtcaaaaatattgcaccaaaattttttgaaaagtttgattttctcaaatgaataagtggaaaaggtctaattttaagtcgaaattctcatttttaacgattaaaaaacaagccaaatttagagtcgctaaccatttcaacatcaaaaaatggtcatttgtactgatacgaacattagtgatttttgaaaattttgatttcgacttttttgttcgtctagggttcggaattggtcaaaacgggtgtcattttccccgaaatttgttcagtggcgatttttgtaattaataagctgtccaatatatatagttgtaagaccttttgttgtatgatttatttctgcaatgataaaagtgtggaacgaatgaatgagcgaataatttgatttattttgtgatttggtcgagcggaantgctactgtctgtntgtgtggaccctgccaggccatgcaag

SEQ ID NO: 33923 - DNA, 810 bp, Heterodera glycines
aattagatcccacaagaaatgtttagaaccacttcactaatttgatcaattgttatacaatattttactattatctttttttcagacagcgctttgcttccggcctcagattttgacatttcaacttctcattaatgactcatttccttatttacggtcttggtcttgggtagggccaggtgggaacgggattcctcgggaaaacctggtcatcttttttcagtgaccggatttttcggcaacgggaaaaaaggatgggaatcctctcccgcttttttcctttttaatttctctcaaaaatgactataaaaatacaaattttccccggcaaacgcctaccggcaccgctggacacccccctggtcccgaaaagattttggtagagacacgccgcaaaaaagcgattaaacccaaaaaaaggattttggcaattaattgaaaacgtagaaattctctaagttttttcggcattgaatctttttggattttaaatagataataaacaattttaacgaaaattatttaattattaaaaaaaaatctagaaacttcaaattcagaaaattaccagtttttgccagtactgtggaaatgttcgtacttgtttatttataataattaattccgaaaattcaatttttattaaaaaaattttgtcattaataaatagtaatcttttaaattattaaattatattttgtcatttgaaaaaagcaaaaacattctgaagaatcataatttttcagaaaaaaaatgtatttttctcgatttagcttacatgctgtgttttgcggaccccctcctgctgtg

SEQ ID NO: 33924 - DNA, 952 bp, Heterodera glycines
  misc_feature (19)..(19): n is a, c, g, or t
  misc_feature (843)..(843): n is a, c, g, or t
  misc_feature (855)..(855): n is a, c, g, or t
atttgaagatatcaaattntgcttggaggatggctggctataacatagacttaatgtaactactccaaaacaaggtgcagaaaaaagtaaaatatttgattaaaacattttcctcctatttattcaacgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataattgagaaaaattgaaatgttgagggggtttaagcaacaacgtgttaatgttatgaatgataattaaccacattgcatacgattaaacactgtggagtaattagagttatttttttaaatgtctttctaaattttgactatttaatataccagcaaaaggaataaaaaatttgaagatatcaaatttgtttgaggatgctggctataacatagacttaatgtaactgctccaaaacaaggtgcagaaaaaagtaaaatatttgattaaaacattttcctcctatttattcaacgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataattgagaaaaattgaaatgttgagggggtttaagcaacaacgtgttaatgttatgaatgataattaaccacattgcatacgattaaacactgtggagtaattagagttatttttttanatgtctttctanattttgactatttaatataccagcaaaaggaataaaaaatttgaagatataaatttgtttgaggatgctggctataacatagacttaatgtaactgc

SEQ ID NO: 33925 - DNA, 188 bp, Heterodera glycines
ctgtgcttagaccaggggcggtgggcgggtacccttgaggtggcaaggtcacactgctcatcagaagtttctcactagggtcttctctggcccagcctttgactgaagctggtctggagacaggggcgttagagaagtgactcatagatggcctaaataagcggggccactcaaggacccaggacagg

SEQ ID NO: 33926 - DNA, 69 bp, Heterodera glycines
agaaatctcgtcaaatctgcattccttcttctcgatggttcgtaatgcactttgtttcttggattcgta

SEQ ID NO: 33927 - DNA, 886 bp, Heterodera glycines
ttttggaatattttacgtgtcaaagggtgtgcatttaccctactcgctgtgcttgcccactgcatttcaaatagctggtaatttttatttctccggcctaatccagaaaaaatcactatctctttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttccaatagctggtaatttttatttctcccggcctaatccagaaaaaaatcactatctccttttttttg

SEQ ID NO: 33928 - DNA, 93 bp, Heterodera glycines
tttaaggctaaacaaataagccgtattgtgatgcatttgccaacaattattggccctaattcagttatgtgtccaattaatgccattcttatt

SEQ ID NO: 33929 - DNA, 669 bp, Heterodera glycines
ataaggtcattggctggtacttacttatgctgcttcgcccgttttttgcttctttcggttttcgttccctattaaatatttttatgctaaaaagaaaacaaagccgaaaaagggcggcttatttaagcaaaagaatgcccaacagagcaaaactccgtccgccccccggccattcgctgggaatgaccttgggaagagagggggaggggggaagaggagggtcatcaacacaaagccaatcgaaaggaatcccccgctcacaaatcagccaccaaaagcagtagcagaacagacactttgctgatcattttgtgaaaggtggcgaccgaaagagaaagctgaaaattgcgcgaaagagagacactgcccacaaatgttcctcgttttgattaacgcaatttgacagaaaattggctaataaataagagaaaactctcgttgtctctcgccctctcctctctctccctctctctcttctctctctcttctctctctctttttctctctctctctctctcttctctctgtctatgcttcccttccttctctcattcgtttcttctctttctcctccgttctcttccgcctttcccttttcacccgtcatcacatttttcttcgtcctccaccatatttggagaattccgttttcggctcctttcacccccc

SEQ ID NO: 33930 - DNA, 954 bp, Heterodera glycines
  misc_feature (834)..(834): n is a, c, g, or t
ccctctctctcctcctctctctttctctctctctctttctgcctctctctcctcctctcactctcgcgttaattccattcccggctctctctcatctcccttttctttttgatgacacccgcttcttcttctacttcttctttttctcgtgcttccagtcgatccacctgccaacaactgtgacataggcagcagaaatgttagaagaaatgtgtgaatggcgggaaggtcaaagggaagcgccgccgggcacaccccgggcacttttgacactctctccaattgccaatgcttcaattggcactctgccaacacatttcaatgccttgcactactggtacacataggtataataaatggaataccttgtactattacattccattcattaattaagctttgttcggacggagttgcccccccccccccctctgcctgccccaatttatcattttgcgtttgccatttcgtttattgccaattttaattggcaacaacactcgcacagagcaaatccacacttgtgcatttgcacactctttgctgtgctgctgcgcttttcagttcagctttttttttctggcactttttttgctgcctttgccgatccttccgagaaaaacgaaacggaggaaatggcagcagcgaataatttgaatttgaattgataattaattaattaattggttggttgtcgacgagacaaacggaagggggaaaccaacgagaacgaattgctctctgcttttttggacaaaatgcgacagtgcaaacagaaagttgacgcggagtttgatggaacagccgggaaatgctaaagatggctgctatttncatgctattcaaaaaaactttgaaattgatattgaggagaaaagtgcatgctaattaaaataaaatttaacatttttaattatttaaatctttaaaatattgtttgaaaaaaagtttttt

SEQ ID NO: 33931 - DNA, 94 bp, Heterodera glycines
gtggtgattttttgtgtttgtttgtttgtgtggcgttgtgtggtacacaattattatgtacacacatatgtacattgcataggtaggtacatac

SEQ ID NO: 33932 - DNA, 913 bp, Heterodera glycines
tatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctcttttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggcagtgcacaatcgccattttatttcacagaggatttttatatttagaggttatcccagaaaaatggctatctctttttttgataaattttatacacatacaaatgctctcgagcatgatagggagggcggtgcgcaatagacattttatttttgagggaatttttaaatttatactctatcccagaaaaatgtctatctcttttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaat

SEQ ID NO: 33933 - DNA, 886 bp, Heterodera glycines
  misc_feature (791)..(791): n is a, c, g, or t
tttgtcttattgtaatgttttagtgtttatagatataatgaaagtgtgcgaaaaatatgacttattgtactagagaaacataattgttgttttccttttccaataaaaaataataaaatatctcatttttattaagttaaataccaaattttattatttgcaaattcaaatgaatatacacttaaatggaaattatttttaaataaaaacccgctctgatatgtgggtacgcgcagacattctcttttcggagatggtcccattaatcgatggccaagaaaattgattggaaaattaaaagatgtgaaattaaatgacaaaaataaatttaaggacaaaaccaaagtcgcgaaaattaatgcaaaattaaggacaataaatatattctaaaattttagaaatttataagaaaagagaaaataacagtaattgaaagaattgtttaaatagttttaaggagaatttgaaaaattgttgtgttcggaacacattatttttgtagttattagtttacttttttttaacataatttttttcatttgaacatgaataatgatatatttaaaataataagaattagcacgtatttttataagcatttgtgctactaaatttcaaattgggggggggaagagaaagacaaagaaaatgatgcgcgattgggagagagaaagagagagacgagagagagagagagagaggaaaaaagagaagggagacgatagtgtagagaatgccgcattttcaaatcttttggttgaaagtttctaaaaccattgtaattccattanattttacggtattccggacccgatcaccatatttaaagtcaaaatcaagtgaatttttcaaattggacccaaaagccaaaaatagaacatttttg

SEQ ID NO: 33934 - DNA, 787 bp, Heterodera glycines
aatcccgcgcgggatcccgtcccgcgccggtctcccctttagcatcattacacaccccgcttaaatagcaaaaaatactattttatagaattatttagtcgcctttgcaattgtgcgggcgaaaaagataaagagtgagatttttgaggatttttgtgcataattaacacatattctgacattttagcattttttataacatatttcaggatttttagcacataaaaatcccagctctaattatttgatactataaatcggcgggatcgggactcccgttggatttttacgagattcccgttcgggactcccgctcccggaaattttttttaccggactctatttgataccaaatgaaaccttcaagcctacagaatttttttgtataactaaatgtagtgttaaaggcaacaacaaaaaattcattttctaggtttttaatgcaaaattgcaaaatacgcattaaatgccacaaagtcgccacttaagaaattttagcccccgcccctctccgatttgcaattttattgtttgttgctcaatgttaccaatgccgtcgcattccacgccttccaaaggaagttgtcacaaatgagcgcggcaattgccgctcaagttcttcaattcggacagaagaaaggacagcggagaacaattctggttccattaaaaattaatttccacctgtaataaatctctgaaaaatttagaggtaaaagcattttgatggcaccccctttaaaaaaattccaccatataaaaacatgtttccttgttcctggggttt

SEQ ID NO: 33935 - DNA, 956 bp, Heterodera glycines
  misc_feature (815)..(815): n is a, c, g, or t
ttttcaattttttttttcttttttattgtcgcaattgcttttagattaatggaaacgcttaaaaattttaaactttatgatttattcaaagtattggctctaccagacaacgaattcgaaaaatggctcaaagaacttaaactcctacacaccacccgtttttgcgactgtggcacggaaatgagctacaaatggattaaaggacgtcaacatcaaggatcctgtcactggtcagcatacaaacacaattgaatcgacgtggcagaagttcaagcagcaacacaaaacgagatttggcacgcaaagatcataccacttttttccacatacatttctgattttttgtggcgtaagcaatttggaggaccggatattttttataatttgtggacccaaatcgcggaattgtacccaataagcacataaatctccttttatttgttatttaaagcaattgcgacaataaaaaagaaaaaaaaaaatttaaaaaatttgactcaaaaggcggatacaaactgaatgagtgagtacctgctaataaaactctatttaaaattagcaatttttctcaccaggatcggattcatattgcttggatttccgcttccatgcttggaagaattttaactatacttatttccaagattgtacttggaaatcggcatttctgaaaaggtccattttatgaaaaaatttttggaagaatttttgtcagaaataaacactgcattttttagatttcaagaaagaatgctaaaaaatttctgaataattcgcaataaatcaattaaagcttaacccattttcacctttanatccataaattccccggcggtacctttggcccgccggaccagcctccactttcaagccctggtttttttctttttcctcattagctcatcacacacacgctgtctctctctctctctctctgtctccctctcgctttctct

SEQ ID NO: 33936 - DNA, 234 bp, Heterodera glycines
cgcgctacctgaccatttccgccgtgctgggcgtggtgttctgcctcggcgcctgggtcacccacggctacgtctcggtgggcttcgtggccgcactgggctttgccaacgcgatgatgtggccggcgatcttcccgctggcgatccgcggcctgggccgtttcaccgagaccggttcggcgctgctggtgatgggcattgccggcggcgcgatcattccgcagctgttcgccg

SEQ ID NO: 33937 - DNA, 1248 bp, Heterodera glycines
aataaaaaattattgtttactaatttcatctatatggatggagatttatacaagaaagaagaattaaaaaaaggcaagaagcgaagaataataaaaggaaaattaaattgtcacaaattaataagtatttaaaataaaaaattgttaataagtatttttcatcaaatttacatttgggaggaaaataaataaatttaaaaagaaatgcaattaaaaatgtattgaatgtcagttaataaaagttataaaaaaaattctaaaaatatattttaatcaattcaaaaaaacaaaccattttttaaacaataattgaaacaattaaataaatgtaagaaataaataatcagaaaacagaaaataaatttaattttttaatataaaaataaacacttaaaagtacgaaaaaaaagaaagtttaattttcatttgtttaattcaatcgcttgaaactgctgatgttttggtgtgggctttggcggtgaaattggatggatttcttccaatcggcccccttaatttgagttgatggttttataggagtcggaggggggggggggggggagacaaattgttttcgcaacggaggagcaatttttaattcgatcgatctattcaattcatcacaatttatcggaaaaatttatgtggtggcggcggtgtcgtagtacagcagatatgtacaaaaataaaacaccacccctccgcagaaaaattgaacaaaaataaatttaaaaaataatttttaaatttgttaccgtacttcttacagttttctggggggggggttaaatgacctgggaaagattaaataattttaatgaaaataattatttgaagaaaactgaagttatgatttatgtctgtaatgcataaaaaataaaattctggcgttggccccttcaaatttaatgaattttcgaaaaatcagagaatgcaaatcaaacctcgtttaaaccaaaccaaaaaatttggacatacaaattaccctcttaaaatttgaaaggagtatcattcagagataatttgtcattgatcaggtgatctcactaattgtgagttttacgtgattaaatacattatcaaatcaattaaataaaagtaatgttcattcaatttaagattaaacggcttttcgacatttttaaattatcatacatttattatgtattggaatcgaatttaaaacaggcaaatccatcaattaaatatcccaaaattggagtaaaaggaataaaaacctcccgcaaa

SEQ ID NO: 33938 - DNA, 202 bp, Heterodera glycines
tctagagtgtgatcacacatttttaactccaaattcatttcctctccagacctgtatttttcctgtacttttgtacagaaaacccaagtacagtctttttactacaaaataccgagcttattaatctatataagtgaccttatttttggcaaatgtttatctgagctcccaaactcaaaaacactgagccgagtgggcgctg

SEQ ID NO: 33939 - DNA, 1490 bp, Heterodera glycines
  misc_feature (826)..(826): n is a, c, g, or t
  misc_feature (1377)..(1378): n is a, c, g, or t
  misc_feature (1387)..(1387): n is a, c, g, or t
  misc_feature (1389)..(1389): n is a, c, g, or t
  misc_feature (1399)..(1399): n is a, c, g, or t
  misc_feature (1407)..(1408): n is a, c, g, or t
  misc_feature (1442)..(1442): n is a, c, g, or t
  misc_feature (1463)..(1463): n is a, c, g, or t
  misc_feature (1485)..(1485): n is a, c, g, or t
atgttatttaattaagaataatttttagattttcactacataaaaaataacttagttttttgcagcttgatttaaattatttattttattgtagcaacttggtgtaaacgtgccaatttttatattgcgtagctcacatgcaattggaatgttatttaattgaagaaataatttttagattttcactacataaaaaataacttagttttttgcagcttgatttaaattatttattttattgtagcaacttggtgtaaacgtgccaatttttatattgcgtagctcacatgcaattgaaatgttatttaattgaagaaataatttttagattttcacaacataaaaaataacttagttttttgcagcttgatttaaattatttattttattgtagcaacttggtgtaaacgtgccaatttttatattgcgtagctcacatgcaattggaatgttatttaattgaagaaataatttttagattttcactacataaaaaataacttagttttttgcagcttgatttaaattatttattttattgtagcaacttggtgtaaacgtgccaatttttatattgcgtagctcacatgcaattggaatgttatttaattgaagaaataatttttagattttcactacataaaaaataacttagtttttttgcagcttgatttaaattatttattttattgtagcaacttggtgtaaacgtgccaatttttatattgcgtagctcacatgcaattggaatgttatttaattgaagaaataatttttagattttcactacataaaaaataacttagttttttgcagcttgatttanattattagttttactgtttacgggaaatcgatgcaattgctgccgcttcttcatcttctgcttccttctttcctttcttctttggcttcttcttctgcgaaacatccaaataggtagttgcagccgaaacactctcaagaaattcatccagaatttcttcgtctgtctgttccttctgtttttcgatcggaggttgctgcttaggttgttcattgctcctacccattgttgcggcggaaatggcagaagcaaactgagaggcgaccccttgttgctgttgtttcatctttggcttgggtttttctgcaccaattcccatggttgccgctgaaataggtccaaagaaattcgaggcgtcggtttgctgctgtctcggctttggattggttttcttttgttccacatccattgccattgtcgctgcggcaattggcgaaaagaaatcagaagcttcggaacggttctgatgtgtcggttgttgagttgacatttgcccaaagtcgagccccgttgttgccgccgaaatagaagaagcgaaatttgactcctgnngctgagttngntgagctgaangattgacnngtagtgcgccaaattcaactcccaaagaggcttngcgaagagcggaaaagaacgnccgggcgtccgctttgtgctgntcctg

SEQ ID NO: 33940 - DNA, 1297 bp, Heterodera glycines
aatggacatgggtgaaagttggcattcattgaaataaaataaattcaaattttagattaaagatgcactattttttgaatttgtcaaaggattagcgacaaattttgagaaattttttaagatggctaacgaatattcaaattatttacgtcagaaagggaattttgatttttggtgatattgataatataatcatgatctcttctgggttaaacgaaactgagaaaatgaaagagcatttgaaacaaaaatatgaagcccatcttggcgttatgtatttgatggcagagaattggcaatgtgacaaaattgctcatcaattaactgcaaatgaaaatggaatgaatgtcaaaaatatcgtaaatatgtggacattttctatgaatattttttccgattgtatgcttatggtttgtttgatctgtacataattttgaatttgtctttttattaaaattaattatgataataatttattaagctaaaaatttgaacgtgtctgaacaattggtaccattgatgaagccattacttattacagaaatttctctggacagtttaattggagttatcaaaaatttgaattatatttcgaaatgtttttggcaaagagataaaaatgaaccatggaatttcaattattgggagatggatttgataaatgaggatgaattaaattatgaaataaaagaggagaaaagtggggaaaatccatcaaaaaatgaaattgaaaaaaattgcaaaacttcgtaaagaatttgaacgaaaaatgaaaatatttgcaaaaattccaagcaaaatgaactcctagcaaaagacaaattggaaaaagcaatggaaaatgcggcaaattatgaggaaaaagaaaatttggaaacagaatattatgacaaatttgacattttaatttcgtcgcccttctcatgaaaaaattctttttttttacaaaagtttcttttctgtttttttttgtttttttttctttttcctttcgaatgcttctgtctttttcagttttttattttttgttttgtcatttttctttaattttatatttataaatttcacttttagatggatcttctaagtctttcttttgtatttgcgcctattttttatttattttcttagaaaaaattgattttaaatatctaaaaataggtaataattaaggatgatattttcaggcaaaagtctatttttttcctgagctccccgtggcctgaaacatacgaaaacatgattttttgggctgtagtgaagctacttttcgacttattaatgcctattttctagg

SEQ ID NO: 33941 - DNA, 1046 bp, Heterodera glycines
  misc_feature (20)..(20): n is a, c, g, or t
  misc_feature (1005)..(1005): n is a, c, g, or t
tttgaacaaaaaatcataantttgaaaaattcaaaatttcgatttttattcgagttcgggttagggattagaaattagtcaaaatacatgtcagattcgtgattagcgacctttaaaaccccggataaaaaattatcatggttttttatcttaaaaaaattttgcaaaacaaaagggtccccccttttgtttcaaaaacggccacttttagattagcgccgaaattccccccccccccccgacactcatttttcaatttcataaaacatttcctttctcccactgaagcggtgctttttgttctttggtttggggtatttttggaggataaaaagaagggggatagtgacgtgggagggaatctcttctctcatccctcccctcccatttcccctctctctctctctctctctctttttcccctctctctccctcttttcccttccatttctcctactctcttcccctctctcttcccgtctcctcattatttctcgcatttcctcccctcccccttgcatttgcagttcctccctttgctctccctcctcctcttccgttgcttttcccgcgaatttcccccctctggccatgtccgccgtctctcccccgtgctcgcgccttccgtccgtcttttccaccttcaattccgagcagtccagcggccagcactcgcgggccgagagctgtctcgaattggaagcgctcgccgccgtccatcgattcgcaggaattgtgcaggaaattgctgtgtccgaaatggtgcccaacgccccctccccctctcacttccccttccgttcagctcccccgcactgccgatttgatttttgtgaatgtcaccactttggagggtccgtccgccgtttgtttggcatttcgtccatttccgtccctttcagcgcagccgttttgtctcgaattgacggcgaagggatggcgcgtcacttcgctgcgtaccgattgcatgcagggcgacttcacccgcatggaattgttcaccanttactatcaatcgctgcatcagttgatggacgcaatttcac

SEQ ID NO: 33942 - DNA, 1311 bp, Heterodera glycines
  misc_feature (32)..(32): n is a, c, g, or t
  misc_feature (1163)..(1163): n is a, c, g, or t
  misc_feature (1227)..(1227): n is a, c, g, or t
aaaaggtttttttttgaattggcaaatatttnttatcgatgggaattctttttaattaaattgtaatttttctttgctattccttaaacaaattttctattttaagagaaaacataaaactcaagcatctgagttgccatattactctaaacatatttttgaatagctaaaaacccataaaagcctttaaatttaacgaagactccaaaaacaacaataaattgccaaaacttgcaaccatctcctccaagttacgaggagtctgacaaacgacagcgagagcttttgctgaactaccaagaattttccaaaaaaaaaaaaaatttctgaatctacagtaacaaattactgtaacagtctcccaccatttgctttcttttccgcttcttctccaatgctacaactttgcttcatcaccaacagcagcagttcgtctcgccggtgccgctcctcctctatttctgctgctgtcgtccatcttttgttgctgctttttgtgttgcccgccgtgtccgacgcgtacagttcaagaacaacggtacaacaacactcactacagcaggacacgttactgtacaagcgcagtgagcggcaatgctcggccggcaatttctgccgggaggaggacttcttccattattatggctgcagctttggcatttgtgacttccacctgcaggtcgatcgattttggcacctttggcgtgtttttgtttttacccataaaaatttgattttttaaggacccaaaatcagtgaaagccgtaatttcatacaattattagagcgttgtatttttttcattggggcccaatttttattttgaaatcattttttagagttagttacggaaagaggttctctgatccacccacgaatatggctgctttttgaacattccgaacttctgacccgaattcgaagaaaattcgctttaaatattcgtttttacatataaaaaatgggatctttctttcaacaaaaaatggtaaaatagtggcaaaaatagtggcgaaaaagttctaaatttagggcgtaattttttaaatagctattttttaatttgaaaataatttaaaattaaggcaaacaattttttttattcactgattgcagttacaaaacattttcttagcaaatattgagcaagaaaaaaaaattgnggtaagaatttttgagaaaattttcattcttaggggtgtaattttgaaaattttagtttgattnctaggggtgtattttttgaattttttaggtcgattcttggggtattttttcatttttattgcattttttgcgaaattttcaaaa

SEQ ID NO: 33943 - DNA, 784 bp, Heterodera glycines
ttttttaaaatttccccttaaaattttaaaagtaaccattaaatgagagattttttcccttgcaaatttttatcggtttgttccggtaccggcggcactagaaaaacccgttccggtttttatcgttttgaaaaaaacagtaattaatggtagcgctatactcaattttataaatttaatttttcattttttggtcccttggctaatttacgaaacggcggatttttgaaaaggtccatgctagcagaatttacaaaaccacctagcataatttttttttcaggccaattacggtgccgcagcgggggccctacggtacatggaacttatgggattgatcgtatggcttttcaacacgggcgtcaaacaccgccaattgctcacttacatttcaaatgtattggacccgaatttcgacaaagtatttcctccggtgttggccaaaatatgcacaaaagggcccgtcgaatcacatcaattgttcccattttgaaacgagcattatttcaattttgtcttaaatttgttgagaaaatttacgaatttttgaaaactttgcatttaaatcaattttacgtaaaatttttcgaaaaaaaagaaaaaattttctgtccaaaatcgcgccgctgccgataaaaaaagacgcgggggggatgtgacggcacaaaaatgccctcaggccgaaaatttatttattaagaattatttatttatctataaatatttatgtgccttattctgtaatgcttatttcggatgttctctacgattgaggtacctatta

SEQ ID NO: 33944 - DNA, 607 bp, Heterodera glycines
taataataaattaggaaaagcactaatttgtttgacgatggttatggaagtgaagcgacgcgagtacatcggagatggacagggtgacctcctcccacgggcttttgtcatacatgtgaataaaaaagaaaagccatcgtcaaacaaaaacatttttttgttttttaagagagaaaaaaatcccatcacttgttgcttcatattctgcggaccaattcaatggcgcatgaataatttcagctacattggatgatgagagaaataaaaacaaaaatgaataaattgagagaatttttgtttttagacacatcaaaactctgtccatcaaataacacagatgaattatgcaaatatgaaccaattcaattcttttcctacactaaacggtcaaaaatacacttataaattgttaattatagtgaacttttttgtttgattttaggcactttgtataatcaccagcaacaaaaacaacaacaaataaattatgcaatagaacaacagcagaaacaacaaccaaagacggctcaaccgaaagtgaaggaaaagccaaatagtgaaaagagcaccagcaaaagggctgaaggaaaagcccccgaaaggaatt

SEQ ID NO: 33945 - DNA, 815 bp, Heterodera glycines
  misc_feature (790)..(790): n is a, c, g, or t
ggaatggctagtattgctgcctacatgttagcctcaacagcagagagaacaagcacgattttgattggaaatttcataatagttttaatgtgaaatcaaactatttatattcccaggatataaagttcataatagtgtaatggattcaggatatgtcctgaatttttaattttgccgaaatttaaaaaatcacgtgaatccagcatgaaatcaatgcaaatattggccgtcctgatttgttggatttgttctgacttttgaggaatcatgctaaccaagcattaaaaccgtgccaatttggcgctcccaatccgttttattaacttagttgtaactttagaaatgtcttgatttttagagatttgtcctgaattagtgaaaataaaaatgaatgccctcctgatgattattacaattacccttaatcggagataggcaaacagaaaatcaaaatgtctgaaatgttctgaattttgaggaatcacgcaaacgcagattgacaagctaaaaaagtaaattgtccttatttttcctatttatgctaaattcacaattttcatttttgaatacccataatacagtcatggtcataagtgttgtcccatcatgctttgaaaaaaataattgcgtataaattgtcattttccaatttcaacagataagtagcataccattggatagcattttttatgggctttccaatgataccatatttgcatttgtgacataaacatttatttgatttattttaccatattcacaatttgatcaaaatataggtggtcaaaangtgttgtccccatttcatttttaaa

SEQ ID NO: 33946 - DNA, 1326 bp, Heterodera glycines
  misc_feature (65)..(65): n is a, c, g, or t
  misc_feature (136)..(136): n is a, c, g, or t
  misc_feature (1251)..(1251): n is a, c, g, or t
  misc_feature (1263)..(1263): n is a, c, g, or t
  misc_feature (1282)..(1282): n is a, c, g, or t
  misc_feature (1300)..(1300): n is a, c, g, or t
aaaatgtcggggttgggatcagggacgggcgaagctcggcttagtactcgaagccgaagcccttntaataaaataaatatattgaatataaaacttttggttaccggcgatgccggtggcgcctccggggaaattntaataggcactagtgctgctcaagagtctcggtctcgagcaaatttctcgggttttttgggctcggtctcggattttaagtctcggtctttgagactcgagaccgagacttttacacccctaatgtttgcttttggtaaatttttataaattttaggtctttgttcaatcttgtcgccatatacgtggtcaagtgggttgtattcttggatattttctttatttttgcgttggatctgtcggcaatttcatcgccgacgagagtgccagaggagaaagaagcggaattttggttttcaacgccgacggcacggcgagggaattatcggaggatgaggaaaacgaatgggcagggggattttccatcacccccagccgaaccgctggacccgaacaaaaaaggaagaagtgccgaggcgggcgacgctgatcggaaaatccggagggaggacattcccggataaaggccattaccgtgttaaacgatcccatttttatatttgttgacatttttcatcccctttccttttttcttatcgctttaaattttcatttcttttcattttggcttatttacataatgtttttcttcaacttcgccatttgccttttctttccaatttttctgccgtttttcagatctgcctccgatttttgattcctttgttcacactttctcagatcgccatttccatttggccatttttgcattcatctcattttccctttgtttggcatttttacccgccgatttttgtacccatcggcgtcgctttttcgcatcttaatctttgccccccccctccaggaggaaatcgttaggtacttaaagtattgtttatcagttaatagcaacaaccaacaaccgccatcttgtttgtcctccccaccccctccccagttcattcccttgggcccggacccaacgggcagcagaggcaaaagtgctgtgacttgagtggagctcagtgaacgatgcaatccaaatttccttcccgggagttactcccgagggagagtgccgtcaatcaaggagggcagtcctcaaaacatcgcgtgactgttcgatccactcggattactcgccccggccaccctccagccaagcagtacttnccaaggctgtgngacactacacacaattggngacgcgcctctcgaaccnggacgatgtgcgagaatggaacagaa

SEQ ID NO: 33947 - DNA, 596 bp, Heterodera glycines
  misc_feature (40)..(42): n is a, c, g, or t
gtgcctcttttgtcgaaaatttgatgattggaacgaagannncgagaaaagcgagcggagtgtgatgtactgtgaaaaggaaggaatgcttttattgccataaagctttgatttttaatttactaaatctcaaggctcttaaaaaggattttgctgggcaacggacggtcgggcaatggaaatggcacacatttgtaatcgaaccatacaaacagcttcggttcaggtcctttgtccttgctaatttcgattggtctccaaattgtcaattcggttttgccattgaaatgtttgtccaccaacgcattgaaacgtggcgaaagaagtgccaatttgaggccaagttgagcatggtcaaaggatgggaaaatgtccatccaaacgtcgttgcaaatccaacagaaattatggaaaaacagtttagttaaataaatgacgaatttgtgtgccttttaaaatccttttaccgtcggttcatttttgaggcaattagcacaatttggccgagttccgaatgatgtcacacaaaagagcagaataataattcgttagaaactttatttttttaatgagagtcaaagcggaaaaccaaacat

SEQ ID NO: 33948 - DNA, 862 bp, Heterodera glycines
  misc_feature (844)..(845): n is a, c, g, or t
tattcaagtttcccttattaagtggtggaaacattaaagattaaattatagctgtccctgagtgatcacggaaattgaattcaaattaaaatttatttttcctaaatttcaaataacataatccttttttaataaataataaattaaattatttgcaggcttttaaatatatttattcattttctcttttttttctttgccttcaattctctttcttttccgcttctttttcttcttctcattaacctctcttctcgggaatcaatgttttgtacagtttttcgggctcgtccaacaacaatcgatcacacaattctttgccctgaaaattaattaattaatttaaattatttttatttttaattttttaaagccaacctggatgaagcaatggtcctggtttgacacttcgtacttccatcccccgaagcgtcctctgctgtaaatgcaatgcttctccaacacttcatgagtccgagcaagttccacatctctctgatcaattaattataattgaaaattaattattattattattatataattgaaataattctaaaaatatttattgacaaattaatccaattttaattaattttaataatttaaaaatatttattgatcaattttattaaaaattaatttatttttttaattaactgaaattcaataaaaatatttattcatttttttatttcatattttaggagctttcataaaatacagtaaattttaacttttcctcaatattttgctaaatattttggcacaaattttttttgtcaatattttaataaatcctgaatgttttttactatttagaaattttcatagttttaattannagagatatttaattata

SEQ ID NO: 33949 - DNA, 1303 bp, Heterodera glycines
tttaatcttttttctcccgtagaattgaatttaatctttttatttacatttcgaagtttagtttcacttcaggacgaatttttcattaattttttcggcttttctttaaataaataattcctttaatcttatttgtttatctgaaatttcaagtttttcgcggtataataataacagctttaaatcgaccacttgtgcttaactgagtgattttttccacagaaaaggcagtattaaaatataattaaatttcttataagtaagatccggatttgcatggatttctatattttttttgcacttcttaaattgtatttgatgtctgacatcttcgctcttcaattattccaccacatttttgtgttaatatgtttgtatttttaaagatttatttataaggtattttttcatttatgtagtttaacgggattttcaaaatattttattttgtgaattcatattattgaaaaatcatattcgaatccattaataacacagcaattttgaatatatattatttaattaatgagaatttaaacaatttcacatggaaaaacagagcgatgttctccattgtttgacctgcaatagttagattttttgaaataaataaattttattttaaaatttgcttcgttttccaaattgctttataattacagtattttattttctcaaatttttactaagttagtttttaagtttttcaaaattatagatagtttttataaaaatctattaacaaaattcattaaattgtttaaaaatcgcaaatttcgtcgtttttcgataaatctgttaacaaattgcaacaaattttttaaaaaatttaaggcgacacctattgtcacatccggacccaccaaaactgctgtttaatatccctaataaaatttagaacaaagctatattggtattttttcttgataaaaaatttttcaaaatatcaaaatatccttgtccgtatacggtccgtatttcctggttattgttttaacggactagggtttttaggggttttagtccgttagtccgtagtagcatgcgtgctgacgcgttttctaaaaagtgccacccatgcgcgtttcctaaatacgccatttaatataatataaaaattatacaaactattcgattgaattgatttttattatttatgaaaagaagtttctgtctagattatcattaattgtttgccaacatcataagtgaatataagtttataaattttaatttttacttattattggaataaatttaaaaagtgaatgcacataataatacatatcatatgtggcagtaa

SEQ ID NO: 33950 - DNA, 928 bp, Heterodera glycines
tttaatgatttagcgtggaagtgccgacagaacgaagggttaagcgatggggcctaagcgtcatggaactcgtgcgcgaccctatcggacggcaggcaaatgaatgaatgacgaaccaacggttcctttccattttctcaggttctcgaatcctttttggattccgagttctcgtcagagaacctccgcttctggtgttgcatccaggacctcaaattctctcccaattgtcaagttaaaacaaaaggccaacacattttggacgagtttcttgctcccggtgcgccctgtcaggtcctttcctccgttttttgcttccttcggtcaatttttacattaggttaacgtcgactctagaacgcttgaagaaacattacgatgcttggaggagtcggaccaagcattgcgaaaccagaggttcgctttctcagtttcggaggaacacgtgttcacactgatgagcaaagactcgtacccacgttttctccgatccggcatttacaaggctgttttggacgctgccaaggcaaagggtggcagaaaacggatcattgacctgatcagagagctgtcagggagtgccgtaaacactaagaaagtgcctgccaaataccacaaaacatcgcgggggagtgccgatgtggacaatacacaacaactgtcgttgaacgccaacaacttccccaaacagtgctcctccgactcattgcctgtgaaagtgggcagcttgggcggcacttcgccatcactgcaactgccttcgtccggcacttctagcgccagttctcctgcgcttcagacaaaggaaagcaataaaagatagtaaaacacgtctttcttccatgtttgttttcgtacccacgaaaggaatgtcttgactctataaaaatttaaaaaaatgacaagaagcattgattcgattatggaa

SEQ ID NO: 33951 - DNA, 563 bp, Heterodera glycines
agacaccctgttttttgggagtttgaccacttcccatgaaccgatcgagctgaatttttaactgtacgtagcaattctgaaaatattaagattataaaaaggagaaggcgaaatgacgacggaaaaaaattttatgaattttttcccgaaaaaggagtgttaatttaaaatagagacacttgataaaaacgaatcaaatctcaacaactaccaaaaagaaactgataaaacaagctaaataagaaagaacaaatcttttttcacatttctgtttattttgcgtacagaaatatgtcttttggggagagttatgttgaattttctaagttttcaggagaaattaagggccaaaatgcttaaatcgcctctaacatttgcccaaccgaatcaaactaacagcaatcagctctaagataacgtacagacatcctttaagcattttttattcattttatgccataaaaaaggcattgaacacaaaatttttgcgggtgaaaaaatacgaaaatctgagtaaattcgaaaaaaaattctagggggttggaaaaaattttccgtagaag

SEQ ID NO: 33952 - DNA, 1392 bp, Heterodera glycines
  misc_feature (1294)..(1294): n is a, c, g, or t
  misc_feature (1313)..(1314): n is a, c, g, or t
  misc_feature (1376)..(1376): n is a, c, g, or t
ttgcgagtttcgttgatattttttgcgccatattgaaaaagttcccaaaagtcgtactttacgacttcgcttaccaatttaaatatttttccatttttctcgctaaaaatccatttcgttaattttgataaaaaaaatcaaaaattttcaaatttttatttaaattatgaagttaaaaaagaatctttttggtttcaatgacctttcaaacactttaagcatgtgcttgctgtcttttgacaattttctgtaaattttgaattcgtttttcagtttttccgttatgtaatttggcatattttctgtattaaactccgtaattgcgacacataagccaaactgttcggagtttccgttataaatctgtcatttaaaaagtgaaactttaacaaatgccttaatttgtcattttgtatttggtaatatgtgatttcgtcagtgataataatcattttttacgaaaaaacgttttaatgtttcttaaatttaattcgttcgatatttaaattcaaaataaaattatttgctcgattgtcaacctaaatttggccggtcacttacatatctaaaataatttgtattgtgcctcttttttttactactttcatctcctgtgtgttcatttctagatggttggtagccattcattctgctttaatgtcggaatttcgcttttaaatttcttaccaggggtggagcgtgaccgcgatccgcaacccggcaatttgaatgcgtgatccgcaaccgcagaatctttctgtcagcgttccacccctgttttttactaataattttgaatttctgcactttgagtatgttgatgctcttagttcgttttctgtctgcaaatcgaatcgtaggcgtcagccaatcacgttggaagtggcgttcaccttttcgagtgtgtacaagtaactaattttcgcgcagccccgctgaccgaagaaggggcacatgaaaagcacaaatcataatgggttctgcagggcaacaatttgagaatacttgcagaggattttgcaaatcgtgactcgttagaatatttacaagcctattcttacgactccatgaattttttgtaaaatttggctaagtgtacgattttttatgaattaatttccactgacgaaatcaccgggaaccttgtatttcatattaacaaatattttatttgtttttccattaattaattatttattttttatttaatttgtatttatttattcacctttatgtttttttcttctataattatgcttcggtcaacactgaaaaatgagtgcccaatcttttncacggtgccataatccctnncaataatttgctcatcacaatgacttttcgccccattgcgcgctgtgaaacttcttgcagcnaactcactgaattttc

SEQ ID NO: 33953 - DNA, 1466 bp, Heterodera glycines
  misc_feature (41)..(41): n is a, c, g, or t
  misc_feature (1360)..(1360): n is a, c, g, or t
  misc_feature (1400)..(1400): n is a, c, g, or t
  misc_feature (1422)..(1422): n is a, c, g, or t
gatcgtcaccaagttcttcaagaacgatgcgcgtgccgtgnatcagtccttctttatcacttttgttgataaggagaacaacgacggcttccgactttgagtcgcagacggtggggaggcatcccagagtctgtgcgccggttcaacgctgccacttcggactcgatttcatcgatgtccagtggacgctcgtcaagcggcttatccgaggacaaatattcgcgcacttgaccaggcacattcgccatcatgatttcgttgatctcatcacacgtgtcaatgtgcggagcgagaatcaaacgattgagcagctctttgtcattgccaaggagttgttggaagtttggatagacaaagtctatcaactcttccctgctctttacgaggaactgcggaggaatccagaagtgttctccggtctctccgaggccgatttggcggcacatttgcaagtacgcttgctgcccttggcccaacctctggttgatggtcaatttcattgtggtaaactgaccaaacagtggattggtttgaaagcaggccgtaacttgtgcagttaggccttcgtgaggcacgaccggcagtgactgtttaaagtcaccgctgaatatgaccgtttttcctccgaagaggaggtccttgtgctggggaattgccatttctttgcacactcggtcgatgacctctatcaccgtgttgtgcagcatggtgatctcatcaatgatgatgagttgggcctcacgtatccgtcgggcaaagaagctttcaagcggaatgcttggaagcttgtctagcgagacttctctgcctagacggaacgtggaatgggctgttttcccatatggcagcaagatagccgcacacccagtggatgccgtagcaagcactttgtaggtgtatgggaccttccgcaatcgccttataatttggccaaacagaaatgttttcccggtccctccgtcgccgaatataaagaaacggcgaggtacagtcgcatcccttgggtccgactgaattgccttaacaacagcatcaaagaccgtttgttggtcgctgttgagtggaggtggagcgttttgctgctgcctaggattttgctggccaggcgacatattcagatcatcatcaccaaagaaagcttcttcaactgccaaattgatatttttggcttttgaatttggtggatctgggaggccacagtgcacgcagcttgagttaaagaagtgcaatcgccaatcaatgtcggctagcgcttcctgctcccgtgcttggcgtatagccgcactggtgatgccctgtggattgtacatttggtctttgtacttgttccacagttctagggcattactccgctgccccnaagacgagatgctcacgaagagccatctcatctggtccgncagcgatgcaggctgctcgccngagcgtttgtgccaaatttgtcatcttcagaagccatgctgtaa

SEQ ID NO: 33954 - DNA, 987 bp, Heterodera glycines
catgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttaaaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaatgactatctcttattttgagaattttata

SEQ ID NO: 33955 - DNA, 522 bp, Heterodera glycines
ggccaaatgcatcatgaaaaagcaataagcaatttaatttaggggtaatactggaaaattggtgtcccggcgaaaaataaatttaaaaattttcttttcgacttttctagtgtgaaaaaataagctgattacggatctgggctcagaattcgaaaaatcattgattttgtctatgatttttcatcacatatttgattttttaaataaatttacatctaataaaaacatgcattctgggcttttctattgctgatcaagcgtctggcatgacttctgattaatttcgaatccagcaatcgaacgcgcgccgaaaagtttgaaaaagaataacaattttgtattgttgttatttttttgcaatcataatcaaagaaggaagacaaatattcgttaaaaattttattggattaatttttgacacattggctctaaagatatgtaaaaatttaaaagataattaataatgtattcaacaaatcaattttgctctccccgtgtaaccatcgatgacgacgaagcggc

SEQ ID NO: 33956 - DNA, 999 bp, Heterodera glycines
gctgtccgaacattttttctttttttctaacgcatctccaagcggattacaccccatttttggacccgtatttttgtaccccgatcacattctgaaaaaaataattgatgcgctaaccctaagtctccccagttattctgcgcattgctttctccaacgcgagagcaaagcagcgaattgtttcattttcctcctttttgtattttttcatgccgatctcgaccctaactcagcaacgcgtgggcgtacagcagcggcgactgcagcattcaatgcagctcttcaaaagctgtccgaacatatttttctttcttttctaacgcatctccaagcggagttacacccatttttggacccgtattttttgtaccccgatcacattctgaaaaaaataattgatgcgctaaccctaagtctccccagttattctgcgcattgctttctccaacgcgagagcaaagccgcgaatttgtttcattttcctcctttttgtcttttttcatgccgctctcgaccctaactcagcaacgcgtgggcgtacagcagcggcgactgcagcattcaatgcagctcttcaaaagctgtccgaacatatttttctttcttttctaacgcatctccaagcggagttacacccatttttggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtattttttcatgccgatctcgaccctaactcagcaacgcgtgggcgtacagcagcggcgactgcagcattcaatgcagctcttcaaaagctgtccgaacatatttttctttcttttctaacgcatctccaagcggagttacacccatttttgtacccgtattttttgtaccccagatcacattctgaaaaaaataattgatgcgttaaccctaag

SEQ ID NO: 33957 - DNA, 805 bp, Heterodera glycines
aaaaatgattttttgaaaaatttttcgggttttgggctcaaaaaggctaatttagctgctgggggccgttctaatagaggtttttttgaaaaatgccaaaatatggaccaaaatgccaaaatatggaaatatggacataaatcgcgaaatatggaaaaatatggaaaatatggatatagaaattcttcctagaagcttcaaaccaagctaaaaacatgtttttcgtgcgtttcaggcctcccacagtccaggaacaaaatatggatttccatataattggactccctaatcattagggttataaattatatggattaacatgtttttctgcggatatgctatgaagaaaggggactcaaaaatggcatttctacgttaaaattttttggatttggtgaaagttttttgtaaagaccggacgggaccgggatcccgcagggattttgccgggactcccggtcccggccatttcataattccggtatctagtttttagtccatataaatccatattttgggggttttcgggagtaaatccatatttcaccatttttgcctttcaatatggttaccgtagttcctttcccaaacccgttctatgatctttgctgtccgcgttaccattcccaaaattggaataatatcctttattccgaaggtgtgcatacaattatataatgagaaaatgagggaaaggagcggcacccgattcgtacgggacagatggggagggaaggattggacgggcacttggcccaatccccccgatcagaatgaaaagaacaaaagagaggggaacagatta

SEQ ID NO: 33958 - DNA, 974 bp, Heterodera glycines
catgtaatcgcagaccaccttatgcatgcgttcttcaatttgcttgatgtgaacctcattcaacttaaaaagaaattaccaaaaaacagaggaatcaaaacctttgtacgcctaacgcttgtacaacgtggagtgttcgcacccgcagcaaaaagcgtcggcgctgacttccgacgccgagtatctgtgactttttgttgaaaatatatgtaaaaaactgaaaaaacctgcaacgctttcaacgtcgcttgcatcctctcgttgctgtaccgtgtgctgagttgcattgttttgcgtacccacgtttgaactgtgacgggttcttttatttgtagagcctgtcatttgtttaatatatataggtttagtttaaattttgcttaaattaagacctccaacaatagtcaaagcccgtaatccgacagtggtcggagtcgaaacaacactggtgtccagttgcattgccggcgtacccacaatagcttgtccatcatttcgtagttgtctgatttgggcacgaattccagtcgacgttgaaggttctacaaatagattttaattatcatatgaaaagcaacaaaaaccctgatctatgccaaaaggttgttgaccacttgtattcggacccccaagagcattggccacgtcaggtgtctgaatggccgctcgccagcgtaaacgatctgcttcttttcttcttcgatcctttgaaggcattaatttaaaataatggcaaaataaattaatagaatattaaactaaaaaaaacatagttaggtttaggtaacattaaaaatataaaataacatttatttaagcaatggaactcaaaattaaaagagcacattacttttgttaggacaggccgtactaaaaagcgaagcaaaggagtgtgcttttaactatttttgtgcaaagggtacgcagtggaagtgtaggcacgcagggacctcttccatgcattaggctgggac

SEQ ID NO: 33959 - DNA, 1251 bp, Heterodera glycines
  misc_feature (1219)..(1219): n is a, c, g, or t
  misc_feature (1221)..(1221): n is a, c, g, or t
aaaaagggggggggggggaatcgaccaacttttttgttaatgttcgtgcgggggggggggagtcagttggtcgacttttgtgaaagggtcgagtcatgcaaatcggcgacctttttgtgcttgtcataaagtcttttttacggcatatttcgttggaaaactttttttctgggggagcattaccgacgggcgtcaaggaatttcgaaattctggacataggcgctttttcaaaatttttcaacacagacgctaaatagcaagaatttgtagccattttgaacttttcaaaaaaataattggtgcaaacggggcggaagtttgcaaaaaatgaagactaattttgagcattgacaaataaatgaagataatatcaattaatccaaaacagacataccatccaatgggcaagtagatttgcttgttcctgaaaatttcagggattattttatgttgcctctgctaatcaaaacttatttaaaaatagtgattaattaataacttgtctaaaactgtccaatttttcaaaaactaccaaatttatgtgaaatcttaatttttatggaattttcaattcgttaaaaaaataaatcccgttttacagtgtatatttttgggttttagaaaattaaagtcaatagcaattgggataagaacataaagaacgaatacccacatgaacaccgatccggacagaagaatgtaccagcaagtggccaactgaccttttctaaaataaaaaatatatccatgagcaggtttacttattaaagaattgattttctttcagtttgaaatgattctcatgctgtaagtccgtttaaacagtgctttcttcccacctgaacaacacataattggccgggtgtctctccagtcgtgcagttcgacaaacactccgaagaggggagtcgtgtaaccgttcaaaaacatccaaacgacgcaattggttgaatatcacagatacatcctgaaaaatagttcatattctgagtttatatttaaacaactccaaacagttgaagaaaaatctgacgagcttattgaactgacctcttcggtgcgctcatttggacgtcgaattaaagcattgtaaaataaaccagatgaactcatttgccaccttcaatatttgagcaaaatgaataattaattcattcatgtacaaagtgtaaaaaactgatttacataatcaaaagccgaattgaagttacctaattnanaaaggtttaatcaaaatcaaagagaagaag

SEQ ID NO: 33960 - DNA, 900 bp, Heterodera glycines
cgcatgcccattccaactgctcacgggtgccacgcatgcccattcgccaagccctcgggttccaactgctcacgggtgccacgcatgcccattcgccaagccctcgggttccaactgagcacgggtgccacgcatgcccattccaactgagcacgggtgccacgcatgcctattccaactgctcacgggtgccacgcatgcccataagccaagccctcgggttccaactgctcacgggcgccacgcatgcccattcgccaagctctcgggttccaactgagcacgggtgccacgcatgcccattccaactgagcacgggtgccacgcatgcctattccaactgctcacgggtgccacgcatgcccataagccaagccctcgggttccaactgctcacgggtgccacgcatgcctattccaactgctcacggatgccacgcatgcccataagccaaaccctcgggttccaactgagcacgggtgccacgcatgcccattccaactgagcacgggtgccacgcatgcccattcgccaagccctcgctttccgactgctcacgggtgccacgcatacccattccaactgctcacgggtgccacgcatgcccattcgccaagccctcgggttccaactgttcacgggtgccacgcatgcccattcgccaagcctcgggttccaactgttcacgggtgccacgcatgcccattcgccaagccctcgggttccaactgagcacgggtgccacgcatgcccattccaactgctcacgggtgccacgcatgcccattcgccaagcccttgggttccaactgctcacgggcgccatgcatgcccattcgccaagccctcgggttccaactgagcacgggtgccacgcatgcccattccaactgagcacg

SEQ ID NO: 33961 - DNA, 141 bp, Heterodera glycines
ttactagatcggggatcgatccccgggcggccgctcgagcaggacctgcagaagctagcttgatggggatcagattgtcgtttcccgccttcactttaatcgtggggaacaacacatacatgtaggaatttacttcactcg

SEQ ID NO: 33962 - DNA, 1226 bp, Heterodera glycines
  misc_feature (71)..(71): n is a, c, g, or t
cccccccgtctcatcgtccgtcgtatacccttaacctgagacaccttttgcattgtaacgtatgcacgatnttcgaaattacttttttgcaaattataatagaaggaaggcaacgtcaaaaaaatattttttaaaataaaacaaaaaaaatacaaaaatttaaatctgtcaattttttgttccgtttgccattggcgcgtcctctccgttcgctggtgcgatggaatccaacactttgtgacaaatgtcgtccatcatgggcacggtcaaattttgcacatactgtgaaaaaagtatttaaaattggggttaattactttggaagcagcacgtttcccgctccccgaatttttttaaattttaatatttattgttagaattcactaaaaaaacttattgctagacatttttttgtaataattgaaattttttaaaatttctcagcgatttttttgggaaaattttgaaaaaaacaaaaaaattttcagtaattttaataaaatttcttataaaaaggttctgattttttcttgaaaattaagtttgaaaattttaaaaatgtgagggggggggacgtagttgcatttctattattttcaacaaatattcttaccaaattccaccactctgtgctcgcgtcaaaatggaatgtccgtccgatttgctgctcctccatgcgctccattttgaaggacatgtacaaaagggcaatggcaatgacctgacaatgagagggaagcgaagaaacaaacaaaaaaagagaagcaaaattcaaactaattcttaaaagcgtataaaattggcattttggggcactccaaaaaatggcaaataaatattttatataaacaaagtctccaagaaaatctaattatttgttaaaaatttgaaaatgtcattttaacgtcgaattcggtcacaggaaaaaatactttttaataatttttcatttttgagatttccccgagaaattggattaaactatcaaaaaagaaatgactgatacggacaaatctttattatttttttgctgtcacatttcactgattttctgataaacctcgggctcccacaaaaggcacagtgttgtgccgagcgaatcgttgacaaatgtccatgcgttggtcacaattttgctcatgtattccttgtccatgcgaaagcccttggcatattggaccaaaaaagtgtaactgaaaaagaaggcgaaaagttggggaaaattg

SEQ ID NO: 33963 - DNA, 962 bp, Heterodera glycines
ctgtttgccgtcatggtcctcaaattggatccaggagaaagactttgttggcccggatgttggccaaagcagtgcgggaaatggtggccgaaggcaatcgctaatcaaaaattttgtagaaaaaaattttggtggtttttcaaagaaatggctaaaggaagagcagcagcgaacagagcccaaaaataaatgtttaacaataaaaaatactagcaataataatagcaataaaagtcgccgatcgctgcttcaaatgctccccattaaataattgatcatctgaacccattcattcatcatttgtgcgtatgtgaaatgttagccaaaattaaactttagaaaacccaagaaaggaaactcggaaattcggaaacgaaatcggaaattatataaacacaaaattgttataatttcttcaactggcataaatatgtttttaaattcgaattcaaatgtgtgtgcgtccacattaaaaatgcaattagaaaacaaatttaagtcaacgattattttttgtatgatggctaatttagaacaattaaaagtaaaaaattaaattttaatttaaatttcaggaaatgattctcattttgaagcaccagaaccagatgctctgtttagcagccctggtcaacatagtgcttacacaacggagagaagctgatttccatagatgaaaacaatatattgtttgaccaattctagcgataattaaattatttaactattagattagccatattctacaatttttatactgcaaattttaataataaaaaaaaaagtttggttcagccaattgtaaaacgggtattgtgaggtgttcaggcacctttttcccgagaatttattttaatttggtgaattttttcaggaattaacagtaaacatttattaaattcaaaaattggaaattctgaaattaatttcaaaagcgtggagtcaaaatccaccgagcgcat

SEQ ID NO: 33964 - DNA, 939 bp, Heterodera glycines
ccggggacctctagagtctttaggaaggagaattaaaaataggggcctttctattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctaaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattaaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaatcctaaatagacaacgacgctttcatataaagctttaagggaggaaagtatacgaata

SEQ ID NO: 33965 - DNA, 560 bp, Heterodera glycines
ggacaaaatccgttaacaaattgcagtaaaattttaaaaaattttcccggcggcgcctatcggcaccgccggacccctgttcccaaaacatttttttgaaaaagagcaccacaaaaaatggtgtaaaaaagtcaatcatatgaaaaggaaaaatgtatggtagcttaaataaggaaaaaaacaaaaatttttgagaaaaaaactcaaaagattgattttttcgatttttaagtgtgtaagaaaaaatttttgaaaaaagtttcgggtctcgggtttttttggtctcggtctcggggttttgggtctcggtctcgagtctcggggtcgagtctcggtctcggggtcaagtctcggtctcggtctcgagtctcgggaaatttttggtctcgagcatcactagtgtcggggagcaaaaagtcgggggccggggacctcggggagcgacatgtcggggcggggaatagcccaaaaatatcggggtcggggagctcggggtcggggctgacccctatttttaacgttctacgtcgtgtctaagaccataatcgaaattatataaa

SEQ ID NO: 33966 - DNA, 881 bp, Heterodera glycines
  misc_feature (798)..(798): n is a, c, g, or t
  misc_feature (830)..(831): n is a, c, g, or t
  misc_feature (834)..(834): n is a, c, g, or t
  misc_feature (836)..(836): n is a, c, g, or t
gaagaaaaagttccaacattttgccaaatacacttaatttttcaaaaaatcatgcgttttgtcacttttttatcaaaagaacacaaaaatccgcaagtcctcattttccaaaaaaatcctctttgaccctctaaaagaccacaaaatgaggaaaaatcctcagatttcgaagctctgatataatcgtttctattcaacaaatttcatatcattcgaaatctttgttttctaatttttcatcgaactcagtttacgattccgttgaatggctccaaaaatgccttcttatgtaggaccgcatttagtacatcaaaagaagcctaaattttaaaaattttgacaaaatatgaaatttatatgatttaacaaattttgtcaacagaagaaatttaaaattcaattattttttgctttcattcaatttttcggtttgaacaacactaaaaattacgtgaccatattttaatgattttgaacataaactcttgacatgaggttcaaaaatcgattttttaaacattgtttcaatcatttcagtcctgcaaggattgagaagtaccttttaattgttttttttaattgaataaatttttaaacattaatttatttaagttaccaaaaagacctttactcttacaccgctgtagctaaaaataaaatttttaataagaaatattttttataattaattactaaaaatagaaggcggcggaacccatgacgacctttttggctttttttcctacaataactacaaatcaatgcacagcagaagccgctgcagaagacgatgattanaataagaataataaggagtaagatgatattgnnggncngaaagaggtacatggaaattcggcagattggctactaatctaata

SEQ ID NO: 33967 - DNA, 953 bp, Heterodera glycines
  misc_feature (920)..(920): n is a, c, g, or t
caattgtatttaaaaatagaatacaataaaagttaaacttagaaaaatttcataattttttgcccacgataatcaattttctcatttcatatttttaaaataattctcaaaaattaaagaaaatatattccaaaaaacaaaatttttttttattattttatatgggtaaaatgtgaataaatattgcaaaatatttggttttattttgctcattgcagaaattaggagaaacgccacgccattaggggacttcatttcacacacacacacacaattagcagaccaaagggattaatgagcacatggaattgctaataagcaaaagaaaaatgcaaagtgcccaaatgccaaaggatttaaatggatttattttttgtgccgataacataattctcatcatgtttttcgaaaagaaaaaataatttaaatttgaaaaaaaattttttttattctttttgggcacgaaaaagcatcaaattctcctgtcattccccgttcgaattggttggtgtaattagtctggtaattaattaaaatttatgccaaacttggattaagctttcattttttagttagtggcatgtttatgggttggggtgttcgggtttagagaaaaaatgtttggtactcattcaagataatttggagccctaaaattagtcaaaattttttctaaaatagaatcttttgaaaaatccaaaaaaaaaattcggcacacgagaaccaaattctggcatcatttttaaagaaaaccttttgttcataaatttgtggctacatcttttatgaacccaaaatttaaaaaagggcatataggtatatttattaattaattttactttttaaaataattagcacctaaaatatactcattttttggaaggctttaataatctattttttagaataaagaaaattanaattaaaattggcgtaatggtcattttgaaaaa

SEQ ID NO: 33968 - DNA, 70 bp, Heterodera glycines
ctagagaaaatgggcaagcccactgtcaagagcacaaaatttgctatcgaattgtgtttggaatggtggg

SEQ ID NO: 33969 - DNA, 956 bp, Heterodera glycines
gctcgagcgcttttgtaacgtataaaatttctcaaaagaagagatagtcatttttcttggatataagataaatttaaaaattctctgtgaaattaaatggcgattgcgcaccgccctccctctcacgctcgagcgcttttgtaacgtataaaatttctcaaaagaagagatagtcatttttcttggatagataaatttaaaaattctctgagaaattaaatggcgattgcgcaccgccctccctctcacgctcgagcgcttttgtaacgtataaaattttcaaaagaagagatagtcatttttcttggatataagataaatttaaaaatattccacttgcttctgctcaaatgtttgataggcttgtccaacaacaattaacagaagggcatttgggtcgccaaacttttgccttaattaatacattttaataaataaagaaaaaaaattaatgaaattattttttctaccatgccaagtaaagtgaatcgacaatgattccttcggaattgtttgctggcattgcgtcaggtgaaaagttagcaccggattttgccatggttcggcgatgcagatttgtggcacgcgttgccctaccgtatccgccaattgcaccgatgttcatctgaatcttaaccaaaacgatcagattttacgctaaacgggtgagagtgattagtaaatataatttcgaaactaaaaatctaatgtaaagcgggaccgggaattttggggaaaaccccgataatttcctttaaaaaaacacaaaaaaaaattcttattacttttttcaagtgaaaattattataatattaaaccttcttttgtttttcatttcataaaaaccaaaagttaaataggaaatttcgacaaatttgttaacagaatttgttcataaaatagccaagttaagtgatctgtcgatttaaaaaaataaggatgatgttgtgacctga

SEQ ID NO: 33970 - DNA, 996 bp, Heterodera glycines
  misc_feature (920)..(921): n is a, c, g, or t
  misc_feature (926)..(926): n is a, c, g, or t
accccaacccacaaccaccaccaacaaactcctccaattccttctccatcataaatatctgtcgtcttacaccgaatgggaaagcgggggggggggggacgaatttacgaagctttgggaaaacagcctcaagacaaacggagcagtgagaggcgagttggggattatgcagcaaatggaagtggcaaattgggggaggagagagtgaccgatcagaagcgaaggacagacagcgtaatctgagagaagtgagtggaaatggcgaagaacaaaggcaaagtcagaaaagtgacactgaaaaagtggcagcaaaacaaaacaaaacgaagggaaagaaacaaagagaaattggcaaaagtgccggtgaaaaatactctttttgatcagcagcaaaacctaacttaaaaattgtggaattttttcagatttttccctcaatttgaaataagttttttggggtgttaaaacatatgaatgactgcaagtgttcatcaataaaaatgaagtgataaagtttcgtgaattttactgagtgagcacagaatgtttttgaacaaaacgccgcctttctttgattttcttggccttttgatcggccggtgctttcgctgttcgccgtgctcatcaatagcagcagaatgtcttttttgtcggcctttttcgccaaagcttttgttgcacaatcgccattcggcaggaaaactttattctcgagataactaaatccttttttccttattattttacagttaaatatatacataatttgagtgggaaaaaacaataattcatttttacgtaaaactgctaccaaaaacaagggtgtgctttgttcttatttctaagaaatgttctgatttggaaggtacaaatctgagaaaacaaatgaattttggtgaaattttttttgagatttttgnntcgantcgggtccggggttcgaaattggtcgaaatgggtatcagattcgtgaccaacgacctcgaaaaccccata

SEQ ID NO: 33971 - DNA, 983 bp, Heterodera glycines
ctaaatataaattgcataacaaaaaatatttgccatgtatgaaatctacagaaattggaagaaattcaataataataatgaacgtttaaaaatatataaaatattatgccattattaaataataagtgaaaatgccaaatccaaaaaagaaaagctggtgccaaaaccaagacagccgtggaggttgtcgacaggtaaagtaaactaaaaatatgccaaattaatcgaaaaagcaatgattccaattgctaaatttaatattaaagcagtttgtgaactacaatttaaaaaaataaaaacgattttaggataatccataaagtgtaagcaaataatattatttcaagtctccttatccttaataatttacttgacaattgaacgtttgtccataatttttatttatcatagattttcattatttacctcagtgaatttaaaaaataaagtaaataatatatcttttgcttaattatatgtaaattaattatcttttgttttgcatattttgagcagttttacagtaatattataattaattaattgaatattttattttcatttattgtttggaaattgttggattttatttattcatttgcgactaaaaaaattgttttatgctgaatagtattttaatatttattcatcaatattaattctttgctcatttttatttgtgttggtttactttttcattagtactcgtgtaagaaggggaattttacttcgtatagttcctgacatattttagaaaacattttttatgggttgggtttcggatttaatttagttgcatatacaaatattcagcattgaaaattttttctgagctttaattagtttgagtaattcagaaaggcatgttgaatttattgcttaggaataaatgaaattgaaaaattacattttcatattgaaaattgaaataatgaataatttaagtgttttttaattgttgaaattatatcatgattgattga

SEQ ID NO: 33972 - DNA, 897 bp, Heterodera glycines
agagaaatgccatgggactgggggggagagacggacagagcagagaaatgccatggacttgggggagagacggacagagcagagaaatgccatggaattggggggagagacggacagagcagagaaatgccatggacttgggggagagacggacagagcagagaaatgccatggacttgggggagagacggacagagcagagaaatgccatggacttgggggagagacggacagagcagagaaatgccatggacttgggggagagacggacagagcagagaaatgccatggaattggggggagagacggacagagcagagaaatgccatggaattggggggagagacggacagagcaaagaaatgccatggaattggggggagagacggacagagcagagaaatgccatggaattggggggagagacggacagagcagagaaatgccatggaattggggggagagacggacagagcaaagaaatgccatggaattggggggagagacggacagagcaaagaaatgccatggaattggggggagagacggacagagcaaagaaatgccatggaattggggggagagacggacagaccaaaaaaatgccatggaattggggggagagaccgacagagcagagaaatgccatggaattggggggagagacggacagagcagagaaatgccatggaattggggggagagacggacagagcagagaaatgccatgtaattggggggagagacggacagagcatagaaatgccatggaattggggggagagacggacagagcagagaaatgccatggaattgggggagagacggacagagcagaagatgccatggaattgtggggagaaacgcacaaacagaaaaatgccctggaattggggg

SEQ ID NO: 33973 - DNA, 145 bp, Heterodera glycines
ttcttggcacacaactcctgaaatccttggaatctccaaagtgatatctttttgtatgccaatgatggatggatggccagcagcccctcagctttgagatggggactggtcaccagaaagacaaaggcagggtccccaaccttct

SEQ ID NO: 33974 - DNA, 492 bp, Heterodera glycines
atgatggccaaaaatgcaaaaatttgccgcggggtgcgacggcgtatttttggacaaagaatggaaagggggaggggggcgggattggcgctgggtattatttggtggtcccctggggcccctccttttactgcccccccccaatccaaatgagtctcgtcgcctcccccacccccgggggcccccgtcccgtctttgtgtggtctcgacttggcaggcagcagcagtcgtcgttttatcgtcgagattgggcgcttcccccccccccccctcgggcgtcgtccgtcgcccgaggtgctccaccaccagccgccaatctctacacatcccctcgtccattctcgtcttccatttgcctctcgcccatctctctgccgccgccgtttttgcattgtgtgtgtgtgttgtgttgcactcactgtcccccccccggggtggacaggaggggcgataggacttttcccttccccacaacacttcgatgggggaagg

SEQ ID NO: 33975 - DNA, 1129 bp, Heterodera glycines
  misc_feature (113)..(113): n is a, c, g, or t
  misc_feature (124)..(124): n is a, c, g, or t
  misc_feature (145)..(145): n is a, c, g, or t
ggttgcaaaagatgcgctcgccgagcatccaaaactgtggccgtgctgatcactgactcattcgggctttccatacggcagggttgaaaaaaaattagaactttcaaaaaaantaatcaaattntaggtcgcacatcggagggtnctcgacaacgtgggccagtctgtacaccattgtgcagaccgccaagtttttccacagcgctcagtgtgctgcgattgcttttccaaattcacagtgccaggcaaaacggcgaaaaccaaaaattttttaaattttttttccagcgatggcctctccgatcgcttttacaccgccttttaccgtcgcctgctcaatttgcagccgggcaaccagcagcacgacttgcaactgttcacactggcgcaacaagtgctgcgcaacgatttggtggagtgccgcgtccgtgccttcctcaaacgcttcttccaggtgccgccagaaaacatgggagtgctcggcactcgagcacactaaagggtccggaccaattggcggcacacttgttaaaccggatgaaatgcccattttgtcggacgggcatattaaatttttggcttttttctcttgagagaaaaagagtggttccggtggctcagtggttggaactgaacatcacgaaatgggtggaggaggcgtgggttcaattcccacccggggccaaccaaataagtaacactttgtcacggtttgtttaaagggaaacctttccaagttgtcaaattccgctttcccattgctatgtgacgaagcgggccaaagacttgggaaattgtcatttgatttggtcggcatatggaatatggggaatacgcctttccttggcatttcccatcagatgcgccggcacattttgtcaatcgcattcctatgggcttaatcgaattaatttgccgtaaattctaaaacaaatactcccgaaattattgttttttttttttgcaattttagccgtaagtcaactattcctggggctttaactgagttcacttacctaattaggctaattagttaatagttttttttcagattgctctttcggccaactcggcattcgctgcggccattctgctgatgtgccattccgttgtgcgggaacgaccgcaa

SEQ ID NO: 33976 - DNA, 1229 bp, Heterodera glycines
  misc_feature (485)..(485): n is a, c, g, or t
gggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatccattctattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccagattttatttacatgttagtttaggcactctgatgctttttctatcaataatggaggtgaagttcagaattcaataaaaataacattcacggtgcgaaaaatggggtttgacaagtttattggggaaaaaaagactntacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataa

SEQ ID NO: 33977 - DNA, 461 bp, Heterodera glycines
ttttctcttccctctcactcactccatctctctctctctcactctcactctcactctctttctcccttctccgttctctttccccattctctctctcctcccccccccccccaccttctccctccttttctcgtttcttccctttgtctccctctcattcctcgcatattaccaatttgtaaaatctttgttattcttatttttgtatttttatatttaatcaatttttttaatagattttcaattaatttatatattttaaaatttttctgtgtttaattattgattatttaattggactgtttgtgtggcgacgtgaagtctgggcaccgggaagtttgggcaccagagtaagggattccaaaaaatgaaacaatataaatatataaaatgttatataaatcattaaatttagtaaattttaacaacccttatgctcaaaaatttctatgttcttgaaa

SEQ ID NO: 33978 - DNA, 885 bp, Heterodera glycines
tgtcgtcaaaaagtaccaattcttctcacacctttgactgacactgatcagcatcaaacgaattccgctgctcaaactaaacgtttcaacccaacgatcggccaaatgacacagaatattttgtcggagcattttgaaacgcccattggccaactgatggcacaatttgacatacaaattcaaattcgcgacacggactttggtgatgctcggtttgtcgacatggaaaagaattggtcagctgaacctgttgacaatcgcggtgcctacaaagtgatgctccatccaaaagtgggcgcccgcagaattgtacatggacaagaagaacgttccagcagccaaatgagcaatcggcaaaatgaaatgttcggaaatcaaacagccttttagcagaaaattctttttaacttgaaaatttatattagggtgctgatcatgaattagcattaattttagcagaaaattccgattccctgacccgaactaaacaaaaatcgaaaactccaacattttaatgttcgaacctgtacagaatgactatttttaatgaatgtttcagtagtttgtgttaaatgtttgtttgtttttttcaattttagaaccaaaatgctcaatttgaaaaatttgaattttcggtttttggttcgcttcaggtctgggatttttaataggccaaatgaatgccgtattcatgatcattttttggattctaaatgaggaatttaatatttttttttccaaaatccgttttttattgagtgttaatttagcaatcgttctcttctttgaaagttttgccggtttgaaagagcgcaccaaaatgttggggcattgatcagaaagtttttgataatacaatccgaaacatattttttttgaattttt

SEQ ID NO: 33979 - DNA, 1015 bp, Heterodera glycines
ggggagcaaaaaattccaccgcagaatttaaagtccaggctatactccatcttcctttttgatactaaagcattagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgttaggggtactcaaacaattatggggagcaaaaatccaacgcagaattaaagtacaggctatagggaagctattccggaaggattcaatctccccataaatctgggcgcatcggttcggggggactggactctagaacaaaaaaaatcgatttttttcagtgtccgtttggggtactcaaac

SEQ ID NO: 33980 - DNA, 807 bp, Heterodera glycines
ggcgaaaaaaccgttgcacagctttgttcgatttaggtattacaacgcagacgaacggcaatgcgtgtccttccaatacaatggcaaaagagggaaccaaaacaactttctgacccaagacgagtgccaattagcgtgtcccggtgggaatattagccgattaacccccccccccccccccatcgtcaattatcaataatttgattcccttcaatttcagctgaactttgtcttctgtcaatcgaccgcgggtcgtgcggggggcgtcaaacgcgttatgcttttgaccggcaaaaagtggcgtaaattaaaattcgaaattaaagtgtcaattcagtcccaatgcgtgccatttgagtacagcggatgcgggggaaacctcaacaattttctgacaatgcaagaatgccagcaaatttgtgggaatgtgcggagctgaaatcacggctaaacggccattgttcaaatttttctcagaaaaaatttattaaataatgaaaatatttttccgaatgttttttcggaattcactgaccaaaaccggggatcacagaaacaatttgaaaagtaaaggcaaaaaatgtccgttcttttcctccgttccgtcggtcacctgagtgagcacccgtcgtagtgggacacaaattcgaattccttttccggaaagtgcacaattgtgcgccatgaaagctgaattgttttgtttttgtttgcgttggcattctgttggctttcgccaaatcctccgacctttgccgcctttgccattcgcattttcgcaactttgcaatgaataccttcgatttt

SEQ ID NO: 33981 - DNA, 893 bp, Heterodera glycines
attattaaataattaaatgcgaataataataaaataatttataaaatgtgaaaacccaagcgccggtgaattgtgcggggatccaacactgaatcggttggccgacgtatctgaagggacggacggagccatggaaatggaaacattggaaacgaaactgtttggcggataatgtgagagcgaaaatgatgaataacattggcgtgtagtaatagttgagtctgtccacaatgtcatcgtcgaattggggcttaagcccctggaggaatttgtccagaaaaaacatcaaaaatcagcagaagaagacggaggcggaggaaaagacaaaaggacaaatgccaagaaaacgagaagaaaacataaaaggggaagaagggttgaattaaaataatggatcaaattgaaattcatttaaatcgcatcgattctctccccctctcactttccttccttagaatgaatggtccatcgcctttctctctccctttttgtgtcctttcgtctccgtctttttagcagcagtctctcccctctcctcccctaaaactgcattgaattccctcaatgttttggtcgatcggttgcctttgcccgcccctttcgtctcttttcagtgagttgcgcaaaattggcggatttgcacagaaacgggaaatttccctgacaaagtaagttggaacattgggagaatttggaagagagggggtgaggggaagagagagagggaagagagtgggtgagaggaagagaagagggaggagagaggtgtgaggggaagagaagagggaggaggaggggggagggaaagagagagagagggaagagagggggtgagaggaagagaagagggaagagagggggtgagaggaagagaagagggaggagagaggtgt

SEQ ID NO: 33982 - DNA, 851 bp, Heterodera glycines
tctgctctttaagttcgcctcgaaaagcatttgggagcaaatatgttgttctacaacggccagcaggcggagaagggccgacggcaccagcgccattccggtgattttgcgaaaaaattttgaaaattttcccttacctcaggctatggcccatcggtgcagtccaccgctgctggtgctggcagtggtgaggacactcagcagtgcaccagctgtgtgcagctccaatgtccgcccggccccccagggccgcccggcgtcgcgggcgaagacggcgcggacggactgcccggcagaccgggaaagcccggtcggttcatttggccgagtgggatttacatttgatttcaatccctaaggcttggatggccttgacgttccgctggagcccgagccgagctatccatggtccgtttgagacgaacttccagtacagactcggtcgagaattcaaatttcagtgtcatttgtccggccggaccgcctggcaaccgcggccctcagggcgaaccgggccgtcccgggccccaaggagaaccaggaccaccgggtataattgttttttaatgttaactttcttttatgctttataggactcccgggccgaccgggaaagccgggccgagtgggcgatgcggggccccccgggtcacgcggtgagcctggcgagcctggcataaaaggtaaatttaattggggtttttcaatcatttccattttcggagttttaaggccctcccggagacgatagcatcggcggcaccggcatcaaaggaccgccggggccaccaggtcagaactgaaagaaatgtgtggacaaatggagtatcacttgtcaaattaaggcccgc

SEQ ID NO: 33983 - DNA, 1022 bp, Heterodera glycines
  misc_feature (25)..(25): n is a, c, g, or t
  misc_feature (27)..(27): n is a, c, g, or t
  misc_feature (34)..(34): n is a, c, g, or t
atacaaatgcgaattttccaatgcntnaattacnaatgaaaatacaaatgcgaattttccaatgataaaattacaatagtaaaataaaaaatacgcatttccacttaatgcgcattttcaatcattaacaacaactgaaaatacaaatgcgcattttctaattattaaattacaatagtaaaatacaaaatgcgaattttccaatgatgaaattacaattgaaaatacaaatgcgcattttctaatgataaaattacaatagtaaaataaaaaatactcattttccacttaatgcgcattttccaatgcttaaattacaattgaaaatacaaatgcgaattttccaatgataaaattacaatagtaaaataaaaaatacgcatttccacttaatgcgcattttcaatcattaacaacaactgaaatacaaatgcgcattttctaattatcaaattacaatagtaaaatacaaaatgcgaattttccaatgatgaaattacaattgaaaatacaaatgcgcattttctaatgataaaattacaatagtaaaataaaaaatactcattttccacttaatgcgcattttctaattattaaattacaatagtaaaatacaaaatgcgaattttccaatgatgaaattacaattgaaaatacaaatgcgcattttccaatgataaaattacaatagtaaaataaaaaatacgcattttccacttaatgcgcattttccaatgatgaaattaaaattgaaaatacaatgcgcattttccacttaatgcaaattttccaatgatgaaattacaattgaaaatacaaatgcgaattttccaatgataaaattacaatagtaaaataaaaaatacgcattttcgtttaaggggcattttcactcattatcgtctacagacaatacataaatgcattatacataatgtcatttcctattgagaatatagacgagaaagtccaatgataaagagacaatagtaaaataataaatacgcattttccgaataatg

SEQ ID NO: 33984 - DNA, 957 bp, Heterodera glycines
  misc_feature (940)..(940): n is a, c, g, or t
ctttgtctgtcgccgattcgctgcaggcaatcaaatccatttgaagttcaattttaaaaaataaattctcaagatcgggctgcattttctttgacaatttttgatgcctgtttttgaacctaatttaaattataatgtaaatctgacttttaaaatgcgaagttgaaaggcaattatcgaaaaagtcgcctaaagtttctctactaattatctgttaatttatttttcattttagcccatatatttagttaattgacctcaacagattttcaaaatttccagctttaaaaaccgcaatattctggtatttaccaaggctgtgaaacagatacatgaaatacaaaattggaacctaaaggttaagctgtgccggattttggcccgacttaattccaactccggagaccgaactccaaccaccatccactaacaaataatttgttgaccgagccgtagccatgcggaaagcctccgtcccatcggataaaaacagccccggatatgctttttaggaggagcctttccttttcaataaatattcaaatccatagccgaaaattaaatcccggccttacagtgctgagccacaaaaatttgatattttgctccaaacgttaaagaccaaaggtgcaaaagtgaagaccagccttggaaacttagcccggatgtaaaagaattcctattggatttccaattttggtgtcgcattccctagtttaggctaatggatgttcgcagttttttcttccttttccttatttttaagcctcactgaattttgggaaaatctctaacttaccagtgataaaatgccaaaaaattggccataaaaagtgctctcgtgtgaacatctgtttcactgtcactgtccatataatttagataatatttgacttgtaattggcttatttcgtctgatgtcaaatctgattttaattangagggaattaaataatt

SEQ ID NO: 33985 - DNA, 1025 bp, Heterodera glycines
  misc_feature (807)..(807): n is a, c, g, or t
  misc_feature (825)..(825): n is a, c, g, or t
  misc_feature (881)..(881): n is a, c, g, or t
  misc_feature (886)..(886): n is a, c, g, or t
  misc_feature (922)..(922): n is a, c, g, or t
tcattttacattttctaggtcattcccagaacattagtttatttgcctattttgttttttcttgatatggcacaatcggtccattgcggcgaccggtattttcttatctattttatatttgactgtccgattgtccactgtccgattgtccactgtccgattgtccacttctgtccgattgtccacttctgtccgattgtcctcactgtcggattgtcaactgtcggattgtccactgtccaattgtccacttctgtccgattgtcctcactgtcggattgtccactgtcggattgtccactgtccaattgtccacttctgtccgattgtcctcactgtcggattgtccactgtccgattgtccacttctgtccgattgtcctcactgtcggattgtccactgtcggattgtccactgtccgattgtccacttctgtccgattgtcctcactgtcggattgtccactgtccgattgtccgggagcccttcagactgcttccacatgtccatcatcgaaccatcatttcgaacaattttttttggcacagatattacacgtgcaataatacatatagactttttgttaaaatatttccaaatttccaacattttttttttggtttattaaagcataaaaaatcattgtagaatttagttagaaagaaagagatggataaagacaatttttgttacagtttctttattgtgggctttttggtgtaacgacggataaatgccgacactcgcccaaaatgacaatgtgcaaaaaatgcaaatgcacatattcttttttctaaaacaatctncaatataattttacttanaatttctattttttgaaataataaagtgaataaaaattaggttaatttcaatcatncacanaaattataaattgtttatgatctgtcctccatctcncattttggtcttaatggcgattaattacttttttattagcatttaatttggaccttctttggagcatcgcacaaaggaaaatgattttaggtgctaaaaactg

SEQ ID NO: 33986 - DNA, 1372 bp, Heterodera glycines
  misc_feature (115)..(115): n is a, c, g, or t
aaaaatagatgaaaaatttttttattaagaatttttttcttgaaatttttctgtttgaaaatttttttcaaaagcttgttcccagttttttatgtgaaattcaaaaaaatttctnaaaattaaaaaaaaattgaatattttcgctaaattttttttacaaaaattccttattctaaatatgaattcgggcgggaggacccttttcaattgtcccttgaatttttttacattaaatttcccttaccaaaatgtacttattgtatttgcttgcttgcttcagtgtatcatcatcacgcgttggtaccgcctctttttgcactgtccccagtgcgcacaactgctccgaatgagggcgtccaaagcgtccgcaacgtgcacacattgccagcaagatttctacccaaatgtggggttgcctttatagaaaattgaaaattttgtgattttttgaaaccggaaatttcttttatcccgcagtgtcaataggtgtcgtcatgttttttttttgctgaattggtttttaaaaaatggtcccaaaatttaaacagaaaaatagtttttgtcccctgtgggcaggcggtgcaccccaaaacgtcttcggccgaaacgtcgtcggaagactttttgaaccataactttgttcactgtcaatcaaattaagaattgttggtgttgttcaatagctctatgtgtttattattaatttgcaaaatctacaaaaattttcgttaagtttcaaaaaagttatggccagaaggaactcaaaaccccagtaattcgaactttttttgctctgatttttttgtgcataaataaaaaattttgaaaatttgcaggctaatagcatttttcgaatgctttcgaataataccaagaatgtttaatttggttgagaaagaaaaaagttatggtcgaaaaattcgttcgacgacgttttgtcctactccggcaaaaaaaaataggtgaaaacctaaaaatccgttccctgctaatgacgactgatttaagcgaaagacccggggaaccgttgaataagaaaaataaattttaagatttcgcattttaaaccacgaaaaagcgttcgatgttttgttgatttattttcgatagaatgcttttcaataataattaggaatgggaatttaagtcaaatgaccacactttctttgattacgccttggttttaccctcggacgagaataaaatttcgatatgattctttttaaatgcttcttaaagtatgtaagtaaaagtgctgttattttaaaatttaattaataaaatttccaccgaatattgttcaacaacaaaaaccttgcggattttttgtaaacctcacaaagtctccaaacacaaaaccctcctcaataat

SEQ ID NO: 33987 - DNA, 841 bp, Heterodera glycines
agtgaattttgtgcaatccgcgcagaatgtgctgcatcatcgttttgatgtccaccagtcgaattttcacttgggtgttactcaacagaccggcaagatcgtgctcgcaaaaggtgaacaccaagtaaaagcagaatttctccttcccactcttttctaaaacaactttttagtggattcgtggcttttgctttgcttttttttacgtttgcttgtgcacacttccaccagttcagttatgtgctgatgtcgaagcctttgtagcatttttatttcgcgaagtgcagttattggaaactgaaaatgaatatgcaaatgggttcctccggtgccaattcaccccttccttttcattttccatcaaaatttttttcagtgccaccaatttgccagttcgcttgcaacgcgccttgaaaacctcgctagaaagttcactatattaaaaaattcgctccgtcttaagcacccaaatgttccttgtccaatcttcaacaactgctcgtaatatgtcacttcgctgacatagggatagttaaaatgctcagtatagttcaagagcttctgtgatattcggcattgttcgagaattgcctaaaatattacaaatgataaacaaacaaatcattgacaaagtgaacgaaccttcactttggtgtcatagtctttggaatttccaacaccgttcatttccaacatttaaactgtgacagttgaaaaagaaaattaaataatgcttaaatctgttcaagtaacaacatacaaaatagcggggtcgcccccagcccagcccattcgccaggaaagggccaaaatgggtgcccctttcacggacggaaaaaaa

SEQ ID NO: 33988 - DNA, 1251 bp, Heterodera glycines
aaaatggggttgaaagtttattgggaaaaaaagactttacaaataatacccctggagaagggagtgggaacatgattttcaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattgtgaaaaaagactttacaaaataataccccctggaggaagggagtgggaaacatgattttcaaaaattttcatgttttctagtctaatctactcaaaacgggtcagaattcaataaaa

SEQ ID NO: 33989 - DNA, 887 bp, Heterodera glycines
aaaattaaaaactcaaaaataaaagatggaagtcctattgtgtgagtcatcgataagctctgacgcttcatccgtctctcttttcgatttccaattggacaaacattcgccacggtcttccccccaccaaaatcccttcgcagagcaaaagctcccattgcaaatggaaaagcttttctgtttgtccctttgaccgcgtgtcggacgattttgcaatacaatgaaaggggagggggcggagagtgaagtggacggacggaaggacggaggaggacgaaacagcgacgaaagtcaaagccaaagccagctgagcacagtcaatccaccgaattcggacaaatgagtaaagaaaggaaaagggaaaaagcagcacaaaataacatcggacaaatgatctatgttggaattgcaaaagcagagcatcttaacttcgcaaaaaatgagatacgaagacggagcgagcaattagtggggcgcccgagaaagcggacggttgcgagcgcatggctaacaataaggtcgggccgaggcccaccccaggcgcgagcaacgcaaagcaagcgagcggagccccacttactgaggccgctgtagtcgagtatgcgccgctttttagcataataggcaaatggcacggcttatttttaggcagggttgggatcgtacaaaccctcttcccaagaacaattttttaaatacatattaaaactttcgataagtgttgtatatcaaattcaactcaaacaaactcgaaaaaaatacttgtttaaactgcagtgaaatggatttagggggattttaacctttaattaggaatttgatcacagttaaagaattaagacactttgttttatatttgaatgcattggcgttttttacgccaacaa

SEQ ID NO: 33990 - DNA, 605 bp, Heterodera glycines
gatgccgaagaatccgtgaaaagtgaaggattgagtcccagtgatgggaatgctggtgagattgagtcccgggaattggaatgatggaaaattgagtcccgatgattgcgatgccgaaggaccaggtgaggttaggtcccagtgattggaatgccggagaactgagtctggtggttgcgatgccgaagaatctgtgagaagtgaaggattggtcccagtgattggaatgctggtgagattgagtcccgggaattggaatgatggagaattgaatagaattgagtcccagtgattggaatgtcgcagaattgagtcccgatgattgcgatgccgaagaatccgtgaaatgtgaaggattgagtcccagtgattggaatgctggtgagattgagtcccgggaattggaatgatggagaattgaatagaattgagtcccagtgattggaatgctggtgagattgagtctcagtgattggaatgtcggagaattaagtcccgatgattgcgatgccgaaggattaggtgaggttaggtcccgttgattgggatgttggtggattgagtcccggtgattggaatgccggagaattgagtcccggtgattg

SEQ ID NO: 33991 - DNA, 973 bp, Heterodera glycines
  misc_feature (817)..(817): n is a, c, g, or t
ggcaataaaaaattggcgcaaaaaatccactaaatcttttgctcctaaatcgctaaatcggaggtatgtttttcagcaggaaataatggaaccctttttcaaagaagaaatttcttcctttcccgccttttccctggggggtcaatcagaaggggcggagtcgttatttaaaaaaccatcattatgaaaaattttgtcgaataattatttataattttgctctaaagcaactaaatgtttaattcttgatatattcgatagccctaagtgttctctatcagtctgcaaaatttcaaaaaatttcgttaagtttcaaaaaagttatagctcgaggaactcaaaaaaccttggttttcgaacatttttggtcataacttttttttaaagttataaatttttttgaaattttacaggctcttaaagaacacttagttctatcgaatgatatcaagaattaaaaatttggttattttagagcaaagttataaataaaatttttattttgatggttttttaaataacgcacatacataatgatggttttaaaataatgacatagcaccaatcagaatttttaattttttgccttatcttaaatgttttgttcattttaaagaaaaatgacgacaaatttacggacaatttgacgacagagacaaacgacctaatttttgtcgtaacgataaatttggagacaaatgccaaatgtgtgatttgtcgtccgatttgtccttcgtaattatgattggcctccgttcccgtaaaaagtaaaaatagtgccccgggcaaaaaagaccagaaaatgggaagggattgngatttcgggactggcggatttccgcagaagctcgagaaaaagcctaccagtgttgttgcttcaaaatctttccaatgaatgttgtctaaaatgattgcaaaagaagccgtgtctccaatgtgtgggccacttttgcgaattgcccaatctgaaaaa
